United States Patent 12,329,181 (MICROBIAL FEED SUPPLEMENT COMPOSITION AND METHOD) - sequence listing, part 3

SEQ ID NO: 260 - DNA, 305 bp, Lactobacillus buchneri
gtttcagtaaaatacgtatcagttaagctggcgccctgtttaagtttatcaaaatcaaaacggtcaaccagcacataccgcttatggaaacgggattctttcgttttaacactatttacatcaaatttagtggcttgatacgttttaagttttgcttgacgctgtttagtttcattttcaaccgctgctaacttttgttgcccctgcttaatagattcccgcatggctttatattctggtaccgttaaacttttacgttctgattcttgaaccccacgctgaatattgaaaccatgctgttgtaa

SEQ ID NO: 261 - DNA, 305 bp, Lactobacillus buchneri
gttctctgcaagctagtgcggaagaaactgctaagtatgaagttaagtcgtctgactatatgactgccgatgatgaccgtaacttagaagtgattaatgatctagagtatgctttggctggtacacggcaaattagttatggcggtcttttttagcagatcaagcaagatttaaaacttgaggacgttgataagggtgacttagttcatgttggtaatgaagaatatagcaaagagcaaatggaagctgcggaagaagtcgttgcaaagtgggactttaaaaagcaaaattattttatgtggtag

SEQ ID NO: 262 - DNA, 305 bp, Lactobacillus buchneri
ttaggggttgtggggaaactttgcgttttcgtaagatcaataatcagttaaaactctaccagacttggttttgtcagaaacgcttatgtccgttgtgtaattggagaaagagtatgaaaaattcaagtcaattaaaacaaattattgcggaaactgttagcagacagcctaagggccgttttttatttttaacactgacagttaagaatgcttatggtgcagaagagttaagaagttcattacgagttttaaccaaggcgtttaataagcttacccgttataagaaagttaccaaaaatttactt

SEQ ID NO: 263 - DNA, 305 bp, Lactobacillus buchneri
agcggctaaattaaagccatagatcaaattcaaaggcttggaccatctaattcatcatgccgttccttaaaacgctcctgtggcctctgaggggcttttttagacggttcttttagtccagctcgttctagccactcatttggtaaaccaatacctaatttgcgctgtaagaagcggtcaacgctccgaacaattccttgtagcgtcccgactagcttttgaagacgacgattctcaatgtctagttccatagccttactttcagctttaatcagttggtctttttgaatatccatatcagacct

SEQ ID NO: 264 - DNA, 305 bp, Lactobacillus buchneri
gccttgcggcctcggcttaggtcccgactaaccctgggaggacgagccttccccaggaaaccttagtcattcggtggatcagattctcactgatctttcgctactcataccggcattctcacttctaagcgctccaccagtccttacggtctagcttcattgcccttagaacgctctcctatcacttgaccgaaggtcaagtccacagtctcggtaatatgcttagccccggtaaattttcggcgcggaatcactcgactagtgagctattacgcactctttaaatggtggctgcttctgagcca

SEQ ID NO: 265 - DNA, 308 bp, Lactobacillus buchneri
tattagggtccgtctgaaaactttatttcaggcgaatcagaatcgccgccaagtaaacgcgttctaaataaacgtgagctaacttgtcatagcgggtcgcaattcgccagaagttcttcagttgattgaagaagttttcaattaagtgccgttcaggatacacgtagtagtccaccggccatttctctttagcgttactcttgggcggaatggtataggtgccttcctcagcttccaagtattggcgaaaagcctcactgccataggctttatccgcaatcacattgacgccggcaatttttaactga

SEQ ID NO: 266 - DNA, 305 bp, Lactobacillus buchneri
gttctctgcaagctagtgcggaagaaactgctaagtatgaagttaagtcgtctgactatatgactgccgatgatgaccgtaacttagaagtgattaatgatctagagtatgctttggctggtacacggcaaattagttatggcggtctttttaagcagatcaagcaagatttaaaacttgaggacgttgataagggtgacttagttcatgttggtaatgaagaatatagcaaagagcaaatggaagctgcggaagaagtcgttgcaaagtgggactttaaaaagcaaaattattttatgtggtag

SEQ ID NO: 267 - DNA, 368 bp, Lactobacillus buchneri
caccccttctcccgaagttacggggtcattttgccgagttccttaacgagagttcactcgctcacctgaggattctctcctcgactacctgtgtcggtttgcggtacgggtagttgatgactcactagaagcttttctcggcagtgtgacgtcggttgcttccctacttaaatttcggtcctcatcaccacttgtcaacccgccaaaaagcatttaactctttgactgactcgtggcttgaacatccctttccaactggatgcacaacttagcctcctgcgtccctccatcgctcaaacatcatcaactagtacaggaatctcaacctgttatccatcgcctacgccttgcggcctcggcttaggtcc

SEQ ID NO: 268 - DNA, 305 bp, Lactobacillus buchneri
tctagttttcaaagaacgaattgagagtagacctctcaaaactaaacaaaactttcgacaatgtgcaggattccgtttttccttagaaaggaggtgatccagccgcaggttctcctacggctaccttgttacgacttcaccctaatcatctgccccaccttagacggctggtccccgaaggttacctcaccggctttgggtgttacaaactctcatggtgtgacgggcggtgtgtacaaggcccgggaacgtattcaccgtggcatgctgatccacgattactagcgattccaacttcatgtagg

SEQ ID NO: 269 - DNA, 305 bp, Lactobacillus buchneri
cttgaatttacactttaagtgcaacactaattaaataaagaatggcccatggccaaatttctgtaaaatgatgtttgcgaaaacaatcatgaaaggaatttagccatggaccactacaagcatattaccatagatgaacgggaaactatctttttaatgaggaatcatggaaactcacttcgtgagattgccagccatatcaagaaaagttactcaaccgtttctcgagaattaagccgtaattctactggtaaatcctattcaccttcgaaggctcaggagaagtacaaacagcgcaaaggcaa

SEQ ID NO: 270 - DNA, 305 bp, Lactobacillus buchneri
ttgtcggcattgaccttagacactttgagtctggcgaatatatcgccgtcgatcatattagtaagcgtggtaatccatatgcccgcaaaattctgtatcgaacaattctcaatatgatggtaagtgctcgcacaaagccatcccacatcaataattattgccgggaaaggaaaaagcaatcttctggaaaggctgatttcaagaagattgccatgggtgcaattagtcgtcttaaccggactatttaccacttgatcctaaataaccagaaatacgattatctcaaaactcgaccaaaagctgag

SEQ ID NO: 271 - DNA, 326 bp, Lactobacillus buchneri
ttagaaactgtttgagatctctaaaagcggcgtaggaaaactgagacaaacgctaaagttaccatcgttgtactggtgtgcagctgtcgttcacagtttttccagagccgacgatatttttccaaccagctaaaggagcgttcaattatccagcgttgtggcaacacttcaaatttatgtaactcatttcgtttggcgacttgggtggtcgcttttaaattaagctggacatccatggcgaaattgcggccactgtaaccaccatcaaccaatacgcttcgaacccggcgtaagttttcggcgtttaaggctaacatggcactggc

SEQ ID NO: 272 - DNA, 352 bp, Lactobacillus buchneri
gagaatctgatccaccgaatgactaaggtttcctggggaaggctcgtcctcccagggttagtcgggacctaagccgaggccgcaaggcgtaggcgatggataacaggttgagattcctgtactagttgatgatgtttgagcgatggagggacacaggaggctaagttgtgcatccagttggaaagggatgttcaagccatgagtcagtcaaagagtcaaatgctttttggcgggttgacaagtggtgatgaggaccgaaatttaagtagggaagcaaccaacgtcacactgccgagaaaagcttctagtgagtcatcaactacccgtaccgcaaaccgacacaggtagtcga

SEQ ID NO: 273 - DNA, 305 bp, Lactobacillus buchneri
gtcaactccttatcctcgctcccgtcggtcgttccggtaccgttgactaccagtcagtatccggttttaattacaacgtggtgcaaggattaagttcgaaggagcttaggcgactgaacttaatttttacaccatgttccagcatgctagggcttggctagcatgctttttctgattattttttcaaaattcaagaatcccaatttcacagcatttataagtcctaggaatttgctacattttttgattttgtcactttaaacgaaaaaattgagagtaaaactgctaaaaaaggcatttttctc

SEQ ID NO: 274 - DNA, 305 bp, Lactobacillus buchneri
cgttaagcagtgtacctcattggaagacttggaatatctggttcaaaataccccggatgatttcaatgtctacaccggtgaagatgcccaggccttgtctgctaaagcagttggtgccaacggtgtcatttcagttaccagccatatttacggccgggagatgcggaagatgtacgacgcccttgaatcaggggatgttgagactgccggcgacatgatgcgtttcttgacgccaaaagtgcaagccttattcatgtacccatcaccgtcatgtgtcaaagccattttgaatgttcaaggctttg

SEQ ID NO: 275 - DNA, 350 bp, Lactobacillus buchneri
ttatgtaactcatttcgtttggcgacttgggtggtcgcttttaaattaagctggacatccatggcgaaattgcggccactgtaaccaccatcaaccaatacgcttcgaacccggcgtaagttttcggcgtttaaggctaacatggcactggcgccgtcacggtcagagacattggcccgcgttaaatgaatggcttgcggaaagccattcatatccactgctagatgccgcttaattccggaaattttcttaccggcatcatagcctttattctcggccgtttcggtatttttaacactctgagcgtcaacgataatgaaggaagttaacgccgaacgatcctgcttgga

SEQ ID NO: 276 - DNA, 374 bp, Lactobacillus buchneri
cgaaaatctcgttacctgcttattggtaaagctgctaaaagaacttcagaagcagtcacggatactttgagcgacttaatgaagctatggcctggtagatcgttaacgattaccccggataggggtaaagagtttgccaaagttcaatgtttaactgataagtttggtacgcccttctactttcccgatcctcactctccttggcaacgaggaactaacgaaaatactaacggcttgcttcgcgaatatttgccaaaaggaactgaccttgattcaattactgaccgccggatacaagcatatgcagaacaaatgaataatcgtccccgtaaatgtctcggatggaaaacgccttatgaaatattctttaatgt

SEQ ID NO: 277 - DNA, 366 bp, Lactobacillus buchneri
gatcaaagcttacgtacagctccccgaagcatatcggtgttagtcccgtccttcatcggcttctagtgccaaggcatccaccatgcgccctttttaacttaacctgtacatcacgacgtgatgcaaagttaattgagtatttgcgatttttttctagttaacaaactcaaaataacgcggtgttctcagttgaaattatataaatacaatttcaaaaaaattattacagaaaattaatattatctagttttcaaagaacgaattgagagtagacctctcaaaactaaacaaaactttcgacaatgtgcaggattccgtttttccttagaaaggaggtgatccagccgcaggttctcctacggctac

SEQ ID NO: 278 - DNA, 305 bp, Lactobacillus buchneri
aaaccggatactgactggtagtcaacggtaccggaacgaccgacgggagcgaggataaggagttgactagctaaccaaaccctagacactgaattggctgaaagccaaagttttctaaactttgctttcctgcctaacggcgagtgaaggggcgagtttgagcgggtgctcccgctcattttttgcgatcaagctggttcagcttggtctgggttcggggcgacagcgcccgagggtttgaaaccgtcgttttttgacggtttcttcttatcttgatacatagtagacacaattattttttctaa

SEQ ID NO: 279 - DNA, 305 bp, Lactobacillus buchneri
aggtctgatatggatattcaaaaagaccaactgattaaagctgaaagtaaggctatggaactagacattgagaatcgtcgtcttcaaaagctagtcgggacgctacaaggaattgttcggagcgttgaccgcttcttacagcgcaaattaggcattggtttaccaaatgagtggctagaacgagctggactaaaagaaccgtctaaaaaagcccctcagaggccacaggagcgttttaaggaacggcatgatgaattagatggtccaagcctttgaatttgatctatggctttaatttagccgct

SEQ ID NO: 280 - DNA, 314 bp, Lactobacillus buchneri
gtagccgtaggagaacctgcggctggatcacctcctttctaaggaaaaacggaatcctgcacattgtcgaaagttttgtttagttttgagaggtctactctcaattcgttctttgaaaactagataatattaattttctgtaataattttttgaaattgtattttatataatttcaaccgagaacaccgcgttattttgagtttgttaactagaaaaaatcgcaaatactcaattaactttgcatcacgtcgtgatgtacaggttaagttaaaaagggcgcatggtggatgccttggcactagaagccgatgaa

SEQ ID NO: 281 - DNA, 305 bp, Lactobacillus buchneri
gttaggcaggaaagcaaagtttagaaaactttggctttcagccaattcagtgtctagggtttggttagctagtcaactccttatcctcgctcccgtcggtcgttccggtaccgttgactaccagtcagtatccggttttaattacaacgtggcgcaaggattaagttcgaaggagcttaggcgactgaacttaatttttacaccatgttccagcatgctagggtttggctagcatgctttttctgattattttttcaaaattcaagaatcccaatttcacagcatttataagtcctaggaatttg

SEQ ID NO: 282 - DNA, 305 bp, Lactobacillus buchneri
acctgtctgtctcgcagtcaagctcccttctgcctttacactcgttgaatgatttccaaccattctgagggaacctttgggcgcctccgttactgtttgggaggcgaccgccccagtcaaactgcctacctgacactgtctcccgccacgctaagtggcgcgggttagagtgttcacacagcgagggtagtatcccaccaacgcctctgccgaaactagcgttccggcttcaatggctcctacctatcctgtacaagctgtgtcaacacccaatatcaagctacagtaaagctccatggggtctt

SEQ ID NO: 283 - DNA, 305 bp, Lactobacillus buchneri
aaaccggatactgactggtagtcaacggtaccggaacgaccgacgggagcgaggataaggagttgactagctaaccaaaccctagacactgaattggctgaaagccaaagttttctaaactttgctttcctgcctaacggcgagtgaaggggggagtttgagcgggtgctcccgctcattttttgcgatcaagctggttcagcttggtctgggttcggggcgacagcgcccgagggtttgaaaccgtcgttttttgacggtttcttcttatcttgatacatagtagacacaattattttttctaa

SEQ ID NO: 284 - DNA, 423 bp, Lactobacillus buchneri
agaagctgtctaaaatctcttaagtaatagtgctaaaaacgctaaaacgaccatttgcagactggtggttaattgacgctcacaatttttccaaagtcgccgacaattctctagccaactaaaagatcgttcgactacccaacgttggggcatgacttcgaatcgatgcaactcattgcgcttcgcaacctgcacggttgcgtttaaattactggctacatcgagctgaaaattaacgcctgaataaccaccatcaactaagacattttgaacctggcgtaaatgcatggcatgtaaagcgatcattgcactggccccgtctcgatcagagacgttcgctcgcgtcatgtgaatggcctgcggaaagccattgatatcaactgccagatggcgcttaatccccgagattttcttaccagcgtc

SEQ ID NO: 285 - DNA, 305 bp, Lactobacillus buchneri
agattatcagtgtgaatttgatcaaggtaattcggcaagtattcacggattttgtttaaccctaagcgctcaagattatttaaaagaatttgattattagtggtcatggtagcctcctataagttgtcgtaatcagtcatatgttcacgaatataagctgaaatgtcttcatctgtccgccctttaagcaaatcagatttgaggatattgaactgatcttgggggtcataattcagcgaattggtagttatggagtgcgtacgaatttcttctccgttataataaatgtggatgcgctgctcatc

SEQ ID NO: 286 - DNA, 305 bp, Lactobacillus buchneri
gacaatgtttcagtaaaatacgtatcagttaagctggcgccctgtttaagtttatcaaaatcaaaacggtcaaccagcacataccgcttatggaaacgggattctttcgttttaacactatttacatcaaatttagtggcttgatacgtttttagtttcgcttgacgctgtttagtttcattttcaaccgctgctaacttttgttgcccctgcttaatagattcccgcatggctttatattctggtaccgttaaacttttacgttctgattcttgaaccccacgctgaatattgaaaccatgctg

SEQ ID NO: 287 - DNA, 372 bp, Lactobacillus buchneri
ctgtgacagcagccattctcgatcgcttggttcatcatgttcacgtagtgaagatcactggtaaatcttaccgattacgtggcctcaagtaactgccgaaaacctacatttctttctgccgaaaacctacatttttaaactgcccttgacattgagacaatagaatttaaaaaaatcctgtcaaatcagtggataaagtcgctgatttacaggatttttaattcttgaattgtcaaattaagtgcaacactacattaaagaatatttcataaggcgttttccatccgagacatttacggggacgattattcatttgttctgcatatgcttgtatccggcggtcagtaattgaatcaaggtcagttccttttg

SEQ ID NO: 288 - DNA, 305 bp, Lactobacillus buchneri
cgggtttccaacgacattcgaacatcccttggcttggcgaagtcaaccaagcttcaaaccagtcaaacagataccgatgacggtcaaggggcaacccaatcatcatcgacatataatggctattaaataatcatgaaccataaaatagcggcccagataaaagcaaaccaacttttatctgagccgctattttttcacaatcaattttatgtaacttttgctttttaaaccaataccccggcatagtagccaagaactccgataacgaatagccccagaataatccagattggcgaaattcgcct

SEQ ID NO: 289 - DNA, 305 bp, Lactobacillus buchneri
agtaacaaataagtgttccgcagcttgtctgaagaactgattgtgagtagagatctattaggttaggttgccaagttacagcagggttaaattaagcggttcagttggttgacatcgattacccggttatactgttaaatgaaacaatgatcaccattaatggaggaagcaatcatgaaaaaaatcattttaaccgccttagccttaggggctttagcgggtggcgtaggcttttcaaataatcagtcaaccttatcggtacaggctagtaccacctatacatgggggaaaactaagacctaccc

SEQ ID NO: 290 - DNA, 305 bp, Lactobacillus buchneri
acctggcgtaaatgcatggcatgtaaagcgatcattgcactggccccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaaggaagttaaagctgaacgtccttggtaagttcgccgagcaatgacaatttttttaaaacttgttccaataaagaatcagccgtaggctcagct

SEQ ID NO: 291 - DNA, 305 bp, Lactobacillus buchneri
tgatttttatccgggagtcagacggtgagtgataagatccatcgtcaaaaggggaacagcccagaccaccagttaaggtccctaaatatatgctaagtggaaaaggatgtggagttgcatagacaactaggatgttggctcagaagcagccatcatttaaagagtgcgtaatagctcactagtcgagtgattccgcgccgaaaatttaccggggctaagcatattaccgagactgtggacttgaccttcggtcaagtgataggagagcgttctaagggcaatgaagccagaccgtaaggactggt

SEQ ID NO: 292 - DNA, 305 bp, Lactobacillus buchneri
gggcgatcccccaactactcttggcgtgcagaagcttaacttctgtgttcggcatgggaacaggtgtatccttctggctatcgccaccacactatttttccttgaaagaacttcgttctctcaaaactagctaatattaattttctgcccttaaacaccatttctacttggttaagtcctcgaccgattagtattggtccgctccgtacatcactgcacttccacttccaacctatctacctgatcatctctcaggggtcttacttccatataggaatgggaaatctcatcttgaggtgagtttc

SEQ ID NO: 293 - DNA, 1606 bp, Lactobacillus casei
gcgttctgttatgaagtgacccctgtcaaccccatctttataagattttcgatattgtcgttggcactaacaagctccagaattccgttgtctctcgacatttaaccactctgttatacggggattggctaccccaggttaatggtcccgtcgaaggctttagaatctaatctatagtcgtggatcacaaactctttgtctctagatatggccatacccagggcgagcctgtgccaaaatagaacgctcgtaaatagccagaccgttgaattctgacgcttgttgctaccagcgacaatatcgtgacgctttagtccttgatacttcttgctgtcatctttgttgtttgaatcttcgggctcaattgcgctttggtgatcagtagttgatattgccagtttccataccccagataaatccagcgagttctcgggcgactgcggcgattgccacgttatatgattttccttgagtaagcatccgcgtgaatttgcgatgaagatgagcgcctgccttatcggcatagctaataacggctgattcttgtcctgcttggcgtgcttttagggctcttgatttgtacccaatgctgcccttgaccaatccctgtgtggcttcaatgatggttgtgcggacgatactgttaccttgcttcgaaatcccccctttgatggtatgatcgccgcttgaatgttctgacggatttagcccaacgtaagacataaacgctttagctgttttgaaacgtttgaagtccgcaatctcgatgtggatggtcatggctgttgtggttttaaatcccttcatacttgtcaacgcgtgaatgggcttggtgtaacgttcactgttcgcaaacgtctcgatggtctggtcgtagcgggcaatcttttcctctaattcagatttctgcagcgtcatttcgtcaagcactgaccgtaataccggagacaatgggactttctttagccaatccatataggccagcgtccacttggatgctgagcacttcaatccttgacggagaaggaacatgccgatttgctgtttcactctaatgaggtcctttttcatcattttacgtagtctaatgaattcttttacctcgttatccgcttcatcagggacataaacggcacaatacgtattagctgcaagattcttggcgatcattcgcgcgtccattgaatcatttttgaccattttgttcttagcggaactatacatcgttgtcggtgccagaatgatacagtcaatgcctaagtttttgagtgaacgatagagtgaatatcctaaaataccagcctcatacccggtcacgaattttgtgtctgattccagttcttcagctaatccgttaataaatttttcgactaattttggctctgaagcgcactgggtctcagctaagagcgcacccgttgctttgtctaacgcgcatagactgtaagtggctttatggacatccatcccgacgtaaactatactttccatgtgagtgacctcctattgtcatggggtaatgattgtatggttcgttttaacacaacaccattatcagtctaaatccccgagtcgacaatctagggggtcacttcatattatctat

SEQ ID NO: 294 - DNA, 174581 bp, Lactobacillus casei
cttaccccagaagaatactggaataaggccatctaaaagctaccaaaattttatattatttcatctgtcaacttgacagggccgaccgcaaagactgagttactttttccgttttgtatttcttttattttggttataggcatcctcaagcttttgaacggcacggttatattcagaatcgagtagccggatagcaatgaagtcaaccttagatttattatctgaaagcggtatctgcatgacttgaattcttagtggcagatttgattgttcgaagaatccggctattgcagacagaaatacggttgcgtgcatgagattgtcataggatgaaagattgttaatggtaaagacgacaaagttctcaattttttccttttctagaagatctgacacgtgaaatcccttggcgaagatgttgatggttctatcaaattgtgttgtcatagcaaacctccgcaatgatggtgttaaccaatgtttaaaatcaaaaaacataaattaatttttatttttttgagtgtaccggtttttcatttatgtgtcaataagttttggaaacgttttttgaggtgaaagcgattgaagttcatgttggaatatcgctatacttatactttgagatttttcggaattttgagaaagcatattgctgtccatgataccattcagcaattgacttgctcgcatgagaagcggctttaacgctgaaaggatggctaaaatggaactgacgtacttgattccccacatttttgcaatggtggtacttacattgacgctcaggtttaaaaattctgctttaaaaaaagagcggcaacacagagaaatcagttttgaaaattcaaatctcgatcaggaattacaagccaaagttctgaaacaagaggcagttctaaatcagcgacacttcatcactgaaatactaataaacgcgcaattcgcaggcgtttacatcgccgctttttgcttttcggccggagttctttatgcagaggagagcactggcgtttatctttttccgagcattggtgttttctgcttgtttgctaatatcctgtttgttgtagaagagcaagcttttcggctttataaaaaacgacaacttaaaaagtatctcgcagttgatcgaggtgtaaagatcatagaaaatcacggggcaagacggtactatgtttaccttgctttattgattttagaaggattcattaatcttggattattctatgcaatggcagtctggctatattaaaaaatgtaccacggtaatctgaactgggtacattggggagaagaaaacgatggatatttacatgccttacatcttagccgcgtttctttgggtggcaacgaccatttacagtcgaataattaaaggaaggtttcgaaaaaacttagagaagcgtttgaaaatgagccgttctgagattatgcgcagagaggcgatagatcgaaagtttatcgataatgcaatcgggaaaattttcaaccgtattctagccggtgtgacaatcagctatatcttcattttttctttttcgctgggggctattacggtcttgccggctagcaccaaggatgcttatttaatagtctcgatttttctactgttgttcgctatttatacatccgcaacatcattttttctccagcgcgtcggcaagacgaacaagaataagttgccagaggtttcatttgtgaagaggctggcaggtgttgtgattcgagacttcgggagtttcctgatctttttgatttttgaaatgaattcattttaaaaaaataaggttaagcgtacaaataagcagcacggaactttccgtactgcttacgcgttaaaaagctagcatttttctaagtgattttctaagtgaataggagcactctaacagcgttaaataaaccacccaacgctgtgacagcccccgattctggtaatgttgaggtcacaattagacctactacgacaatagtcgcaaccttttcaagatcaacagcgaaggtggggttaggctcggtcactggttgatagacaggatcatagtcattttgaggcacctgatctttatgaatgtaggtctccaatgtcaaagtaaattgattttccacagaagaacttgtacttgtgttttctacagaactctcaattgcaactttaaatccgaccatcccatcgcgaatagctagaccagctttaatggcaccgttcccgatcatcggggcgagcttgttaaaggttccagctaaatcaccaacattatatgaagacatggcgctttcaaactgttctaagatgtcggtagattcattaatgattttagcatcttggattgtcagaacgcctgttttattatcgactacggttgctgaccatttgtcctccaaagtgacatagtagtcggctaacggggtcgtaatatgttgtgtaggggaggagaccgtccaattgatggtgccaaataaattatgatagtcagggaaaatgctcaaaagtcggttcgctacgtacgccttttgtgttgctggtgttgcttctgtgacagctgaaacaccctggtctcgaccggaactcgcatcttgatcaatatcaatgccataaattggatattcgacaaattggtcgaacgcccagttgtctggcatcttaaatcctaaattgccactccatccgtatgacatattggcaacaaagctgtagtttataccagttttctcagcgtgaagacaaacatttcgagtcccataaatgccagctttgtaaattgaccgattcaaaacgttctgcacagcattgatgtacggaataaccgtcccatcaatgtcgccttcctgaaaatcaacgtccaccgcaaagtagatgacagtgtcggcaggtaggcctaggctaagcgctgtactgattgctgtttgtccgtctttttgaccttcggcggcagtgaagtaactttcaacgtagccaccatcttcgtagatcgggaagaactttaaaccgccatccagaattgttttgacttctgttgacgtaagattctttggtttgaaatcagcaccgactgttcctgtgagataccggccaacgatgctgaatccatagtcgcggaaatgttgcacatcagttgccgtcagttgggttgctgtatcgagcgcgattgaatcgcggcctgtgtcaccgttactggtaacgagccctttgatgactgtgtagtctgcaacaccggagtcttcgtttggatacttcatgaatttgcgaaatttgataatgcttgtcgctacatcggatccaaagttttcaccaaaatcgccatcatattttatcttctgccaagcgaccagttagtggttacttgttaacttggcaaaaatgctcgcgacttacgcaatctcatcaagcttgcgatgccgcgcctgcagatagagaccgcctagcaagatgattgcggaagcggcgactgataggaaaaacatgttctggtaggcttgttgggcgatggcatagaagttttgcagcagctgatttttatgcgtgctggcggcgagtccctgtaggccgcggtagaagctttcaattgaagcggtgccgccttttaacgctagtttgctgaagccggtttgaatgagcgtggcgtaaatcgttggggcaattgtcaggccgatttggcggctgacggaaagggtgccgagtgcgacgccgttgtctttttggctggcgatttcagacatgaggacggagaatggcgcgcccatcagcatgccgaagccgataccggcgactgttgaggcgatgatgaaccacagtgttgtggggctgaggaaggctaccattgcaaagccgattgttgaaagcgtcccggatacaatgatggatttgatggcgccgagtttgccgactaacatcccgccgaccccagcgccaacaattgaacctagaccaatgccactcatccagacaccactgttgttggctgaaatgccgtatcgctgctcaacgaagctggggatgaagacaaagacggcaatcaaagcgccggataagaggcccataaatagcgtcagtaagaatcccggacttttaatgagtttgtagggcaggaaaggatcgacgttgccgcgaatgcctttttcaatccgcgtgaagccgaagaaaaaggcgagacttagtaggaacaggccccagacttgtggcgttaggacgctggccagcagttgatcactgcttaaattggtaatggccagcatcatgctgaaaatacccaaggttaagaatacgagccctttcagatccagacctttgatagctgcggctttagtttcgggaatggcgatgaagccgctgattaagatgaagacggcgatcggcaggttgatgaggaatagccagtgccattgaccggtgatgtttaagatcaggctgccgagattgggtccgaccaccgaggcgatcccattgacggcacccagcgcaccgagcaaggcgccttgttgcggtttggggtaagttgccaggatatggctagacgcaatgatgaaaattccgccaccgccaatggactgcacgagtcgcgcacctaggaagaagataaagctcgggcttagcgcaacgagcaatgacccgatggcaaaaatcagaatttcaatcaaaaataatttgcggcggccgaatttatcggctagcttaccgataatcggcgttgcaatggccatgcccaaggtatacagggtaatcgcccatgttccttgaacttcattgacgtgaaaagaataattgatcgttgacagcgcgctggaaatgatgccgttgtctagcgccgacatgaaaacgccaatgataaagatgcttaaagcgaagacactgttctttttggtcattggtgtgtgacctcccataatgttgataacgtgacgtttgattttgagtgatggtgacaccgtgtcactttcagaaatgagcataacgttaaagtgacacggtgtaaactttttgttctcgattatggaatggaggcaaattaaaagcagcacagccaatgtgatggcgtgctgcttgggagcgtgggtgtgcctttaaaatcagttcgaagtcccgaaagcaggttgtcccaattgttagattatatttctttccctcgtgatggctcttcggaagcaattccaatgtttttcttcatggcagcgaaattaatttttcggatggtttctgtgtgccatgggttcattcgctgaggctcatatctcaatgtaccgtcttcggtaacgaataaaagatattcctgaccttcagtaacacctgcttcagcgggtatcggcaaactgagcaggttaccggtgcgtttaacagtgaatgaaccgagtgtttgactttgatgctgttttgtactcattggcctgtcctcctgtaagtatgagtatatcgattcaacttggtaaaggcacgcaaaaagaatgggcagacaaagtagttttacttatagtcaaaaacgcgtcgatcgattatttttcgtaaatcgatcaacgcgttttctatttttttataaaaagttttccaacccaaccaccaactgatccgcttcctgcaccttgcgaatggcgacggcaacgccttgcatgaagctttggcggtcgaaggagtcttggcgaatggtgagggcttcacccgggccaccgaagagaacttcttcgtgggcgatgtagccggggaggcggacggcgtggacagggacgtcatcgatgcgttggccgcgggcgtcgttgtcgatggtggacaatggcttttgggtacgtccggcggcgattttgtgcgcagtggcgatggcggtgcctgagggggcgtcggctttgtcttggtggtgcatttcaatgatttcggcatcagggaagtaggcggcggcttcttgggcaaacttcatcaataaaacggcagagagaccaaagtttggtgcgatcaggccgccgaggtgtttcgctttggctagcttgatgaggcgatcctgatcagccggcgccatcccgcttgtgccaatgaccggatggatgccggcattaatcgcggcttcggtgttagcggcgactgcgccgggattggtgaagtcgacccagacatcggcgacgctagcgttgagttgatcgtaacggttgaggactttgacttcagccggcaatccgtaattttgtgggttattgatggttattttagggtcaaaaacggcacttaatgcgaaatctgaatgtgactggatcattttgacggttttttgacccatggcaccgcgaaaaccggcgacaagaacgtgaatcatgcgagcacctccgcttcaatggctgatagttccggaacgcctaaaagatgggcgagttcctgttgttgtttggcagttaatggcagtattggcagacgcgggctgccgacgttgaagcctaatgcgttgagcgcagccttggtcggggcaggcgatggaaaatggaataaggcagccattttcggcaatagttgccgttgcagcgcagccaccgtcgtgatgtcgccgcgatccaatgccgcatacatttcccgaatgctgtgtgcgtaaagatgggaagcaaccgagatcacgcccataccgccgagcgttttaatcgtcagcgcctgagcatcttcgccggtccagacactaaacgcatcgtgcttggttcgatcaatgatgtcactcagggcggcgaggctgccgcattgcttgatgccttggatcatggggttttgcgccaacgttgccacggtttccggcagcatctccacgccggttcgaccggggatgttgtaaatgatgatcggcttttgagcgttggccgcgactgccgtgtagtgagcgatcatgccgttttgatcaggcttgttgtagtaaggcacaaccaccagtgttgcatcaatcccggcaatcccgccgacttcatgggtaaaatcaacggtttcccgcgtattgttcgaccctgaattggcagtgaccagtgcccggccgtgaaccatgtcgacaaaccgcgtgtacaaggtgattttctcgtcatgactgagcgtcggcccttcacccgtagtagcgccgacgacaaagccatcggtgccttctgcaatcagatgatcaaccaaccgttgcatgactgcgtagtcaatttcatcgcgatcattaaacggtgtcacaatcgcggtgatcaattctgctttttgcattcaaaaacctccaattaaagtgagcgtgagccagcgcgggtagaagccggagtgtaagtggccttgggcgtgatggcggtctttgccattgcgaccaaggtccttacacgcaggcttctgcgctggcgagcgcgttaaagtgagcgtgagccggcgcggttaggggtcggagtgtaagcggccttgggcgtgatggcccggtcttaggccattgcgaccaaggtccttacacgcagacccctgcgccggggaacgcgttatggttgagcgtgagccggtgctttttacgggtaagctcctgcgccaaatgctccggaacgcatatggtgaaagccgtctcggcgcatcaagcatgagtcaatatcgatagctactgattcaattattttccgccatccggtgttccagaaaatgcacaactgctgtgacacctggtgctaacgcagcttcgtctggcgaaaagtcggcggcatgtagttgggaatccggatcgttgacgcccagccagaacatggtgccgggaattttattcaatagatagccgaaatcttccccggtcatcacgggtccggtgggtgcaaacgtgacggctggatcggattgcatgtattgaatgaaatctttggtcagctgcgggttattttcgaccggataatagccaccttgattcaaatcaacgttgacgttgcagttgaagctggcggcgattccccgaccgatatcgcggatacgttgctgtaagaaatcgatttgtttctgggtgaatccgcgtaaagtaccttccaagtgggcgcgtccggcaatcacattgcggatcgtcccggcgcgcatcaggccaaacgtgatgaccgcgctgtcggtggggctgacgttacgggcgacgacggtttgaatctggttgataaaactggcggcggttacgatcatatcgttggcattttgcggcaaggctgcgtggccgcttttcccgatgagatcgacattgatttcagttgtcccggcaaaaagggtgccaagccgcgtgctaatagtaccagccggcaagtcggggcgatcatgcagcccataaaactcgtcgatgtgccaatcaccggtgaaagtgcccatgtcgtaggccaatttaccgccatttttgctttcttcggccggttgaaagaagaaaatcaaattatcttttggctggtgatgggcaaaataatccagaattcctagcgcgactgtcatgtggatgtcatggccgcaagcatgggcgatgccgggatgctgcgagctaaacggtaagccggtttgttccgttaccggcaaagcgtcaatgtcggtccggtagccgatggttcgctgcgggttttgtccgtgaactttgaccagtaaggcagtcggcaatttaggcagtgtccgaatggtgaggtgggtttgcggaaaactttgcaccgttttaagtaggaaggcatgcgtttctttttcctgcaaggctagctcggggatttgatggagctggcggcgaatggcaatcaattcagcttccttcattaaaggtcacagctttctgagttcgtcgagcaggacggttttggcttcggtttgatcgttaacctgcttgatgactttggcgggaacgccagcaaccaccgtgtgtgccggcacatcgttaatgacgacggccccggcggcgataactgcaccttcgccgaccgacacaccttcaagaaccacggcattggcgccgatcatgacgtgatcaccgattgtgacaggcttcgctgacggcggttctaccacgccggccaaaacggtaccggcaccaatatggcaatgcttgccgacaatcgctcgaccgcccagcaccgcacccatgtcgatcatggtgccatcgccgatttcagcgccgatattgataatggcgcccatcatgatcaccgcattgttgccgatcagaacctggtcgcggatgatggcgccgggttcgatccgggcattttccgctttgatatccagcaaaggaacgccggtgttgcggcccgcggcttcgacatagtaatcatcaagcttggcctttttcagaattggctggataatcgcccagtcgccgatgaccgttccggtgtgctccccaacgaatgcgtgaacactttttggaaagtgcaaatcagctaactcgcctttgagatagaccttaacgggtgttgttttctgactgttggcaatggttgaaatgatcttttgggtgtctaattgtgccatgatggcctcctatttggttgcggtagtagcgttgttggcggtggttgcgggtgctgacgagctcggtgcggcgtagtggtgatcgtgctgaatcaagtcagcgtaagtttcgcgcgtgacgaccagctgagcttggccattttcaacgaaaacgacggccggccgcgggttgcggttgtagttggatgccatggagtagccataagcgccggtgtcgaaaacggcaacgacatcacctggctgcgtggcgggcaatggggcatcgtcgattaaaatatccccggattcgcagtacttgccgacgagatggacatgctcggttggcttggcggtcgggtgatcggcaaccaccgcagtgtattgcgcctgataaagggcgggccgaatgttgtcgcccatgccgccgtcaactgcaacatatggccgcagcccaggtacgtctttacggctgccgaccgtgtaaaggctgtagccggcggggccgacaatcgaccgccccggttcaatccagactgccggaagctgccaatcaagctggctgctttgcgtcttgagggtgctcagaatggctttgacaaacgcttctggcggcaacggatcatcctgactggtgtaagcaatcccgaaaccaccgccgacattgagcacttgcggggtgaaaccgaattgccggtgccaattgtcaaggacagccagcagcttttgggtgacggcttcaaatccggctacttcaaaaatctgcgaaccgatatgggcgtggatgccgagcagattcagatgttcgtcggctaaaatctgcttggctgcttcatctgcctgtccgctttcaagatcaaagccgaatttactatcggtttgaccagtttgatcataagcatgggtgtgggcactaatcccaggagcgacccgaatcaaaacatcttgttggccaactgctgcgttcaagagctcatcaagcagatccaattcatgaaaattgtccacgatgatcgtgccgacgccggcatccagtgcttgttgcagctcagctttgcttttgttattgccatgaaagctgacttttgccatgggaaaatcggcggccttagccgtgtacaattctccgccggaaaccacatcgacgtgaatgtcttcagccttcgcgatatcgtacatcgcaatggtcgcaaacgccttggaagcataactgacagcataacggacgttggcagcctcaaaaacttgtttaaacgcgcgaatctggtggcgaatcgcttcgacatcatacacgtaaagcggcgtttgaaacgtgtgcgccagctgactggccgcaacgccgccgatggttaattgaccttcttgatttgtagcaaaattcatatcaggcatcctccttgagcgttcactgggccggtttctggcccagtgaacgcgttacggcagggcaatggcaaacgaaaagggatccttttgtttggccacgcgtcaaacaaaaagatcccaacttgcaatctacttgaatgatagcgccccgcttaggtttctaagcgacagtacaggatttattcaaccctggcccaacaggcttgccgatcccggcgcccccatttcggcaaccgcccctttcaccaaacgtcaccgcgaaggatctcgctcgattcggatactcatgttggttgcaacctctatctgtttatcaccagactataataaaaaaacgaaagcgtcaagagcgtgaactgggccggttagaaaccggagtgtaagtggcctcaggcgtgatggcccgaacttggccattgcgcctgaggtccttacacgcaggtttctggcccagtgaacgcgttaacgagagcagcagagaaaaccagtgagcgttagccattgcgctcaaactctttacatacaggcacgttcctgcaccaactaacttttcgtcacctgatacccaaaactcactcgccacctgtttgagcaaaaaaattagaaacaaatttcaacactttgtttctatgcaatgccggtagaacatgccgattttccgccgccgctgggggttgtgtttctgcgagagtctgctaaagtacaaaataaaatgacagagttctcatttgcagaaacgagttggcgaaacgcgatgtctgtgagcgaatagctgcgagttgcttgcgatagagaacccattagggaggcagtttatcgtgcgggtcgtaaagtttggcgggtcatcattagcaaatgggtcgcagtttgccaaagttgtggcaatcatgaaagcaaatcctgcgcggcaggtgatggtgactagcgcgcctggtaaacggcatcccggtgacgttaaagtgacagacttgttgattcagtatgcccaagcggtcttgcgccatgaaaatgcaactgcagtcgttaccgaaattgttgcgcgttatcacgcaatcgccgatgatttcggacttgatccccaagtcatgcagcaaatcagaaaagaactataccaattaccgaaaaaggcatttgccaatcgcgattatcttctggccggattcaaggctcgcggcgaaaagttgaatgcgtttctgatgaccgccgttttgaatcatgaaggtattgaagctacttatggcgagccgaaagacttgggcatcgtggtgaccgatgatccgaatgatgcggaagtttcacgtgaaacttacacgcatttggaaacttttagtcgaccgctgggtgtgctggtggtgcctgggttctatgggtataccagtaaaggtgccgttgccactttttcgcgcggcggttccgatatcaccggagccattctcgccaacggttttcacgccgacttatatgaaaactttaccgatgtggatggggttgccgcagctgatccgcgtgtggtggcaaatccccagatgattcaggaaatgacttatcgggaaatgcgggagctttcatatggtgggtttggcgtttttcatgatgaagcaattttgccagccattgcgggacagattcccattaatttgaagaacactaatcatcccgatgctcctgggaccatgattgttcccgaacagcattttgttccgaagcacgccattaccggcatcgtgagttcgcaacacttcggcgccatttacctgcatcgttatctattgaataaggaagtcggttttacactgaagttgctgcaggttttggagcgacacggcatcagctacgagcatatgccaagcgggattgacgatctgacgattattctggatgatcgacagctgaacgaggccaagcggaaggctgtgtgcgatgagatccaagcggcggtccatcccgatgttttgaagtggatcgatgattacgcgattatcatggttgtcggcgaaggaatggcgcagcggactggcttgattcagacgattttgcagccgttagcgagtgccggtgttcacgtgtcgatgatcaacgaaggcgcctcgcagatttcactgatgctaggcacctcgcgggagtcagccaatcgcgcggtcaaggcaatttacaacgcctttttcattccgattaatcagcgtctggaggtacactaacatggtgacattgcaaaaagttcacggttccgaaaatagtttctttttattggatgaaacgcaactgacccagccgttgacgaagacgcagctggcgacattgacgcaacggctaaccgacagtcagaccggtttgctaggcggtgcggacggcgttttggcgattacggatgcacccggaacagcgggggaaatgaccgtcgttaatacagacggcagctttgccaagctttgtggcaacgggttgcggacagtggcgcgatatttaagtgaaaaaaccggccaaacatcgttccgggtccacactgactttgcggatttggcggtcgccaagcagaagccattagcaaccggcgtaccggcgtattcggttgaaatttccccggttagttttgtgccacaggctttgccgtttgctaatttaggcacggatcgcattgttgacaccgttttgccggccattcatccgcatctgaagttcaccgcggttgccgtgcccaatccgcacttgattgcgtttgtgtccaaagacgagttggctggtccggatcttgaacggattggcaagcaattgaacggggaaaatccttattttccggaaggggttaacgtcacatttgccgaaatcttagggcaggatacgctgtttgcccggacctatgagcgcggcgtcgggtttaccaatgcttgcggtaccggcatgtcagcaacgaccctggcgtttatcttgacccatcccaaccaagcagcgttggatcgcgtcaataccgtgtatagtccaggaggaatggtcaaaacggtggttcaccgcgaccacgaccattattggattgaattaatcggcaatgcgacagtcaccgccacgattacgttgccagaaacagcattgatcgacggcgatttgcagcaggcggttattgcgccgacgagcgagcaggcggcttatgaacgattcgttgccgcattaccgcatcgcgcattggcagacacattgacagaaggagtttaaatcatgagtggttatcacgtagcagttgtgggtgcaaccggagctgttggaacccggatgttgaaaatggtcgcagaaagcaaactaccaattgcatccgttttggcacttgccagtaagcattcagaaggcaaaaaggtaccgtttcgcgatgggacattaaccgttcacgaaacaaccgatgattcatttaaaggcattgacattgcgctgttttccgctggtgggtcggtttccaaacggttcgccccggcagccgttaaagccggcgccgtggtagtcgacaataccagtgcttttcggatggaaccggacattccattggttgtgccagaagtaaatcccgaggcactgcgccatcatcaaggtatcatcgccaaccctaattgttcaacaattcagatggtcacagcgctggagccaattcgtaaagcatttggtttgaaacaggttgtcgtttcgacctatcaggcagtttccggtgccggacagtcggccatgaatgaattgttcgatgaaacccgggcagcactggatgaccagccgctggaaccgaagattttaccgactgctggcgataagaagcactatccgatcgccttcaacgccttgccgcagattgatgttttcgaaccagacggctacagccatgaagaatggaaaatgattcacgaaaccaagaaaatcatggccggcgatatgaacagcgatgcgattaaagtcactgccacctgcgtccgcattccggttcccatcgcccactcagaagaagtttacttcgaagtggaagatagcaatgctaccgctgacgccattcgcgcgaagttagcagcggcgcccggcgttgtcgttcaagatgatccgagccagcaactttacccgcaagccagaaacgccgttggcagtaaagaggtctttgtcgggcgtattcgcgccgatgcagaaaatccacgcttcttccacatgtgggatgtttccgataatcttctcaagggtgccgcatggaattccatgcaaattgcggagacgatggatgcgatgggcttgattcagccgaagtaaaaaatatgttaggaccgataccatgtatggtcgctgtttggcggcggggtggtgtcggtttttttaacgtataaaggattataaacttttgaagaaccatggacgaagaattcggccagtggtaaaaaaagaggttgccaaatttgaatcttgcggagatattcaaaaaggttatcgtttatttgtttgtgaaggctgtcgtgacactaaatgggtcgcttttgcaaagtaaaagcgacccaaaagcgctctgtgcttctgaacttaaaatgataatcaaattagcataaggcagcaattaaacgttattttttaaaatttggattgcattttgtttaggcttgccttaactttgacttatcaaaagtaaaggaagtgattttatggtcaatgttaaacttcgtggtattgcagaaggtcgccttgggaagggatccatcttgtcctctggctctactgtgagcgagatcgttaaagatgttgcattcaaagatgacgacctgaaacataacttgtttgatgagagaaccaataagccacggcttctttgccgcgtcttgattaacggaaaattggcaaccgttgatcaaccagtcaatcctaatgacgaggttatgcttgcctctgttatgacctgcgatggctaaacggaaataagaatggccacctacaatcaggtggccatttttattttataaatatcacatattttaaactttaggagaataatatggaatttaacaattcacggtacaatagacaattactcatgcctcaggttggggagcatggccaacaattaataaacaactttagcgttgttagcgttggcgctggtggtgtgaagtcgccgcttctgtattatctagcagctgctggcatcggcaaaattaaaattattgattttgatagggtagagttaagcaacctgaatagacagattctatatacaactgaggacattggtgaatataaagccgtagccgctgccaagaagttaagattgctcaactcggacattgaaatagaatactcagtcgaaaaggtaactcccgacaacatagatgatctgttgggtggatttgatgtgatcctagaaggcggagatggtcctgagcaacgattgatggtgaatcagtatgctgttgattataaagttccaatggttcatgtctccgctcaatatggatatggttatgcgtttacaagactaactgacgatgatccatgcttacaatgtgcattcccagatttgcccgaaagcagaaaaggtcctgtagctgtttggggcattggaacagggattgccgggattatgggtgctaatgaagtcttaaagattgctttgaaggaaggagagctagcgcgaggctatttaatgtcctgctcaaactttcaaaatgattattataaacttcctataccaaaaaatccgaggtgtccagcctgtggtaagaaaacaaaagcctagaaacaatatacagtttgctgctttgctttcttcaggaattgattcctttgggactggatcattcgttagtgtctcaacggtttttttctctacgtacagtcacgtatctccgagtattattgggatagggctaaccttatctgcgataacagggatgatatcatcgctgccagtgggttatttagcagataaatatggaaggcttaaattgttttcaatttcatattttttaagaggcgtgggtgcactatgctggctgtttataagtggcaatcttcaattcttaatatatatgtccttatttggaattatagatagatctgctgcttctttaactagaagtctaataatttcgcctttatccaaaagagacgcgacagttttaatgggtaaaatgatgttgccaacaaacattggatatggtctaggagctggatttagttttttattgctcgctataaattggggattaatgccaactgtgattacaaattccctgtcttttttgctggtgatttttttatacagaacggcattgaaaggtgtagctgtaacgtctggtaaggttttaaaaaagccaatatctataaaggtgataaagtctgcattggcaaataagtttagaagattgcttatcatggagaatttcctgttttcttttcataggactttattgagtgtgtatgttccattaatagttgtcatgtactttaaaaactatagttggctatcaccgatggcctttattattaatacagtggttatttccttatttcaagggaaggtaaacacctgggccgctgaaaatagaagatatgataggctatgggttatatcaggcgcaataatagcagcttcattccttgtcacgtccgtaacaaccgtaatgcatattgatactctcatctttatggctttgttaatgttaatagtcagtcaagtcttagccgagttatttagcagtgctgccttagcgatgtacatggtgatttatagtcgttctgaatccttaaccactgacttgagtgctataaatttggggggacagttgcagaacattttaggcccaacaatgtttggtagcgcagcagtgtcatctaacggcctcatatcctttcttatgtttactctaaccgcagcggtatcagcacatgcgtatatgtatcgagggttaaataaagaggagctaaaagatgaactttgatggtgaagataagagatgggacgaatactacaaaagagaatggaatgataaacgtaagccattgcctatagagaagatcataaagaaggctgttcctaaacaaaatgcagggctttatgttggacttggtacgggcagaaatgtttttcctttattgaaagaaggctggaatgtgtatgcctgtgatattgctcacaccagtataaagaatgccaaagaaaattatccacaatatgctactcattttgactatggaagctacactgaagcctttccccatataaaagcatttgattatacgatttgtagtgaggtcctggtcaatgggaactttccaaatgtcgtagaaagatttcgacttttaaaagacaggctcaccaaagagggtttcttgatttttgagcttcctgcgataggcacggatatatggcctaattggaaaagtttgtctatgtcaaaaaatggcagcttaaaattaaaatatagggcagacgtacctaataagctatatttgtcctttcaagacatatgccatttattggagaatgccggttttaaaatagtatacgggcctaaacccgttaactctgagaggtcgaggtaccctggcggacttataagagactggttaggcatagctcaaaatgtttctttaacatagcagttgctcaacaacatgccagtttgttgaaatgatcttcattaatttcaactatcaatttattcgcacttttttgctagccaatattttcatcgatgcctgtctcattggtggtgtgatgattttacgcgggaagtggcaattcgcattcgcattgacgccttatcttttcatcgaggcaggaattattctactcgtggcatggcgggcacagcgcagagttttggcaacgctgaatcgcggactttaagagctagcgcgcatttagtaactgacaagagaggaaaaaggtacatgattgaagtgaaaggacttacgaaaaagtttgcccagcgaatgatctttgaaaatgtcaattgtcagctggtacaaggtaaaagctatgccattattggtaaaagtggtacagggaagacgacttttctcaacattctcggtggtttggaaaccaccacggcaggcactgtcatggtggatgatcagccggtttcaaccaaaaatctacctcagctgcggcgggataaattcggcttcatttttcagaattttggattagtcgataaggaaaccgttgcttataatctgaaaatcggcttagccaatcagcgtctaccacgtcaagaacaaaccattgctatgaaagaagttttgcagcagttggggttggcaaacgttggcctgaagcaacgcatttttacacttagcggtggcgagcagcagcgactggctttggcgcgcttattgctgaagaaaccgacaattattttcgccgacgaacccaccggctcactagatgcagccaatgccgatgaagtgacacagcatctacttcatgacttcggcgatcaagcaacgatcatcgtcgccacgcatacagctgaggtctggcgccattgtgattacttgattcgggtcgaaaattgtcgcatcaccattaccgaaaatatcgctaagggggagaagcttgcatgaaaaaggccaaaattttggatagtacattggcagcactggtcatggttgcggttgccggcatattgctgattcacaatcaatggacagatcttatcaatccattcgtacctgaacaaacaagctacgcaaaagtcccacaaggaaaacagcgttatcgcaatgttgagttgtataccgcaacgcagacaaagccgacgctggtactgaaagaaatgaccggctatgatccggatgggaagtatgtagcggtgaggcacaagggacagtacgtaaaacgtgtgacttatgtgtcaaaagaagcgtttattaagaagctacggcagtcctctaagtcgggtaccaagtgataatggcctatttttcttttgactgttgccatatcttaaaccatatatatatttgcgcggataataacgtcaagacggcaataccgctcactgtataatttatccgggcgaacaccttaaaaagggggtggtttcgaagtatcaccaggtaagaggcggataatgtatacccaaaataagcacatccaattgccatgcccgggagtataacgagcgagctaaaagcgaaacgatactcattgtagacgactgaaaaaagtgaactacctatggatacaaagagcagaaaccaccaatgtttacagaggtcatgaatcgtacttgctagataaagggggggtgagacttaaagtgccgatagagaaggaaaaagaagactgcagtgattattacttctaaagtaaatacactgatagccaatttaacctttttttcattcacactttctgatatcatttagcactctccaactttttaaggattagagggcgcgacctccaacaagggcagtcgacaacgcctcataattttatttgtattttcaataattatccagaatatacgataatgcaagcaaaactttcgataaatgctgatcaaaggccttttggaagtattagatctcaaacaaaaaattgacatcaattcagtcgccatggaataatatggctactattggcagacgtgcagcttttcaagaaagaaggtagcagccatggcagtgattgggacgattctgatagtgctgttggcagttctggcgttggttattgttttagcgttgatcgttgctgggatacaaacgttactgtctttgtggccgtccactaagatgaagcgactgccgtatcacgtgcgtgctggtacaatgttggcttcgcttttcaacgttctttataaggtagtcacacttggatccgttatttgatcaaagcaagggggggggctgaggatgacaccgaggacgttaaagattgaagatctgatagctaaatattcggttcaccctgaggcaaaagcgcagtttgatcagggtaaggctcgtttaatgactgcttatcaatttatgaaagcacgtgaagccgccggattgtcgcaaagagatcttgcagtggcggccggtgtaccgcaaagaacgattgcccgagttgaactgggcgatagtacaagtcttgacactttgcacaaaattgcaatggcacttggcaaaacacttgatgtgactttggtagatgattaggctacaaattggtccatgcagcgcgcatgggcttttttgccgcatttttacgatttatttttggcctttatctaatagtgatgcgtcaaactcacggaaagtgattgtcagagaaacatcaagataaatgcccaaatggtgatcggagccggacagctcgccgatcaaattgtattgtgcgggaaacgaaacttcttagcagtaaaaaatatgattgacactcccacaatgcccgttatacaatcaacctccgcgcttttaaccaaataaatgaagaggtgattcgatatggtcgaggttcattttgaaacggttccgcaaaggccggattcggtgctggttgttcaattttttaatggcggcattatctgggtacataattctaaacgccagtgggagctgacgggtggcaagttggaagccggtgaaacccttgcccaagcggcggtgcgtgagtcgtttgaagaatccggcgctgtgattaagccgagctcaatcgtgccgttgggttattatgtgttaccaaccggacacgtcacagctgtcgtccgcgccgaggttgatcgactggaggcgattccggcgtcttctgaaaccgacgatcgaaagttgtcacttgaaccgttgcctgatgctgacagatcgtttcatgacgatgtttactgccagattttccgccatatcgggtggccagatgagtagccgccgttacggcttactgctgaacggctcgtcggtggcggtgatggcgctgacgccggtgatgaacaaatggtcgatgatcacgctatcgccactggctgcgagcttttataatgcacttatttcactggtgttgacgctgatcacgattgcgatgaccaaaacaaaaatggtgtggattaagcagccagttgtctggattttaggactgacgaattgccttggcattttcctgcaatacctgagtctctttttccttgatccggtgagcgtcgggttgatcggacggttttacattgtcttcgccattttgctgtcggtgcttatgctgcatgaaaaattcgaccgccgcgaactggtgccgattctgctttgcattgccggtaccgcactggtatctgacttctcaggaaatgtgaacaacatcattgggcttgtctgtgcgtttgggtacaccttcagcttcgctttgacgaatacgttagccaaaaaagcactgactcaggttgatgagaaaatattactcttatacgaccaaggcactgccgttgttattctcggattgatactggctggaagcggcaagctctctttttcacccaacatgggcatgggtgccgttgccatctcagcgttttgttcaggctttctcggattattactgttttatcgcggtctaaagtttatctcgtttcgcgatgctaatttgatccgagcgcttaacccaatttttgtcttgatctactcgttgccatttttcacgattcaaatcactccggcgtttctgctcggcggcgtcctaattgtgctttcgattgtttggatgtcgctgccggttaagaagtcgcaaattgactaaaatagtcattcatagtaagcaatctgttcaggcctaaatgcaagatcattaaacggccaaaacatttgtacgcatcttgtgggttgattattttatcgggatcgcagtgaggttcatcgaattaaatttagcaaatggaaatctttgcgattatataaatgacctgcaattcccggaaagttcggcaatttcaggtcattttatgtaggctggaatccgtatatcggattccagtaaagttatcaagcgatcttaacatagacctttttacccatagcatgagcaatttctgctaatttattaaatgagacgttatcgccccgttcaattcgagcaatcgttgtctgtggtacaccggcacgttaggtcagcttgtgtgaggcctgccgcttcccgtgcgtgataaagtgccaaggctgccgccgagcgttccttgtctagcgtataagcactggcaaattcagggttctgcatttctttttttaataagtcatcaattttcatgggttgaatgccgttcctttctgaaatctatggattctttatatcatactcgtgcatatgatatgtatgtataccgatagactttgacatctcttaactattcaaataggtctgttttgaagattggtgatttgcatatattcaagttacttttttgtggaggtgtcacgcattcaaagccagtagtggattcagacagagaaaaggctaacaataagaaattagaaaataattacaaaattaaataataattgcattctcattgacaaaaactcttgcgagcgtaaaaccataactaaccttagttcatctgtgccaactcacgctcaggaggtgtctcaatgaacgctgtcgtatggcaaacactaaagaagcatcgcgcagcctttatcatcttggtgatctttacgatgctgagtacgagcctgatcaccggtaatacatatctcgaaggcaagttgctggatagtttggtgtatagtcgcgacccgcgcttgtttgtgctgttttttggcttaatgctgggctttggcatactgaggctcggtatttccttttttacaagtcatattcagattctgaccaaacaaaaaacggtacttgagttaaatcgaaaaatcattttccgactgttcacaaaaaatacgctcggcatcttaaagtggagcccgacaaccttaagcgcgcgaattaatgatgatgtaactgaaattgtttcatttttctctgacacagttgtcaggttgtgcagtgtcattgtgtcgacgctcaccattactgcttatgttcttagtgcgaatgctgaaattttcaccattatggttgtctttttaccggtttattttcttatttatgttgtctttcatcgaaaaatttaccgggtgagtctagaaataaaaggcaaacagaatgactattattcggccagaaacgattttattggcagatatgtcgagattaagggcgcggaaaatctgcctagtgagatagcgcggcttgatcaggtgggtcacaatctattcaagacgttcaccaaaagtttttggattcattactggatgtcaacctggcaaatcgtcatgcagttggcgtttcaaacccttttctttgtgatcggcggcttggcagtcttaagaggcagtatcaccatcggcttttttgcgattattctccagtacttcgggcagttactcaattcagtcgatcagatttttggcattgccattggcgctgaagcatatcgggcctcacttgcgcggatggagcaaattctggacatggcggacgatcaaaccgggatgcaggatgttgcgcggattcacaggattgatgttgatgcttttaacatcaaacgatttgagaaaaaatctgatgtacaggaacttttctattcgcgtgatctatcttgctcgtttaagacaccggggttatacgttatttctggggacaatggcgttggcaagagtacgtttgtccgaacgatgacagggatttaccagccagagttgaagggcaacatttcaattaacggcatcaagatgaagcaaatcgatatgcggacattgcggaaaaaggagatcggtttttcgtttcaagatgtcccatctccgcatgtgacggtccgcgaatatttagccggaatgacgcaaaacgacccgttatcaatggtcaaaaggtcaccgctttttgcaaaagtttatgattcggacgtgtttaatctccggaatatttatgatgagaaggtcgatgtgctgtcgagcggcgagttgcagttagtgcgtcttttagcggcatttggcaaagaaaatgcatccatgtacatcttggatgaaccgactgccaatatctatccggagattcgagcggcggttattgggttactcaaagaactcgcaaaaagtaaattagtcattgcgattactcatgatgatcatctgcttcatatcggtacgccggttgtgatgcagtgagggttatgtgagctgcatttgcggctaaactttcagctgatgaattccgacgaagcccggcatcggcattaaggcggtatcttttagcgagggtgtcgttttttgagtacaaaaaatccgcgcagcttacggcctacgcggattggtgatgattcatgagcaatttcgacaagattattctaacatgggttcatctaaaaagcatatttgtatagaaactcgtgacaaacctcggctgaccgacgcactcgaaaacgcgttcgcagtcgcagaaatctacgtgtaaggacctcaaacctaaatggccaaaacccagccatttaggcttgaggccacttacactccgatttctaagcgctcctgctcacgctttgaaacgcgctcactggcgcagaagtctgcgtgtaaggaccttggtcgcaatggcctaagcccgggccatcgcgcccaaggccacttacactccgacttctaaccgcgccagttcacgctctgaccctctttccagaatccgcttgcacagtatggtagaatagctaaagaaatccttaagtatctgcgccaagtgaaagcgagtttttctatatgaagaaattgtttgaacggattcgtatgccggagtttttggaagacatgcggatgcggtatgcagcaattgcgatggtggttcttgcggtcatcggcattttgatcggagccttgatccgcccgtggctggctttgttgatgctgctgattttaatcagtcttgtggcgacgattttttatgcccttgagaccattgccaagaatacgaatcagtatatttcggatcttagttatcggattaagcgcggggaacaagaagcgctgattaaaatgccgatcgggatcatgatttatgatgaggatctgaatattgagtggacgaatccgtttctccagaagtattttggtgatacggatgtgctggggcagccgctagaaaaagtggatgccgagctggctgagctgattcgcagtcatgaggacactaatgaaaccaaaatggtgacctggggccagcatcagtttgagattatcgtgcaaaagagcattggcgttgtctatttgatggatgtcacgcgttatgctgaaattgaagagcgcgcggaagatgaaaagattgctatcgggcagattttcattgataactatgacgaaattacccagacgatggatgaccaggttgtcaccaatttgaatagttatgtcaccaaccagttgacagattgggccaaccaatttggtatgtttttgaagcggatcgacaatgatcgctttttcttactggcatatgccaagtcattgcgtgatgttgagcgggataagttcaagattttggatgcaattcgggaagaaacctctaaacagaattatccattgacgctgtctgtcgggattgcttatggtgacgaagatttagctcaactcgcggttacgtcgcaaagcaacctggacctggcgctgggtcgtggcggcgatcaggttgtggttcgggctaaaggtcatgaagcccgattctatggcggtaaaaccaatcccatggagaagcggactcgggtacgagcacgcatggtcgcgcaagccttgcaggaattgtttaagcaaaccgataaagtctttgtcgttggccataaacggccggatatggatgccgtcggggcagcgatggggattcggcgcattgctcagatgaatggcaaggaatgttacattgtcatcgaccccgaccacttgcattctgacgtggaacggctgatggggcaggttggtcaggatccggaagtggctaatgccattgtgaccccggaagcggcgttgtcacaagcaacggatcaaagtctgttgattttggttgaccacagcaagccatcgatttcagccgcgcctgagttgtacaagcggttggcggcacgaaccgtgattatcgatcaccatcggcgcggggaagagttcccggacaatccgatgctggtttacatcgaaccatatgccagctcgacgtgtgagctgattgccgaaatgtttgagtatcagccgacgaatgttccgagtctggataagcttgaagcaacggcgatgttagcagggattaccgtggatacgaagtccttcagtttgcggaccggcacgcggacgtttgacgcagccagttatctgcgttccatgggtgctgacgggatgttggcgcagaacctgttgaaagaaaatatcgacagcttcatccaacgcaaccatttaattgacacaattgaaatgattgccccaaatatggcactatgtactggggaagaagataagcgctatgatccggtgattgctgcccaagcggctgacaccatgctgtcgttgaatggtgttgatgccagttttgtcattaccaaacggcccagcggtgatatcggcatttccgcccgttcgactggggatgtgaatgtgcaggtcatcatggaagccatgggcggcggcggccatttaagcaatgcggctacccagatcaagggcaaaacaatcgccgaagttcgcaccgacttacttgctcagatcaaaaaagcagacgaagacgcgtgacgcaattgtcataacgcgttcaccagcccagaaacctgcgtgtaaggacctcaggcgcaatggccaaggtcgggccattacgcctgaggccacttacactccggtttctaaccgggctggctcacgctcaaccataacgcgttcgccggcgcaggggtctgcgtgtaaggaccttggtcgcaatggccaagatcgggccatcacgcccaaggccgcttacactccgacccctaagcgcgccggctcacgctcaaccatagaaagcagggattttaaatgaaagtcatctttacacaagacgttcgtggtaagggtaatcgcggtcaggtgaaggaagtacctgacggctatgccgagaactttttgattcgcaagggtttggctaaggcagccactccgcaagccatgagtgctttgcgtggacaacaacggcttgaagagaaaaaagaggccgaaaaaaaggctgaggctgaagcgcttaaagccaagattgaagacgacaagacagttgtgcagattcaagccaaggccggtgaagattcccggttgtttggttcgattcctagcaagcagatcgccacggcgttggagcggcaatatcagattaaagttgataagcgtaaaatcgatttgaagcagccgattcgttcgttaggctttactaacgttccggttaacctgttccctggtatcgatgcgcggattcgggttcacgtgcttgaacagaagtagaacagggcctgtagatcaggttctaattaaataagtgacaatcaatatgaaaatcgtgcgttgaaagtttagagagcctgtctcccgacttttagcgcgcgtttttgaatgcttcagaggttatgcgtgacaatgacggcgaaaagcgcataaggtcgggctttttcagcttaaaatcagcaatgttacgttaagcgggaacgcttgttttggtcagcggtttaacgtagactgttaaggataagtgctatcactttgcaatactttaatagcgaggtgttgcaaagtgaaatggctgaatggaaggggacgcgcatggataatcagttaattgaacagcaaccgccgcatagtgatgaagcggaacgtgccgtccttggcgggatttttctgaatgccgacacattgcctgatgcccaggaatacgtgacggcagatgacttctataaaaaggcgcatcggcttttgttccaggcgatgacggacttacaggacaacgggactgccattgatacggtcacggtaacggactatcttgacaatcacaaccagttggacgacatcggtggtgccggttatattaccgatttggtggcatcgacgccgatcgccagtaacgtggtttattacgccaaaattgtgcagcaaaagagcaccttacgtaagctgattaacacagcgcaaaatattgccagccgcagttatactgagcaagacgatgttgaaggtctggttgaagatgccgaacgccagatcatggatgtttccgagaatcgcaaccaagccggatttaagcaaattaaagatgttttgaatcaagcgatggcgcaaatcgatcagctgtatcaaaatgatcagacgattaccggtttgccgaccggattccgcgacctcgataagatcacgaccgggttgcatgaagatgaaatgattattttagctgcgcgcccggctgtcgggaagacggcgtttgcgctgaatattgcgcaaaatgttggcaccaaaaccgataaaagtgtcgcgattttcagtttggaaatgggcgcggagcagctggttaaccggatgttgtgttcggaaggcagtattgatgccaatcatctgcgcaccggccaattgaatgaagaagaatggcagaatctgattattgccatgggcagtttgagtaaagcaaaaatttatatggatgatacacccggtatccggatggccgagattcgggctaagtgccggcgactggcgcgtgaacaaggcgacctggggcttatcatcattgattatctccagctaattgaaggctctggtcaggaaaatcggcaacaggaagtcagcgccgtgtcgcggcaactcaagaagctggcaaaagaattacacgtgccagtcatcgctttgtcacagttgagtcgtggcgtggaacagcggcaagacaagcgcccggttttgagtgatattcgtgaatccggctcaattgaacaggatgccgatattgttgctttcttatatcgagacgattattatcgcgatgcagaaggcgatgacgatgatgaccgaggcggcagtgacgacggggatgataatgtcggcgaagtcgaagtcatcattgagaagaaccgttccggcccccgcggcaccgtgaagttgttattcgtcaaatcgtacaataaattcacaaatattgcctataatggaccggatcagtaagctttttgaaaaatgacgtaccaaaatgagtgacgcaaaataatgtgttcgtcagtctagaaaccgggctggctcatgctcaactataacgcgttcgccggcgcaggagtctgcgtgtaaggaccttggtcgcaatggcctaagaccgggccatcacgcccaaggccgcttacactccgactcctaagcgcgccggttcacgctcaactataacgcgttcgccagcccagaaacctgcgtgtaaggacctcaggcgcaatggccaaggtcgggccatcacacctgaggccacttacacttcggtttctaaccgggctggctcacgctcaaaataagaaagtgagggatgccgcatggatgccattttaatgagtttgatgacagcgctcaatgaacacctgctgatcaatgtttaccagcgagataccgatgatttttacactgggtatgtgcaggttttgggtcatgatgcggttgttctgggaacctataatgattcggggattgctgatggctgcgctttgattgccttttcagcgattgaccaagtggaatttgccggcgacgatctggataacatgaattttcggatcgggttggcgcagtcggagcattttttgacgcttcaaggtaaggaaaagccgtttcaatttgatgcaactgagagcctgatttggcaattagccaagcaggcgcaggctagcgagcaaatggtcatggtcgtggtggcggatgacgatgcctatcttgaaggccgggtcacggcggtcgccgaggatcgcttcagtatggccatattcaataagttcaattacacggatgttcgggcgttgcaggttgatttctcggatattctggtgatggaatttcatggcttggatctcaagctggaaaccgagctggtgcgacaccgcgatcaactacagcatgtgccaacgaagctgtttcaaaatgacgggcagcttgaaggcgtctttcagaatgcactggcagagaatcggttgatttcagttgtgccaaaagggccggaagaccagttctttgttggccgagttaaagcagtcaatgaccgggtcgtggtgctgagtctgaaggacatggccgggcaatttggcggctatattctcatgaccctgccaagtattcaaaatgtggcggctgcttcggattacctgcagacgatcagcttttatgagcagtgggatcaaacgcatcatttcagtcagcaaccggtcctaaatgccgaccgggagtttgatccgaacgataatctggttaaggcgattatttccgaagcagctggttttgaacgggttgtccggatcaaggttgcggatagcgacgagcatttccttggctatccggaacatgttgatgaaactgattttgatttgaaactggtgggtcaagacagcggagaaacggtgcgcattcgctacggccagattcgtgagattgcatttggccacattttcgcgtacttgcaggaagctcagttgaaaaacgcggatcgctaatggttgatttttgaaaagttaccgcttgtggttggtaaaatctaaaaaagcatgattctcacgatgatgaaagtgaaaatcatgctttttattttggcgctgggggagccgagattacttgctggtaactgtaaagacctcatcccccgccgcaacatcctgatccgtgaaggctgtcagggaggcgacgtgatccatgttggtgatgatggtcatcacggtggttcctttgccggctgctttgactgccgctaagtccatggtggcaattggctgaccggccttgacggtatcctggtcgttgacctcaactgagaacggtgcgccgttaagctcgacggtgtctaagcccatgtgtaccagaatttccagaccggtagatgtggtcatcgtccaggcatgtttggttggcatgacactgacaatcgtgccatccaccggggcaacaattgtcccactggtaggttcgactgcaaaaccgtcgcccaccattttttgggagaaaacgtcatctgcaacttcggatagatccttcagctgccctgtagctggggcgacaaagttgatcgcgccggtttgaacggttgttgactcggcttcctggtcagcggttggttgttctgggctaggatcctcttcttgcgaatcagcttcatcaatgaccgtgccatcagccgccgttgcaaccatggcactttttggaaccccaaagaagtaggtggccacaaatccgccggcgtaagaggcgagtaaaccaaagacgtacgccatccattggtggttggcaatcagcgggatgagcgccgcaccggaaggaccgatggtgatggcgccgacgtggccaaaagcaccgacaacttcgccgccaatgccaccaccgatacaagcggtgatgaacggccggccaagtggcaagctcacgccgtaaatcaacggttcgccgacaccgagaatgccgaccgggagcgcgcctttgatgaggcgggttagttgcttgttcttgcggcacttgatccacaaggccaaagcggcaccgacctggccaccgccagccatcgcaaggatcggcagcaacgccgtgaagccggtatttttgatcatttccagatgaatcggtgtgagaatctgatgcaatcccaacatgaccattggcaggaatgccagtcccaaaacaaagccagagaaggcaccgccgacttggagaatccagttgatggagccgacgagtgaattagacacccatccggcaagtggcatgatgaagaagatcgttagtacaccgatggatagtaagctcaacatcggtgtgaaaatgatatcgatagagtcgggaatcacgcggtgcagttggttttcaacgagcgcaagcagccaaacagcgaagatgacgccgatgatcccgccttgcccagccaataacggttgatgggtgaaaatattgttaatcgtcactggctccaccacgcctggcaggtaaatcagtccgccgataatcccaccaagaccgggagttgcgcgaaattcggttgccgcattgatgccgacatagatgttcaggaaggtgaacagaccgccgttgataacttttagaacggtaatgaattgggtccagtcttttggcagctggccggcagctagcatgtttgctaaaatgccggcaatcccggaaatcaacccggcgccgacaaacgccggaattaatggaatgaaaatggccgaaatgtgtttcaaagcggtgcgccaccaggtttgtttcaatgatgctttgtgggcagcgtggacctcggctgccttggcctcgacagcggatttgttgtctagatggtcatttccggtaacagcgctgtccgggaacggatcacctaagccgacaccgactttagcgaccatcgcctgggcgactttgttgaccgttccgggaccaacgatgacttgcagtgtttcttcttcaacgacgccgagaacgccgggcacctttttcaggccagccacgttgactttggtgttgtctttgatggtcatccgcacacgcgtcatacagtggatcagtttcgcgacgttttgtgggccgccgacttgtgcgtagatgccatcccccatgatttgatatttatcttgccccattttatacttcctcctcctgacttagtgcaacggctttgctgatgaagccgtttgcacgattgagtaatgtttgtgcgatggtgctgggttggtcggtcaaaatcatgacaattgctaatttaacgtgccgattggctgcctcaaaggcctttgctgaagttgccgcatcacagccggttgcttgttgaatgatgcgctggctgcggacaaccaacttttcgttcgttggttggacatcgaccatgagattcttgtaaactttgccaatcccgaccatggcaccggttgagagcatgtttaaaacgagtttttgcgccgtgccggccttgagtcgggtcgaaccggtgagtacttccggaccggcgggaacttcaatggcgatttcggcatgccggctgatttctgcgccggcattgcaagctagactaatcgttgcggcgccgacagattgggcgtagtcgagtccgccgatcacatacggcgtccgcccgcttgccgcgatgccgacaacgacatcgttggcggtcaacttgcggtcttccagatccgttttgccaagcgccggtgagtcttcggctccttcaacagcaacggtcatggctttcatcccgccggcaatcagcccttgcaccatttccggtgatacgccaaaggttggtacacattcggcagcatccaaaacgcctagtcggccactggtgcctgcgccgatgtaaaataagcggccattttgtttgaacgcggtggtgatcgtttgaattgccgcttcaatggctggcaacgcctgatgaacgcttggggcaacagtttggtcttcggcgttcatgacagttgcgaattcatggacgctcatggtgtccaggtgcatggtgcgttgattacgggtttcggtggtcatctggtctaaattgattgataaagtcatcatttttcctctttcatttttcgttttggccattactgcttgaagcggagcgcttggtgcggaccaatgtgatcaagcaaaggcagtgctgccggcgcgacatgaccaatcacattgactttcggatcggccggtaaatcgcagcgcgttatttggagttcgccagcgtatctgccatagcgggtgttatcaagggtaatgctgccgcgcgggcgttcaacggtgtgatgcggctccggggcggcgaaaatatgctcaaggcgggcttctgccagtcgcacgacttgctgggcgacatccgggcgattatgccaggtcaaatgatataagcgctcatcagcggcttcggtttgaatcaaaagtacctggtcgctcgtataggcctgaaaagcagcgatgctacgtgggctgagttgcgggtcgccgatgtaaacatggtcagttgccaattgcttgaggtccagataagcggctagtggtagtaacccgcgatgaggctcaagtgttggcaagccggcaaaaaggggacctcgttgctgtgcatcgcctggaataaaggccatcgttttaaaaccgagtgtgtgcagccagtgatttttttgctggaaccaacatggatctaagccggtttccggtcggggatagaaattgtgccacgcctcgatgtgcctgaggttggctttggcattggccaactgatcaatggtttcggacgaaagggtgctggcattgagcgcaacccccatcgtgtgcgacagtgctgcgaccgtggtcatgtcaatgccgtcgtcaatgcgcacgccgtctagttgtaaggcttcaatgccagaacagtcccgcggcgcaatccccagtcgcttcaaactagccagggaaatatcggccacaaccgccagacctaattggcggcagctcgtgattaagtggtttaaacgttgtcgtaaagtttttggatcatcttccggtaactgcaaagatgtgaataccccggtgaagcctgcttgctgcatctgtttgagataagctgtttgttgttcatcagccggttcactgagatagcatgaaaacccgatcatccttattcctccataagttgtgtcatcgcctgatactggtgatgaagtgacaaccaacaacgaaaggtgaaagccctttcgagattaaagataaccgatttatcttagaatttcaacatatttcgtaattttttgaaataaagtttcaaagatgactaaaaaataacgcatcgctggccgatgcgttcagggtgaaactcgcttgttgttatttgaagccatggcgcataaattctttgtaagttgttaccagcgcctttgaatcatcggtttgttttttggaagtgtcgtaatagcggctgacgtaggcgtaatataaaatatcaattaacataaactgtgcgtgtaacgactgcgttgccgcaaatcgattaggcgcctccattggctgagacgtttgaatcacgatatcggcataatgtgcgagtgagttgttgccgagtttggtcgtggcaatcaccggcagtccggcttttttagccaacttagcgcccaagactgcttccggtgactcaccggagtttgaaataaaccaggtaagggtacgcttaggatcggctgtggcagcgaccggtagaaacaggttcaagtcatcgctgaaatggcaggcgtaaccgaggcgtccccatttttgcgcaatattttgcgcggaaagatacgaggcgccaacgccgaatagcaacatctgccgactatggtgaatcagatcggtgatcgtttgcactgtagcttcgtcaacttgatcaaccgtttcgcttaaagagcgctcggcattggtgcgcaatttggttttaatggtagtcagactttcatccttttgaatttcctgataatccagctcattagcctcaccatttaaatcagcggccagctgcatttttaattcgttatagccggcaaactgcaatcgctgggcggcccgactgactgtggcaggactggcaccggcagctttggcaagttcataaacactcatcgtcaggacgtcttgcgcgtgggttaacacgtagtccacgattttcttttcggcttctgaaagttcaccgcgcgtactttggtaattaccttcaacactcataatcgagcttcctccttctgagcacggtgcaatgcagtctaaaaaggaaataccgatacatataatcgatagactacaaaggttgagagccatgctcatgttcgtgcgagacgaaaaaacgtacaggttcgtacggattttgctatcctcaagtcatcatgccatgaatgaccaagattgccaatgttttggtcagaaatacaggatggcagatttttgttgagtgtcaagcgtgggatagcttcactttcggattcagctaaataaaccccgcttttcgatataattgttcgtatttttaaagataagaaagaaaataaaagattaaagttcgtattttccttgtcttcccttaccaaccctgttagactacgaaatggcgggcgaatcccgcactaatccgtgaggagcgatcgataaatgggaactgtagttattgtcggcacacagtggggcgacgaaggtaaagggaagattaccgatttcctgagccaaggcgccaaggtggtaagccgttaccaaggtggcgacaacgctggccacacgattcatgctaacggccaggtttacaaactgcgcttgattccgtctggggttctttatccgcatcaactatctgtgatcggtaacggtgttgtcgtcaaccctaagagtctggtcggcgaactggcccgtcttgctgagcaaggggtgacaggtgaaaacttacggatctcggatcgcgcccatgttattttgccttaccatattaaacttgataagttacaagaggctgccaagggtgccgacaaaattggcaccaccaatcgcggcatcggaccggcctatatggacaaagcggcccgtgtcgggattcggatggcggatctgcttgataaagaaatttttgaagaacgattgaaggctaacctgaaggccaaaaatgaagaattcgtcaaagtctatgacagcacaccaatggcatttgatgatatttttgaggaatattacaactacggccagcaactcaagcaatatgtttgcgacacgtcaattgtcttgaacgatgcgattgataagggtgaacatgttctttttgaaggtgcacaaggcatcatgctggatattgaccaagggacgtatccgtttgtgacgtcatcgaaccctgctggcggtgtgaccgtgggtgccggtgtcggggcctccaagatcgatcgggtggtcggcgttgccaaggcgtatacatcacgggttggcgatgggccgttcccgactgaattactcgatgacactggcgactttattcgcaatgccggtcatgagttcggtacggttaccgggcggccgcggcggattggctggtttgacgctgttgtggtgcgccactcacgccgggttgcgggcattactgatttgtgcctgaattcgattgatgttctgacgggcttggataccgttaaaatctgtgtggcttatgaacgtgatggcgaacggatcgagaactatccggcatcgctgaagttcctgagtgaatgcaagccggtttatgaagagttgcctggctggaaggaagacattacccatgccaaaacgttagcggatttgccggaaaatgcgcggcattatgttgagcggattaccgaattgcttggcgttgatctgttgaccttctccgttggcccggatcgtgatcagacaaatgtgattgcgaatgtttgggataaggttgagtaggtgaatcacttcggaatgttggtaggctaagagctgcttgccgtgccaaactgcgcaatctccggcggtttggggctggcgacgcgaagctagagcggagggcacagctttgaactcgcaaaaaccgcgatttcaaagtctggccttgtcctaaccggggaaaaccgccccggcaaggacaatttcacagctgagccccctctggcctccgattgctccgccttggcactagggtttcaacgcgatgacaaattacctatacgaaaacgaagggcgaatgaatgccatctgtcgtgcagatgaaagttcattcgccttttttatatactcctgcgtaatctttcaaatcccctaaaaattccaattgacatcaatgccagaagccggtatattcaaagtaacatatgaacgaatgctcatatgaacataaaatataaaggtggttatgattcgatatgacgaaagcgattggcttgtatttatttggtgttattgcttttatcggcggtttatggataagtcagcctctgccgcgggcaacactgcttattttggcggctgtggttgcgggttatcacgtcattgcggaaggcgtggttcaaacgattcaggcttcaaaagcgcagcatcgcttttcgccgaatatccatattctcatggcattggctgcgatcggggcgattgcgattggcagttttgaggaagccgcgatgctgattttgatttttgccggtgcccattttcttgaggaatatgtggagaataaaagccgcaaagagattaccgcacttttggcaatggcaccacttgaggcccgacgctatggacatgatggcgagtttgaagttgtgccagttgctgaacttgaaattggcgatcgcctgcagattcttaacggggcccaggtgccgacagatggcgtgattgttgccggaacggcgagtctcgatgaatcggcgatcagcggcgaaagtattccgcgcgagaaacaggtcggcgatgaggtgtttggtgggacgattaacggccaatcaacctttgacatgcgcgtgacgaagaaaagcgacgaaacggtcttcgccaaaattatccagatggttcaggcggcgcaacagtcgccgaccaaaatggcgagtgtcattcagcggttcgagccgatttacgtcaaagcagtcttggtggcgctgccgattgttttcttagcagggccattcttgctgcattggtcgtggatgaccagtgtttatcgaaccatcgtcttcttggtggcggtgtcgccatgtgctttggcagctagtgccgtcccggcaacgctatcgggcatctcgaacttggctcgtcatggggtacttttcaaaggtggcagttatctggcgaatttaacccagcttaaagcaattgcgtttgataaaaccgggacgttaacagaaggccggccggtggtgaccaacagtgagtttgcgccgcatgtggatcaggcggcattgacggcgatcatcactgcgatggagaaacaaagtaaccacccgctggcgacggcgattgttgcgcattttccggcaagtgatttggtgcttgaatccgtgcgcaatgaagtcggcaaagggctgaccgccgagtatcaagggcacacttacacgatcggcaagccgcagcggttcgcgcgtgtcgatccgatctatcggcagcgcgccaaggtactgggccagcaagggaaaacagtggtcttggtggcgattgatcggcaagttgttggcttaatcgctttaatggatcaagctaaaagcagtgccaaagccgcgattgcttacttgaagcaccatgacattcagccggtgatgattaccggggatggcaagcaaaccggcgaagcagtggccaccgatttgggcatcgaacaagttgtgaccgatgtgatgccagagcaaaaagtctccatcgtcaaacagttgcaggaaaagatgcggccagttgcgatggtcggcgatggcgtgaatgatgccccggcgttggccaatgccgaagtgggcatcgccatgggctccggtacggacgtggctattgacgtggctgatgtggtgctggttaaaaacgatttgtcccgcttagcttttgcccaccgcttatccgctaaaatgaaccggattgtgattgaaaatctgctattctcaatggcagtcgtggtgatgttggtcattttgaacgtgttgcaactcactaacattgcctggggcgttgttttccatgaaggcagcaccttggttgtgattttaaatgggttgcgcttattgttgccgcagaaaccttaaggcaaaaaccgccttcgatacaaaagtctgctaaaatggccttaagtatcgtaaggagccatgcagatgacaaccaatgatgttcatacaactgccgccagcgacagtgacattcccgacgatgagggtttacgtgatatcctcgaagtctttaaaactatgagtgaccctacccggatgcggattattttggccattgccaagggacccatcacggtcaacgagcttgcggccatgttagatcttggccaatccaccgtgtcgcaccagttgcgaattttgaaacagacgcgcctcgttgtgggcgatcgctcgggcaagcagatttattaccacttggtcgatgatcatgttttggagatttatgagctgactaaggcgcatatagaagagaaacagcatgggcaaattagctgaccgttagagcctcagaacaactagtcaagtataaagttgaaacaaaccagtagcttcaaacaaatgccttcaaacgaaggtctttgtctggggcttttttgttacccaaaagtatcttgatggttgactttaacggccataagtttacagagcctcgatatacagcgatgatgtgcgcccttacagtgagaatagaagccagaaaagaggaggccaaatggtaatcaatgcgggggctgtgatcagcacttatcgggaacagacgggcattacccagcaggctttggcagattttattggtagtttgaaggcgttagtttcaacgtgggacccaggagttccccgagcaaaaggacattagaaacaactcatgaaatacctttttgcatataaaagaacatactatgatgctgcaagataccgcacaaagaccgactcgtatagatctacaaacgcaaaaaaaacaaaattaaaacttacgagaaataaaatgctgcgttataatatagctattaaaggtgtgggaggaatgagatgaaaaagactaaatcggcgtgtattcaacacagatcttgcatttccttttgaaagaggattatgaccatgaatatgccatcaaggcaattatatggagaagtaaagaaacataaggaatatctagaggaaatcatataaaccataaaatcctctcgtaaaaacgaggggatggcggcccagttattcctgatatgggaaatacaatacaccgatagtcggaaaacattcgaactgatcttttaattgataatagaagaaaacctttggtagaattaaggagtcaaacagcggacagcgtagaattttgatgtttctacgttgttttttatttgtcggattttttgccaaagcgtctcgaatatcggaaatcttgtattgtctgagccgtttttctattgcactttttgattttaggaggaagtataaagatggatttttacatgaaattaccacgtaacaaaaaagaatttgcactatttatggggattgtttctattgtctctgtaaatattatcgcgccgcttattaccttttttgagtcaggatttcacctttatgtgtggcgagacgtactgacgatacttccgtttatctggctgagtgtgattgttattgtgcttattacttatataccggcagaaaaaatgacagctctgattgcggcgaaagacgacagtttccgctctcatattgtcgtgaatattttatgtacagtattgatgatgtctgtttttctgactgtaatcggaacatggattgggacacgcgctatcaccttagaaccgatacagatgtttttctataagtggcccagaaactttgctatttcattattcgttgaaatgtgtatcgcacagccgattgccagatttgcacttttacaactgcatacaagacttgatgaaaaaagacagttgggataattaaaaaatgtatagactgtttgaattctgactttatttatgcgcaagctgagaaagaaaattgatccgaagcctttgagcttgtgatcctgaatccagccggtgtgggctaactttcagttgacggcgttgaacggtttgccaagcagcatcaaatcaggaccatcgcgggctttaaaacgagatgcgaccggtttgcaggacgatgaatgatcgtcttgcggaacggccgccttttttgatgacacgataaagccgcagttatgcgagtttgttatgttctgagacggatgagccgttattttaaaaatcgatcgctgacaatcaaatgatgcaaaaccactatatcatgtatagtattgtgccattacccaccaaatttagtggtttagtgctttcatttgaaggaaaatcctgtatactatatgtattgatgcaagtggaacaagtcagtgtactgggggattagccatgattgaattttatacacaaatcaagaaacgagacgggcgcatcgttgattttgatgcgagcaagattagcaccgcgattacaaaggcggcggagagcgtggcagagctgtcacccagtgatgtgctgacgattgatcacttgacggatacggtgacggctaaaattcgcgatcgctatcatgatgatgttgaaatcgccgaggttcagacggtggttgagcagacgctgattgcagccgagaagtatgactgggccgaggcgtatacgcaatatcggctgaagcgggatttggcgcgtaagcagaagcaagatgtcaattacaatgtggcgaagcttgtcaatcgtgacaagagcgtggtgaacgagaatgccaataaggatagccgcgtgttctcgacccagcgcgatctcactgccggtgctgtggctaaggcggtcgggctgaaaatgttgccgcccgctgtggccaatgcccatttgcgtggcgatattcattggcatgaccttgattacaccccgtttatggcagaaaccaactgctgcttaattgattttgactacatgttgaatcatggcttttgcattggtaacgccgaagtagagccggcccactcgattcaggtggcggtgacccagatgacccagattatcgcgaatgtggcttccagccaatatggcggttgctccagtgatcgcacggatcaggtgctggccccgtttgccgagaaaaattatcagaaacatctaaaggaattcggcgatgtgattgatgatccggcccaattgaaagcgttggctgtgaagcagaccaagaaggatatttatgatgccttgcaaacgttggaatatcaggtcaacaccctttattcgacgcaaggacagacgccttttgtcaccgttggctttggattgggcaccagctggatcgaacgggaaattcaaaaggatattctgaaaattcggattcttggtctgggtaaagagcgccgtaccgcgattttcccgaagctggtcttcacgttgaagcgcggactgaacctcaatccggaagaccccaactatgacgtcaagcagctggccatcgaatgtgccaccaaacggatgtacccagatgtcgtgtcatacgataccatcaagcggctgaccggctcattcaaagcgccgatggggtgccgcagctttttgcaaggttggaccgatcccaagaccggcaaagaagtcaacgccggccggatgaaccttggggtgatcacggtcaatctgccacggattgccatggagtccaaaggcgacaaggacaagttctggaagatttttgaagaacggatgcgtatttgcaaggaaggcctgctgtataagatcgagcgcaccaaacaggcgacgccggaaagtgccccgattctttacaagtacggcgcatttggcaagcgtttggctgacacagacagcgtcgatgatttatttaaaaacggccgcgccacggtatcgcttggttacatcggcttatacgaagtcggcacggttttctatggttcagcatgggaaaagaatcccgaagccaaggcgttttccgtttcaatcgtcaaggcgttggacgatcattgcaaagcctgggaaaagcagtacggctatcatttttcggtttacggcacaccgagtgagtcgctcaccgataccttctgccgcgacgacaccaagaaattcgggatcgtcaaagacattacggacaaggaatattacaccaacagcttccattatgatgtccgcaaatcaccgaccccgtttgagaaactcgattttgaaaaggattatccgcagtatagtgccggtggcttcatccactactgtgagtatccgaacctgaaacagaatccgaaagcacttgaggcagtttgggactatgcctacgataagattggttatctcggcacgaacacgccgattgatcaatgcttcaagtgcggcttcaagggtgaattcacggcgacagcgaaaggttatgaatgcccggaatgcggcaaccacgacccggcaacctgcgatgtggtcaagcgcctctgcggctacctcggcaatccaaacaagcggccgatggttcacggtcgccaggaagaaattatccaccggaagaaacatatcacgtttagcctgaatcaggtggctaaccggcgtgacaagtaggatgaaatagcaacagcatattaaaacggcgatcgcgagaagtttcctgcgatcgccgttttatgttggctgaaatgagacctgcgactttttattttatttgactgcgtgtaaaatgcaaagcaattaattgttagattgaagcgctattttgaggaagacaaacgagtcgggaggtgcagcatggttgccaatgcatttaccgccagtcagtggcagtcagccgagcaatggaacaatggctggctatttttcgctatcgttgtcattttactcattgtgaatcatattgtaatcattggcgtttatgttccgaatcggttgaaatggaaatgggcagttattgtaccgtttatttttatctgtcttgggttggccaggtacagctgggttcggacgaccagcgccgcgaatgtccagttcaatcagtgggcgaagcaaatcacgccccaaatacgagtcaaaaaagcctcttttttccgacttgtgccagttcctgatagcgccattgaagcgtaccaaggactaaatgagtatccggcttttaaaacattgcccatgtatgcacaccggcaagtcaccgcccctgtgacttatttggggcggaatgccaacagcgtttattttaaatggcagggtatgatttatcgctacacagggacaacgcgctcgggtgatcacgctgctttaatcggttatcgtttttggttaaaagaccggaactacacgcgactgggctttgtcaatccatctaaaacgttcactgcggctttaatgattcctaaggggcaggccaagcgcatctatcatccggtcaagcagattgtggtcacgcttgagagtatggatggcgattggacgactgagaaggtatatcggggatcctgatttacttggcaggctgatgttgcggccaaattggctttgtcaggatcagcatgaacaggctcccgacaataaccaaaatgatgtcaaggctaataccgcgataccagacaatggccaatcccgtgattaaaagtgtgagaccaagtaagctgaagccaagtgcagtgagccggcgggataaaactgaccagtcggcgaagatgtcgactgtttttggggcgataaaatgtccccaaactaaagtggtgccagtaagtaaccaccagatggcttgcgtcagccagtgtgggtggaatccaaaaagcgtcgttgttgccatgccaatcagaatggcaacaactgtggttaagacagccatcacagtttgccaatgattgaccgtactatctttgatcaatttcttcttcaactgtggattatccagaataagatgatcaagggagacgtcaaatatccgggcaatgcgggtgaccatctccaagtcaggcaagttgcgctcgttttcccagttggagacggtgtgacgtgagacattaagatcatgggcaagttcggcttgagtcatatgatgggcagtgcggatttgttgaagctgctttgaaaaattcaaattgttcacctcgcttggtctgattgtggcagacgccatcggaaatcacaaggaagataagcatccgcacgagctcgtcattcgagacaagtaattattgcccgggaaatgctggtttaaccaacacaaaaacggctcacaagattatagatgccacaatcttgtgagccgatcagccgtatgacaaggttctgtttaaagatgcgcgccccagaggttattgccaagttgtttgaaagaaaagatcttgtcccacagcgccttctctgtttcgctaaacacgaagtcgtcagataatttaatacttggccccatgttgaaaaatgcttggagggtagcgtaaaaagagacgccctcacttttctttatatctttcaaggtttgaagaacatatttggccgtttcggaattgggatgagattctgccaacgcactattgagacgttccattgcttgaactacttcgtcctttgataccatgattgccaccatctacttttctaatgaccatgacgtgactttcgaagttcttttcttttaaagataccgctattgtaaaaacgcttttaatcaactgtcaacaatttgcgatttgacagaatcagatgacagctaaggattgcctgaaggccgcggtgcctcgagtaaagacgttgctgaaaagttgggcatcaaacctttaatcgcggatttgatacctacgaatggcattgtactcatttccgtgttccgcttcagcattcctgaactcaatatcgttttgaaggttgagaaaatacctgtccgataccccgaagaaacgccccaaacgaattgaggtgtcagctgtaatctgctggcaatcatgtaggatatcttcaatgcgcgaagtcgggatgccaagggacttggctagcgagtacgcagataaattgaatgggagcatgaactcttgctttaaaatctcgctaatttttggtgttgggatttttccatggtacccccctttttgataaatatcctaataaaatgataaaagatgaagcttctgctgtctcagatgattataagcgtagtggagaaattaaagcaataagaaacactccgattattgatcgacagtttagattccgaaaacatagggattctggtagaattacttgataacgtaaaagctaaccgaataagatctgttttagatggcaaagtacaaggggactggaccttattcgcagttattgacgacaaactgtagattcaaaatatttgtaaaattccacttataaaggagacagggtatgaaaattctaaaatcaacagatgagcaagaggcttatattgaggacagattggaagcgtataacgaaaaaaagcatccattaacccaagaaaggccggcggtggtctttagttatacagcgctggagggacaggatgtaatcggaggcatcataggttacgcttccttgtataagattggttacattgacactttgtgggtaaatgaaaagtatcgtcacaaatccataggaacgcaacttctaaaaaaagttgaggaagatttgcgaacctttgggtgtgagatcgtccatttggaaacatttgatttccaagggcctgaattttataaggctaatcattatactgaatttggccgattggagtatccaactgctcaagtaacggaaatgtttttaaaaaaagatttgcgaattactgagtagaactatgatgaatagcgtatcggtccgcagcacctcttgtttttacaaccccaaccgtgctatactccaacacggtgccaaaccacggtgagttcgtaacgatcggcgcgtcagcgttcagaaggtcgaagcgactcgccatttttttgtgagcgcgaaccggcgcgttcagaagccggagtgtaagtggccttgggcgtgatggcggtctttgccattgcgcccaaggtccttacacgcaggcttttgcgccggtgagcgcgttatagaaagcaaaagacaaccccgcaattgccctaaatagaaacgctccttaatgccccgtctccatcaaccaccaccccaaaacaaaaaccgcaaccaacgctaccggctgcggccaaacaaacaattcaactgagcaagacgtcgctgataccccaagtttcaggacgccggctcagtgtctaactttttggacttagcgtgggccgttaatgcttcccaattaaccagcggcagttgtgccacggcacccagaattaagatcagtgaccaagtgagaatcagactcatggtgacgtcgccggtgaagtgggcaagaatccggacgcgggtgtaggccatgatggcgccgtaagcaaaggtgagccagaaaaccaggcgttggcgcttaggcttgtcgcggtcaacgaaccaagtcagggtgaggatcgttgcggcggtttgcgtatgaccagatgggaaactcatgtggccgtttgccccgtttggatggaaccaactggtgaagtgcgccgggttgccatttaattcgtatggacggaagcggccccagaaggttttcatcgcgtttacaatctgatcggacatgatgcagactaaggtggccacaagtgcgaccttcaataagtaacgcagctgttcatcgcttttgtgcgagagccaatattgactgccggcaaaaaccgcaacgtaaagcacaatgaacagaatgagactggtggcaccaggcaaggcaagcttgctgccatcggaatttgccattcccatcggcttgcctgcgttgatgtcgttgagcgatgtgattaccatcgtcatcgcatatttcagataaccggcccataattcccaaccggcgtagatgacgctgccaataaccatcagcgtgcgaacgtaccacgcaagttgcgaagagcgcagcgcatagtgacaaacaatattgcaactgatcataataatcagcggtgctgtccacagaccgacatcttgaaagagtgtggcgaacggatcgttcatatcgccaatggtttgtgaaatctgccagtcaaaaccggccgctgtagctaacaataaaagtaaaataccagcaacaatcagaaaaatatgttgacggatcggagcgtttaacttttgcgtttggtccatttttatacctcccttgtactttgaaaatagcacagagtttgcagaaaatggggggatttacgcgacctgtacgcaacatttaagtcaccgatacgaaatttacagaggctcaggcaaagtagggttcgtcaatcgttaattgccgctggtcaaagtcaacggttgcctttaagccgtacggtaaaatggtgcgcgggtaagcgtgaccgaagttgaggttgtatagaatcggcgtttgataagaagccgttacgtccaaaagcacttgttggtactcggtaaaataagtttcattttgcggtttgccaaccaaaatggcgcgtacttgctgcaggacactgtgatcatcaagatgccgtagaaattgacgatacgtcgttggatcgattttttcctcagaggtttcaatgaagaggattttgtctgcccaggattgcgggaaaaggtgatacttctcggcaacttgcggctcatcggagtagcggacaggatatagcaaatcgtgaaggctatcaagacacccgccgagcaaggtaccggtgatgcggccatgaccgcgtaaggttaagtagccgtgctgctcatgatgggctttgcgcggcacgcctagctgatcggcggaaaaatcggttcgctcttcataccatgtcggactggatgtgatcgccgtggtcgccgggttttcaaagaaatggtgaaaactggctgccgtgtaaggcagtaactgcttatccaattcggccagatcgttcaggaagtttggcccataaaaggtggtcatccccagttggtagaacatgagatgatcgatggttgtgtcagaaaatcccgtgaaaattttcgggtgatttttgaccgcttcaataaattccgggtcatcaagtagatacggcacgattcgataagtatcatcgccgccgattgcacaaataatgcctttgatgtccggatcggtcatggcggtctttaaatcagcggcccgagcttcgggatgcgcttttaaataggcctgtccgcgtaaagcgttgggcataaaacgcggcaccagccccattgcttcaaggcgtttggtccccagttcccgttgatgcgcggcaaaggcttcccctagtgtccctgcgcttagactgacaatggcaacttgctcatgttgatgcaacttcggtggtttgatcatttaacatgcctcctttggcaatgattgagtctattattcatgataggtcaggcacatgcaagcaggattgattttcgcgattcgttaaagttgtgtttctacccggcatgctggtaagatcgaagggtagctagtgaatgcgtgaacgaggggataaatcatgtataccattcaaactgccgcaacggttggggcaaggggcacggtgatcacgattgcaccgccgattgaacggattcgaccaggtgatccgattcggcttaatggcaaaaggattggcagagtgcgcgcgattgaaaaagccaatcatccgcaccatgttaacgacaagccgtgcaccggattagtgatcacgattccggtcaaacccggtgacaccattgagtttccgcaatcaccacgcaagtcataacgccagcggattggcggcggcgcgactatttgatgaatgtgaataagcatccacattcatttaaaataagcgtaacgcaaaaaatcggtcttaacccacaaggactcgtcatgcgagttattgtggttaagaccgattttttaatgtaaatgagctagtcggctgacgcggccgtcataatgccggcttcagtcatcccgtctgcatacagtttcaacttgccattaataatgtccatgacaagatcgccatattcaacaccgtctgcttcggcttcttgtggcaaaagcgatagcggcgtcatgcccggcaggttgttggcctcaatgacccatacgcctttatcgttagcaaagaaatcgatgcggccatagttttgtaagcccaaaacatccatggtttgcagcgacacatctttcattgcctgatggacgtcttcatctaaatcttttggcggggtgatgaagtcggtgtatccggcttggaacttgtgcttgaagtcataccagccagaatggactttaatctcaatggccgagaaggcgcgcccgttgacaacgcctaacgagaattcgcggcctggcgtgaattcttcaacaatcgcactgttatcgaagcggaaaacgtcagcgatgccactttccaattcttcctggttgtgggcgatgtgcgtgccgacactggaaccgccagacgttggcttaacgacaaccggaaaatcaaacggcaccttatgttcgccaggctgattccgtttgaattccttaaacgcagcggtctggatcccgtggtacaacatgatctccttactgaagaccttgttcatggtcatccctgaagccagcggaccggagccggtatatttgacattgttcagatccagcgttgcctgcaccttcccgttctcaccgtcaccgccgtgcaaggccaaaaagacaatgtctgcggctttgcagatcgctaaaacattcgggccaaacagctgtgtgctgccatctgtccgtaacttattgatgtcagcgtcagtcaggatggcatccgaaatcttcagatccttactggtgttggcgtcgtcaaaaacctggtcgaccgtttttccttcgaggtcgtagcctagaaacaggtcaataaaggtggcctgctgccctttttgtcgcaaggcgtttgtgatccggtagccgcttgaaatcgacacattgcgttccgtactccggccgcctgctaaaacgacaattttcattgatagtacctccacgtattatccgagtttgatagaaactacagtttagcacaatccggtctaaccggcgagaacggcgcttggatttgcggtaaaattaaccgaaatgaaagggattactaaaattcgaatcgccttaaatttgagcaaaagactgcagcagtgttaacgagcgcagtctaaggaggtcaccatgcaatattcgtggttaacaatgccccagcatcgttacttactggtagctgatcaagggaaacttatttttgtcgggtcgcctgatgctgacttgcaagaagcagagcactatgtagacgggccgtttgagtttaatgacgaggcgatggaaccgtttcaaaccgccctgactgcttacctcacaggaaaaacgaaggcagtgacggtgccggtagcctttcatggcaccgcgttgcagcaagctgtctggcagtacttgctaacgattccttatggtgcgaccagaacttatgcgcaggtcgcagcaggagtcggtcacgaccgcgcatttcaggcagtcgggcatgcggttggccagaacccgcttatgatggtgattccttgtcatcggattttgcgcaaagacggcgggttaggcggttttcgcggcggcttagcgttgaaacgcaagctgctggcgcttgaacaaggggaacgaccactcttttgatcatagcgggaatttccataattttttaaagggcgatgcgaaaggttctatttttatatcaggatcttgtatactgggttagacaaactaaaaacaaggggatattgagacatgaagattatcgcttacggtgcgcgagtggacgagatccaatatttcaagcagtgggccaaggaaaccggcaacacgcttgagtatcataccgagttcttagatgagaataccgttgaatgggctaaaggctttgacgggatcaactcgctgcaaacaacgccttatgcagccggtgtttttgaaaaaatgcatgaatacggcatcaaatttctggcgatccgtaacgtcggcaccgataacgttgatatggcggctatgaagcaatacggcatccggctaagtaatgttccggcgtattcaccagcggccattgccgagtttgccttgaccgatacgttgtacctgttgcggaacatgggcaaggttcaggcacagctgcacgcaggcgattatgaaaaggccggcacctttatcggtaaggaacttggccagcaaacggtcggcgtgatgggcaccggacacattggtcgggttgcgatcaaactctttaaaggctttggtgccaaagtcattgcttacgacccatacccaatgaaaggcgaacatccggacttcgagtatgtcagcttggaagagctcttcaagcaaagcgatatcatcgatcttcacgttcccggtatcgagcaaaatacccatatcatcgatgaagcagcatttgacttgatgaaacccggcgctatcgtgatcaacacggctcggccaaacctgattgacacgcaggccatgctcagtaaccttaaatccggcaagctagccggtgttggcattgatacttatgaatatgaaaccgaagatctgttgaacctagccaaacacggcagcttcgaggatccgttgtgggatgaactgctcggcatgccaaacgttgtcctcagcccacatatcgcgtactacacggaaaccgcggtgcacaacatggtttacttctcactgcagaatctggttgactttttgaccaagggtgagacgaatacggaagtaacggcaccggcgaagtaaggatcaaagttaaaacgtgcacgactcattggcggctttgccagtcagtcgtgcacgtttttgatttttaatgatcttcaacattcacttcaagtgtcgtattaaaagcagttcgccacttttgaccgattgccggactgatttttgacgttgcttttaacaacgaattcacatcttcctcggcaaatttagaacccattatcttgaactgacaaagcttcttcagaagatttgattgtaaacgaatgaaaaagtaggcttctggcaaatgttgttcatttaaccggtcaagcgcggttaacgcatcggcatacttgtgtcggtggtagagcgacgaggctgttttataaagggcttcagaaaaaagatcttgttggttctgatgcttttttgtcgaaaagtgaattaaaagtagtcggggataaagttgctcgaaaatggttgtctggataaatggcacacagtgattgtagaccatgtattctaatcgataccaggtatcttgctggagaaggtaagctttgacgagttctgcgtctggttttgaaagaaatgaatggggatgctgaattttgataattgttgcggtcacaacgattgctcttaatttatagaaaggtgcgttcgttttcgtatactgtctttcaagttgaagttgatatgagtgcaatgccgtaacatcttgttctaacgataatcgggatattcggtcttcaaaagaatcatttgaaatgtcagtgatcggcaattgactttcccgtaaatcacttaggagttcgcaaaattctgccgggtctactttcaggtttttgagtaactgggaaaagctctctaacgaaatgtcggattgaccattttcaaactttgagattgtactgatgcttaaattgtcagcaacgtctgaaattcgcaagcctctagaaacacgtatgcttttaataagctgtcctttggtgtattcggtcatggcgcaagcgcctccaatttcatatatgcaagtattttagcaatcctatacatacttttataatacgaaaatatataaaaactgtgaactttttgtgataacttagtttttgtcaagaaggtatgcgactttccattaatgaatgagatttaaagaaaaaatttttgaatgaaaacgcatcaatatgttgaaacacagaggaaagcaaaatatagaaagcggcatatccttttgcaaatcgtattgatgtagcccaagcataggaggatattatggcaaaatccaagcaattaactgtagctatcgttgctcttgcatcagtcgcaggtttttcttttagtcagattgaggttaaccacgttgcggcggcaacaacgccgagcaaatcaaacgtggcgtctaacacagcaagcacttctggaattgatccgaataatccggtattaccagatcagtctaagacgaggtatattgatgattcgcaagttctcgaaacactaaaggcaaaaaatcctactgcttataacaagattcctcaggcaacgattgacagcatagagaatagtggtttgcttcggcaaggaggaacttatgcgaaggttacaagtgatgggattaccatatatataaactctgcacttgtgactgttgcgaagatcgctggtacagctgctatttcaactgctcttgcatcagtacttgacgttgaagaagttggaaaaaaatcagcagtatttattacatcgtctatgactggtattcttgatcagttttcagcagaacgaggtatctggatgcattttactaattatgaccctggttctacaggtgaagggaatctgcttctaagtagttgcggacagcagtaagacaaaaataggcagttgtcattacagatttccaatataaaaatattgactgttgcgaaaaaagcgttcatgtatggtgggggtggccaagattaagatcaaaatgacgacaccaaaactcgttgggatttgtgtgattatcggtgctctcattggggtgattgctaaatatctagccaacttggtagctaattccgtgcttgagtgggcgatcaaaattggtgcccttgccgttgggggactggccggctatgaactctggaaccattttgaaaacaagaagaattccaaattgtgaacatgacaagttgatttatgtcgcgaacattctgtaagaagttcgtgtacggaaagtcgtgatcttgaaaggagcagcacacagcaactgaaaagagtggttggattaagaaaaaaatgacaacgaaaaagctcgtttggatttgcgcgtttggtggttatctttttggtgaacttaccggtcgcctagccaaaatggtaagcaatggcgtgctgtcatggagtattaacattggctctattgtcgttgggtcattggtcgcatacgcattcgggcaccactttgacaaaagggaaaaatctaattcttaaacatgacaaaacgcgctgcctcctgtggattaggaagcggcgcgttttaatatgccagctttaaatagaattagtgatgactctgtgtcactatcttttcgaatgtgttggcaacattcaaatcaaacaaacggccggaactgtgccagcacaaagcccgtaacggtcaccagtgcgaatgcagcaagcgcgctccacaggatggctttacttaggtgctgttgctttttacctgcaaaggcaacttcgattaaaccgattaaaccaatagccaacaaaattttgacgactgtcagcaaagggttgcggtcgaatgcgaaacgcatcaacaccacaccagtcacgatcgaaactaggtaacaaactcgcgcgatcatcgtccacatgacaaactgccgcgtgtgactgaaaatggcaatcccagctgcaactgccaacactgcccatgaaataagatgtagccaaagccacataaagaaaacctcctcagatcagcaaaagtattagttacactataccgctttttctgaaaaaacggacgatatttgggtgttgccagtaaaacacgaacattaacgatgactttttgaaaaataaacgtattttctattgcaagttgatgtgttcttcggtaaacttttcatattcaaagtttaggggagcgtgtcatggaaaacttttttcatttgaagcaaaataaaaccacgccgatgaccgaggtcatggcggggctgaccacattttttgcaatgtcatacattttattcgttaaccctcaagtactatcacaaaccgggatgccggcgcaggcagttttcctcgcgacgatcatcgcgagtgcggttggcacgttggttatgggattgttcgccaatgtgccttatgctttggcaccgggcatgggcctgaacgccttcttcacgtacacggttgtcttcgcccttgggtttagctggcaggaagccttggcgcttgtcttcatctgtggcgtgattaatattttgatcactgtcacgaagattcggaaattgatcattgtggcgattccggaaaccattcaacatgcgattggtggtggtatcggggttttcgttgcgtatatcgggatcaaaaatgccggttttctgcagttcacctccgaagcatcaagcattaacacgattaatggtcagccactgaaggccggtgcgttgaccctcaaacatggggttgaatcagttgtttcaaacggtgggattgtgccggcactggttaatttcactcaggccggtgccgtgttggccttgatcgggttggtcatcatggtcatcttgaatgtcaaaaaggtgcctggtgcaattttaatcgggattctgttgacaacgattatcgggattccgatgggtgtcaccgatttgcatctcagtgccgcaaattcctttggcagcacgtttgcatcgcttcaaacaacctttggcgcggctttctcggctaaggggatgggttcgctgttcacgaatccggataaaatcgtgttgtccatcatgacgatttttgcttttagtttctcggatatttttgacacgctgggcaccttcatcgggaccggccgacgtaccgggattttctctgatgccgatgagcacgctctggaagaaggatcaggcttttcatcgaaaatggatcgggcactgttcgccgattcgattgcgacgggcgttgggtcgatcttcggaaccagtaacgtcaccacttatgttgaaagtgccgctggtatcggtgccggtggtcgaaccggtttgacttcggtcgttgttgcagggatgttcctgattagctcgattttcgcgccgtttatcgccattgtgccgacacaggcgttggcaccggcgttgattctggtcgggattatgatgatgagtaccttcaaggaaatcgaatgggaggatctgtcacaagccattccggcgttcatggcatcgatcgtcatgggctttgtctataacatttcatacggcattgcggcgggcttcatcttctactgcctgatcaagctgatcaccggtaaagccaaggaaatccatccggttctggccgtagtcaccgtcggcttcatcttgaactttgtcattcttgcagcgttataaaagcacgcaaaaaccactgtcaggcggcagtggtttttgcgtgaacgcgttcaaaagcgtgggctattttggacgctcggcgaaagactgaatctatgctatgctcatttcgaggtgattaacaatggctcttaaagcaattttccatttagatacaactgggcgctggccccatctggcttcgaatctgactaactttttgacggctgagccaaatgctgatctggaagttctggtgaacggcgatggcattaccgtttattttgatcaggaggttgtcgatttcattgctgcccatccgcaggtgaagttctttgcctgccacaactcgctagcgcaacgtcacttggatgaaaagcagttgccggcgaccgtggcaattgtcccggttggcgtggttaagctggcgcaagcagaaacggccggctatgcatatattaagccgtaaaagtagcttaaagtttttcagctggttgtggttccgtgttgaatgggactagattgcgttcgatggcggcgcgctgatcttccaaaaacggcggcaattcaaggtgaacgccggcttgttcgtaagtttcatcaagcaagaagcccgggccatcggtagcaatttcaaaaagcagctcaggaattgggcggaaatattcagacgcaaagtagaaccgatcgacgaagccggaagcatccaagccggctccgccgatttttttgatccagtagtgcaggctatcgcgatcgtctgtccgaaacgcaaggtggtgaacaccgccaaagccttgataggcagcgggaatcagacgttgatagtcaatgatcacttgcgcaccatgaccgccgtgatttagctcaagtaaagtatattggccgtctttggcgatcttttcaaagccaagtagatcggtcatgatgccgatgagttcctcatagtgatcggtggtgatgtactcgggaccgaggccgctgatcgcaaactccggcggcacgggtgaatgccgccacggcgtacctgcagggatgccatggttgtgttcatcgctaatcagctgatattgttggccatcaaaatcgtgaaacggtaatattttggcgccgaatagttcggtgatcgcgtcatggcgcacacgttgctcgtcaaaccgtttgacccaataattgagggcgtcatcggatgacacgcgaaaactggtgcgggcaatttcgttgttgccatgctgggctttttggatgccggggaagtcgaaaaacgtgatgtccgttcccggagtgcccatgtcatcagtaaaatacagatgataggtgcggacatcatcttgattgacggttttcttaatgagatggaggcctagaataccactcataaagtgaaaaatccgtggtgcgcttgacgtaatagcggttaaatgatgtaaaccggttaattgattaggcatgatgggcacttccttttgcttatatttagtaagtgaaaggtaccatgctgcccaccaaattgcaagggcttgcgttttccttaagttgattaagctcttttcaaaatgttgtgaccggctgcgctatggctctgatgacatgatatgctcacctcattaacgtaaatccaggtaaaggagcccgaggcgaacatgtttaactttttagataatccggatgaatataaacggttgatgaaaatggaaatattgatcacggtcgttgccgtggctgccagtgtcgtgctcttcaactttggcgtgctgactggggccttgtttgcgaccatcgctgctgcattcttcttgatggacgcaatcgtcgaagggctgcgactgttaggagcatcatgcggattcagccgcttcatcggtacagccgtcgcgatcccggcattggcaggctacttgatggtgatgatcgcccgcttcccaattggcatagcgtaacggtgtgaagggtatcagcggcataacagctgaccaagcacaaagactactcaaaaagcgatctccgacatggggatcgctttttgagtgtcgctggattgatctgatcagagctacgccactttaaaaatgaaagtcctctttatccgccaccgcttcggccgtgagttcataacgaaccagcggcaccttactgccatcggggagggtgcgttcatgccgataatcgccaacctgcgtgaagaagttgtcggttaataacttcgcggcgcggtcattacttgctggcaaaatgacataaacccgcttaaggccaagctcgaaaaaggcaaacccgatcatgcgcttaagcacttcgctcataatgccttgcccttgataagcagctaaagtttcaaaacgaatctgcgcaacagtcttcttctcgctaaagttccagatgcagaagctgccaagaaaatcattcgtgctccggtctttaatgccataaagcaaggcattattactcatcaccagccgcatcgaatgattaatgtaacgcgcagtatccgtaatcctttggtcaaattgacgcccggactccgcggcaatctgctgatcagctcgcagctgaaaaacgtctttaatcttaaaagtcgtcagccagtccatcgtgtaatgaaccgacataatcggatggtacttttcaaaactctgcatagctttcctccatgatcatggtgatgacgtaagcttaccataaaagagggtgagcgtgagccggcgcgcttaggagtcggagtgtaagtggccttgggcgtgatggtcgggctttgaccattgcgcccaaggtccttacacgcagactcctgcgccggcgaacgcgttatggagaaaggacaagtcacacgcatccagaaaccaaatcaaaagtggcctcggtcgcaatggcccggtcttggccattgcgaccgaggtccttacacgcaggtttctgggctggcgaacgcgttatggagaaagaggcaagtcacgcccagttagaagccgggatgcaagcggcctcagggacaatggcccgggcttaggccattgtccctgaggtccttacacgcagatccctgcgctggcgaacgcgttatggggaaaggaacaccccggcaccttgccgtcactcccaacacgagcccattgtaaatggcatgaaccattaccacccgatttacgaaccgcacctatctaccgttataaaagaaatggtttgcggtttgtttttaacgattatgagtaatttgtgaaaatgttctttagcaaccattaaagaacaatttcacaaattgatcgcagctgaccggactaaccgaattaaattgacgccgttttcaagttgatttttaaaatcttgtataccaaagaaattaacgggattagccgttatttttttattttttaagcctataaataaaaactgaaaatgacaaacgtcagaatcgccttatataatcaataacattgagaaaggggtgaaacaaatgaaacagtttttttttggcttttgtcaggtgtcatgctgttgcaaccacttacattaaatgtcggttcacaggcagcttcatcaacacctagcccagtcttaaatgaagcgtcggtttcacaaccggatcaacaggcgccatctactagcgccgaaagcaagcttgagacaagtagcgaagcatcgacgagttcgaatcaagcgatcgcgagcagcaccagcgcggcgtctgccagtcagccgatcgcgagcgatacgactcacgaagcgctaactgatcaagccgacgactcagcgaccccgaagcggcggcaaaaaagagcagttcaagcaacaagctccactcaatcctcaccttttctagtaggaactgctcaagaattggcagccgccattaaaagtggtgaaacgcatattcgcttaaccgctgatatcaatattggcgccgccgctatcccggttcgccagtcggtcatcattgatggcgatcataaatacacctatatgtacaatggcggcctaaactggcaccgcggcatttatttcgcggccagtggcatccagattacgtttaaaaatattaaaatcggcaaggcttctgttaaacattcagctaataactactacggcattgcgccggcagacaatagtattaaaaacagtcagatcatcattgaaaatgtcgactattactcagattatggggcgcaaccgattcacattcgcgataaaagtaaccagattattttcagaggcaaaaacaatttttatacgacgaaaaacccggggtcaatcctcatccaggaatttgccgaagccactaattttttatttgaagaagattcggacaccactatcaccttagccaaaggcgaggttctgggaaccttttggccgtcaaccgggccgttgaatctggaactaaagaagcgagcgcggttgaaagtcgataccaccaatgcgcttgtctacaccggcatcggcgcaatccacaacaaccgtatcgtcattggtgaagaggcggttctggatgttaagacgaatagaacgaacgctggtaacttaatgttctataaccatgatctgaccatcgatgttcaaagaaatggccagttattagccgaaacggttagtgcaaccaatttcaatagtaactccagtatcaatctagggccgggagcgaaagcaaatttaaaaaacgtcaatggcgatttcttcaagaaagggaaaggcaccattacgcttgataacgccgatgaattaacacttgaaaccggaaaatgcgggggaacgagtcccaccggtttggtttccagtaaggccaatgtgcggcttgaaccttttaaccaagaaacaaaagggtacggggtgcatgctgacggtcaattactgacaacccaaaccggtgacgatgattggatttttaacggtaagcatgtaagtcggcaaccaacggcacttcccactgatgttgcaaaccaggtgggcaatgcttcggtttttaaattaaagcggcaattggttccgaaaccagcaggcaagctagccgtcattagtgtgccggatttggattttggtagtcaaacggtcacgggattaacccaaatcttacggccacgggttcaaggcagcttgaaaattgaagattcgcgcacgaatggctctcaaaaatcgcggctctatcttagaatggcgcgcccgtttaaaaacggcaatgtggatgcgacccggtgcctaacctatacgaatcaggccggtcaggaacaaactttatccagtcaggcgattcttgctgaagtgaatgtgggcgtcacggaacgcgacgttagcagtgaatggaataccgccattgatagctcggctcgcgggttcaaattgaccctgccgattgaaaagcaaaaaatcggtagcttctcgggagaactggattggtcgttgcaagacgtgccaggaaattaagaaaggataagccaaatgaaaaaatggttgccactggctgttcttttgctgggactcgcctgccacccacgactcgttgccattgcagatagtcagtacacgtcgacaggtgaggttgtttttgttgaaccggcagcatctgagcctgaacaaccatcagcggcaccatcggctcaggcgtcaagtcaccagcaacatcagccaccagcgacgtcacaagccccgccgtccaggtccggactcgttccgcgacttggggagcggccggaaatactttacggcttaatcggcagcttgttgatcgtcaccatgctcctgtttttcatcatcaaacaacacaaagaagataaggaagaaggaaaataaaaatgaagaagagtatctggacagcaccgttattgggattaactttggtaggacttgtagcaccggcagcagtcaatgcagcctcagcaaacgacatgatttcaaacggtgaggtgacgtttaaagccgacaattcaagtactggtccgaaagatccgcttgatcctaccgatcctaatccaattaagccgatcgatccaagtaatccaggcggcaacccgacaccggggacaagcggcccgctgtcactggactttgcttccagctttacgttcggcgaagcagcgatcagtagcgatgatgccaaatactatgcgaagccacaagtattcacccaacaagatggcacgacggttgaccggcctaattatgtgcaggtttccgataagcgtggaacttttgaaggttggaccttgaaagtgaagcaagacaaacagttcgccgtgaaagatgatgctacccgcgaattgatcggcgcgcaactgaaattcaagaatgcgagtctggtttcagccaccgattcgaagtacgccccaaccggtttggcatcatttgaattgattccgggcaccgcccagattgccccggttgaagcggtcaaggaccaagggatgggcacatggatctaccgcttcggtgacgacaagcaaatgggccgttccgttgaattgtcagttccgggtaagacaccgaagatggccaaggcttacgttaccgcgttaacttggaccttagaatcaaccccggccaacgtaacacctaagccttagtcaaaaataaccggattttagccagcgttagtatgattttgccgatagcctcgagacaccatttttaaaaaggagatttccgtgaagaaaatacttttctgtttagcagcgtttgttgccatgttgttgacccctgccgtgcatgtttttggttcagaattgaattttgccgcaaaggctcagctgccagacaatcaggtgcacacagatgtcagttattttgacatcaagatggatcgcggcgctaagcaaacccttcacgttgatctacgtaatgataccgaaaatgaggtcgaagtcgatgtcggcattgctagcgcgacaaccaacattaatggcgtggtggaatatagtccgaacgacattaaaccggccaaaagccttgcgtttaatctcaaggatcatgtcaaagcacctagtcaaatcaaaattccggctaagggcaatacgattttgaatttagatgtcaccatgcctgatgccgccttgaaagggcagatggccggtgggatcacgctcaaagagcatcaaacggaggatcaggccaatgaagaaaaaggcaagggattgtcgatcaacaaccggttttcctacgtcattggccttgtgcttcaacagacgacccagccggttacgcccgacctgaaattgaataccgttaaaccgagccaggtgaactatcgcaacgtcatttccgcgtctctggaaaacatcactccgacgttcatcaataaagttgccattgacgcgaatgtgcatgccaaaggggccaaaaaggtgctttatcgtgttaaaaaagaaggcatgcagttagcccctaacacgactttcgattttccgatcgccttggcagggaaagccttagagccaggcacttacattgcccaactagaggtctatggtaaccaaagttcggatggcaaggtgacgcggcaaaccaacagtgccaaacaacgctatcaaaatcactggacattgaccaaagaatttaccattaccgaccatactgccaagaatctgaatcaaaaagatgtgaccctgaagtcaaccaatcattggtgggtctatgcattgctggcagtggtcgcaatcttgctcatcgtcattgtgctattggtgattgtgctgctaaaacgcaagcacaaaaaaagcacggaacgtgaatgagtagattaaacatgttacaatctagggtaaacattgatacttcttttgacttcggatcaagcggcgctcaacgggcagtacctaaggatatgaatgagttggcttaggttaaaagtagttgcaacccaaccaactattttgcttcataatgaacgcgatgaacgcgcttattaaaaaaatgagcattttcaagcggcgcccaacttaaacaacagatttaaaatccgcacattaggctgccaacgtctgaggacgctgacagcctaattgtgcgaatttttagtcatgtatgtgatttggattgtgtaaaagcaaaattgaaagcttgatttcattgatgatgtgggtatttgatcattaggtgaaggcacgacatcaggtaagcgggttggttttagtcttaaggtgagggtggtatttatgagattatctgaattgatggaaaaaaatgatcaaaagaaactccagctgctgcattatcttgatcaacatccaaaccagagactgaggaatagtgaattacaacacaaactggatatttcgtattatctctttaaacggcggactaaagagattgccgatgacattgatacgtttcaactgtctggtttatttgatattgaagtgaccgacacgacgacaactttgcataaaaatcacaacaccaacattttcgtctttttgaatcattatcttgagcgctcctaccaaattaaaatcctgatgttgctagtgatgcaacggcagaattttgatctctatgattttgcggaagcacattatgtcagttatacatttatgtataaacgtttcacggcgctgcgccaaacgctgcaaaaatgggggattaaccttaacaataacagcgagctgaccggtgatgagttagccattcgcttattattggcggaacttatcatcattacccacgtcggtgaagaaacgtttgataacgagattcggacagccttgcatgaacttcttgagctgattgacacgccggccattgcgccatcaatgagtcagctgattgaaaccaaagcctatttgctcgctagcctattgcgatttcaacaaggctatttcgttgcgacttcaccggaagttgccaaactgatcagcaaaatccggcagcaggcgcttgaagaacggagcaaagtgattgcgatttttcagactcattttcccgccgatgagcaagctatcaacaatgagtgtgattacctaggtacgtttcttgcgattgtggggatcatatccgctccggcagtgatttttccggatgaagtgacacaaagaagcagcgactttattcgtggatttgaagaacggtttggtgttacattaacgttggaagcgaagcaaaatatcacttatgaagttgataaatgctggattgatgttgttgcctttccgcttagaagtggtttctttgaatatcataccgaaattgcttattttgccagaacgtttccggagttttttgaatattgtcagacctatgtgcaacaacaagaagccgcgctagatgatcagcaggcccaattcattttttatcgttgcttactgacactggtggcgaatgtgccgctgagtagtgtgcttgaaccactgtatgtttgcgttgatttcactttgggggaagcttacaacaccattattgaacgggggatcaagcgattctcgatgttaaatgtcaaggtcaccaatgaagtgcagccgaagacacgcctgatcattactgatttggttaacgcgtaccggcataccgatattcctaaagtgatctggctttcgccaccgcgggcggaggattgggagcatttgattagcgagcttttagcgtttcgcttagtgccgaatggtgtttgaacgactactgtagcagtctgcacctagagtgattaaacgtgagtgtttcacacaactagtttttttatccaagcgtatctttttttgatctatagatttcttatgttatactcacgatattcacaactggaggcgaggcactatggaacgagaaaatggtttttggccagcgataaaggacttcttctttcgtgctggtgacttcaaaggtgttagttcacgtgcgcagtattggtgggtgtttctagctcaaattctagtcggcgttgtggccggcgttttgatcggtgtcaccgggcccgcgattcttaatggcgaaaagtcttttggcgctagtcttttgcaaacgctggtgatgttgccagcaattgcgcttgggtatttaggttatccccaactaagtctgacaattcggcggtttcgtgatgccaaggttagcccttggttgtatctagtattagtgatcgtggctttagccggaccactaatggcggcgagtggcatgggactgttgccattgttcattctaccgatcgttgcggcactggtaactttaattatcttggtgttaccgagccgtgagcaggaagtgaagccttttccggttcaaccacattcgcctagcacagttggcgtaggttttggtgcagccgttaaaaatctcttccttcgcggcggcgactttaccgggacatctagtcggagtcagtattggtggagtattttattttctgtcctcattatggtccctacaggattattcgttattttgtcactagttgccacatttgttggggtagctgctgcaggaaaaatagaaccgcaaaatgcagcacatatttttaattcattaggctttggtgctgtcattttagttgttctgttccttgctattttctatgcatggtctatgttgtctttgccgatgttgacagtaacttggcgccggttcagagatgcaggcattagtccatggtggtttgttgctttttatgtcgtgtcgaatttcgtctcggctcttcaagcaagcaacaagaaccttgttttaactttaattccgttgattctcgttatcgtgcagatcgtcattcttgccttaccgcctaagaatttaggcgaccaatagtaaccgtattttgcaccaaacaatgacgggttcatcaaaaaaagtgccgacttctcaaacgaagacgagcactttttaatttgtttcacaacatgtcagttgactcaataaatgccctttgaatcctcatcaaccaatggatcgttgaagttcttgtggaagtaggtgctgtcgatgactttgaacttgccgttggtgaaacgggcgatgatttcgccatattgaacgatgagcggttccgtattcggaatttcgattttgagccgaccgattggtgttttggtgaggtattggaagttggtgccgaagaatcccttcagatctttcgtagttgtgtcctgcgagtaaggtaggaagtgggtcattttagcggttgaaaaagccgcaaattcgccttttggaaatccttctagcgatgaaggtggttgtgccattttatccctcctggggcctgcgtacgttgttgtgacaacgtcgggtggttatgaatttacttatcattatgttaacacaataatagaacaatggaatgattgcgtcgcagcttgaaaacgcttaaaattagggctggacgttgatcgggggtgagcatatggatcaaagtctgtttcaaaatggtaactttcagccgttggcgagtcggatgcggccacaaacgctcgatgagtttgtcggccagacccacctgttaggcaagaataaggtgttgagcaatctcattgaacatgatgagattagctcgatgatcttctggggtccgcctggggttggtaaaacgaccctggcgcggattattgccaggagaaccaaagcacagtttgtgacgttttctgccgtcaccagcgggatcaaggagattaagcaggtgatgaaagaggctgagcagaatcgcgaactgggtcaaaaaacgattgtgtttgttgacgaaattcaccggtttaataaagcccagcaggacgcttttttaccgtatgtcgaacgaggcagcattatcctgattggtgccacgaccgagaatccgtcgtttgaagtgaacgctgcgttactgtcgcggacgcgtgtgttcgttttgcatggtctgaccagtgcggaactggttgatttgttgcaacgagcgctgaaggatccacgcggttatggcttgcagaaggtgaagatcagcaaaaagctgttggggcaaattgccgattttgccaatggcgatgcgcggattgcgttgaatacgctggaaatggcggtcacgaacgccgagaccaaaggggatgttgtctcggttacgcaggcagatgtcgcacaattattgaccaaaaaggccttattgtatgacaagaacggggaagagcactataatctgatatcggcattacacaagtcgatgcgcaattctgatgtggatgcggccatttattggttggcccgcatgctagaggcaggcgaagatccattgtacattgcccgccgcctagttcggtttgccagtgaagacattggcatggccgattcccgagctttggaaatcgccgtcaccgtgtatcaggcatgtcagtttatcggtatgccggagtgcacggtgcacctaacccatgccgttacttatttgtcactggcacccaaatccaatgcgctttatacggcttatggtgccgccaaaaaagatgcaaccgaaacattggctgaaccggtcccgcttcaaattcgtaacggggtaactgatttgatgcaggatctcggttatgggaaagattaccaatatgcccacaatgccaaagacaagctgacaacgatgcagaccatgccggataatctggtggggcgaacttactatcatcctactgatcaaggtagcgaagagaaagtcaaagaacgactcgaacagattaaggcatggcacgcgcaacaccctacccctacaccaccggatactaaggaaaagtcgtgattgggacgataccggcgcgcactggttcgcgctcatcataacgcgctcactataacgcgctcaccagtgcaggacctgcacataaggaccttggtcgcaatggccaagatcgggccatcacgcccaaggccacttatgctccggtccctgaccgcactggttcgcgctcacttatctataggaggaataaaaaaatggcgaagattctcgcagtcaacgcaggcagttctaccctgaagtggaaactttttgatatgccggctgaggttcaattggccgagggcttggttgatcgtttgggccagccacaatcgaaagttaaaattaaatatggtgacggtcaaaaatacgaaagtgatacgccgattgccaactaccaagaagcagttgccagtttgatgggcaatatcaagtctttgggcttagtcgagcatttgcatgaaattatcggtgttggtcaccgggttgttgccggtggcgaagtttttgctgaatccgttgtcgttgacgatgagacgttgctgcagattcaaaacctgcgtgactatgcgccattgcacaatccggttgaagctgattatattgcggttttcatgaaaatgatgccgtgggcgacagaagtagcggtttttgatacggcctttcatcaaaccatgcagcctgagaacttcctttacagcattccttatgattattacaaaaagtatggcgcgcgtaagtatggcgcgcatggtaccagtgtgcgttacgtgagcgctcgtgctgctgaaatgctgaacaaaccattggaagacttgcggatgattatcatgcatttgggctcaggttccagtatcaccgcagttaaagatggccagtccattgatacctccatgggttttacgcctcttgccggggtgacgatgggcacacgttctggggatattgatccatccctagtcgcttacctgatgaagaaactggatattccggatgttggccagatgatccatattctcaataacgattccgggttactgggcatctccggtttaagcaacgatatgcgggacttggaagcggccgaagatacgaatccgcgggcgaaactcgcattggatatttttgtcaatcgggttgtgaagtatgttggctcttatgcagccttgatgaacggcgtagacgcacttattttcactgccggtatcggcgaaaatggggatgaaatccgcgacaagattatgcgctcactgggctacctcggcgccaagatcgacaatgatctcaattacaagtcacatggtgtcgaaaccgatctcagcacgcctgattcaacggtcaagacgttactggtgccgacgaacgaagagttaatgatcgtgcgcgacgtgatggccttaagctaaggatccagaacagattgcaacgatcacgataaagggtttgtcacaacacaaacccaaaatagacgctagaaacaagctttatcgcttgtcatctagcgtctatttttttgccctcactaaagcttcgtggctttagtcaaaaatctgcacatggttcgctcgcgcggtgctgacgatatcttcaggcatggccttgtcagtggcaatgtaatccagcgtattcatgggtgcactcatatagagttgatgtttgccaactttggtgtgatctaccagcaacatgacctggtctgcgtgcgccgcaaacgcccgcttgatgttggcttcctggtcgttagcatcagttgcaccggcagcaatcagtccgcgacacgagaagattgccagatcggcttggtaattttcaatgtcacgcgtcgctcggtcgccactaatgttttccagcattttattgaccgcaccgccaacaagattaacgtgccaaccgttatgtttggaagcttcaagtgcaaccagaatcccgtttgtgacaatgtacagctcatcaatagcacttaattcgcgaattaaaaccaaagcagtcgtactcgaatcaataaaaaggctcataccgcttttgatcaaccgatctgcccttgatgcgaccgttcgcttagcatccaaatttaaagtcaccgaataatcataagggacgtcttcaggttcctcgcttagcgttacgccatttagaacccgtttgatcaaaccgcggttttccatatccagtgtgtcacgcctgacggtagcgggactgacgaaaagttgcttagccaagtcactataccgagcgaattgttgtgtgtttaaaattttcagaatttgctcttgccgttgaaaagaaaccattaaagcgccttctttcctaatttgaatgaatttatgcaaaaatataccacatatttgtaaaaatatgaaaaattatcgatttactcgtcacgtgttgtcaatatttttcacaactcatatactacactatgaaagcggtttacgaaagcgaaggaggttctcacattggcacttatgggattggatctcggtacaaccggggtaaagagtacgatcacagacaatcaaggcaacattctctctgctgcctaccgggaatatgagacgtcggttcccagggaaggtgaatacgagctggatccaagcgtggtctggtcggcaacgaaggaggtcattcaggaatcaaaaaaattcgttaaggaagatgtactagccgtcagtgtttcatcgttcggcgaagcatttgttgcggttgatgatcaaggacagccgctgatgaatacgatgttgcagacggatagccgcggcaaagatgagttaaaagatctgctgacacggatttcggctgaggacatcaggaataaaaccgggttgaatccggcggtgacattcgcggtacctaagatcatgtggatcaaaaaacaccgtccggaactttatggaaagattcatcgtatcctgctttacggcgcttatatcctatacaaacttggtaatgttgatgcgattgattacaccctggctgatcggtcgctggcatttaacgtttcgaccaatgactgggattcggacattttggcagcagccggcattgatcgcaagctcttgccgaagtgttaccgcctaggcaccgtggttgggacgatcaagccggagttggcgtctgagttaggtattaacgctgacatgaaacttgtcaccggtgcccatgaccaaatttgtgtatcgattggcgccggaaccatcgatgtcggtgatgccactgacgggatgggttcggtcgataatatttcaccaattttcacagataccagccatctcaaggagaatgccaaaaagaattatccgacggtgccgtatctggataacaaatataccaccattgcttacatgtatgatggcggcacatcgctcaaatggtatcgtgacacgtttggttttgaagaagttcaggcggccgagttatcaggggtcagcgtctacaacatctttgataaatatgtaccgaaaaagccaacgaatttgttggttctgccacatttttccggtgcagcggttccttactttgatgaagatgcacgcggcatgatcctcggactctccggtgcaacccgaaaacctgatatttatcgggcattgatggaaggcgtggctttcgagatgcgcatgaatctggacaacatggaagccggcgggatgcatgtcaatcatttgcgggcgactggcggcggttcgcggtcagatacttggctgcaaatcaaagcggatgtctttaaccgcgaagtcggccgtgttcatatgaaggaatcaggaaccatgggtgtcattatcatggctggcgttgcggttggtttgtttgattcttttgaaaccgccatgaagaagttagtttcgatcgataaagtcttcaagccgattccggagaatgttgccttttacaatcaccagtataaaaagtatcagcaactgtatgcatttggtaagaagttacggagcttataggaggaaaatattatggttttagtaaacacaaaagaaatgattaaaaaggctaaggaaggtcactatgcagttggttcgtttaacgtcaccgacatcgaaatgatccgcgggattgttggcgctgccgagaaagaaaactcaccggtcattattcagtttgcggagttgcatgataagtatgtgccactagacgtgattgcgccggtgatgctgaatattgcccgcaaagcaagcgttccggttgcggttcattttgaccatggcgagacttttgacaatattatgcgggcgattcggcttggatttacctcggtcatggtcgatgcatcgcaggagaattttgccgataatctggcgcagaccaaagaaatcgtgaagatttgcaagccgttggatatcacggttgaagccgaactcgggccaatgaatcgtgaaggtagcggggataagaaagtggattatgcggatctggacaaaacttacaccaacccgcaagaagccaaacagttcattgaagagtccggtatcgatatgctggcggttgcgtatgggacggttcatggtgtttacacgcaaaagccgcacttgagcttcagtcggttgaaggaaatttctgatttggttaacttcccattagttgttcacggtgcatccggcttgactgatgaagaatatcgcaagtccgttgaaaatggcatctgcaagatcaattactattccgaaatggttcaccgcgttgccttaggcgttcaaaagaagttggaacaggatgatagcgacaaacaactattcatctcagacgccagcatctgggaaaccgaaatggtcgaaaaagaaattcgcggtcgtctgcgcgtctttggttcggcagggaaggcttaatcactttagaaagcaggcggatagccgtgatgctgtccgcttgtttttagagaaggaatgtgagcgctttagtttacgctcatcacaaggaggtttttattcatgaaatttctggtcgatatgcttagccagccttccatcattgccggaatagttgtttgcgtagggctgattgcgctgcgtaagccttttaccgaagtaattggcggcacggtgcgggcatttatcgggtttgtcgtcatgttggctggcaccaacatcatcgttggcgctttgaataacttcgctaagctgttcaccaaggcctttaacatgcacggcatgattccaagtaacgaagctgctatcggtgtgaccgtcgcaaaatatggcacggttgccacctttatcttcgtcttcggacttgtgttgaatattgtgctggcccgcatcaccaagttcaaatatatttttctatcaagcgaccatgctttttacatggcgtgttgcttgacaccggtgatgcttttaggcggcttgaatacgcttgaagcgattgtctttggttccatgaccctcggcgtgatcctctgcgtcttcccggcaattgcccacccaacgatgaaaattatcacaggccgcgacgacatgagctttgcccacttcggcacgctggaatactggatgtctgctaaaatcggttcgctagtcaataaagataaaaagtcaaaatctattgaagatattaatttcccgaaatcattagcttttctgcaagatagtaacgtttcggtgaccatcgtcatgaccattctgttcttcgttgtgaccgcggtggccggtccggcttatgttggtaaattgactaacctgaatccatatgtttgggcgttgctgcaggccgcacaattcacagccgggatcatcgtattggtccaaggcgttaatatgttactggcagaaattaccccagccttcaaaggattcagtgaaaagattgtgccaagtgctgtacctggttatccattcgctattctgttcaaaggtacatctaatgccttgctcgcgggcttcctggtcagcctacttggcggtctgctttccatgggcgttcagattttgatcggaaccaccattgtcatcccagggatcgtcatgcacttcttctgcggtgggattgcagccatctttggcaatgccactggcggtcgaaaaggcgctttgattggaccatttctcggtggcatcatcttgagcttcctgccactgattgccaccagtctttacggtggtttgggctacaccacaacatattggtctgatagtgatttcaataccatcggcgttatcttgggactcattgccaaagtcggcaagtggccgattatgatcgcagcactaatcatctttgccttcccatttgtcttcagtgctttgcacaagaagaagttggttgattaatttactgggtctgatgagtggagtcagacaaaaaaagatgcaggcggctaatttgctgcttgcatcttttttatactcttggggttagcaagacttctgtggcgttcgctagctaacaagttcattcagcattgatcccttgatccgagtcaatcatgacgccctttgtttcgtcaaaaacgcagatattaccgtaattggctttgaagcccatgtgattgccgccatcaataaagtaacgcggcgattcgcctgggtattggataaccttgaccggacatttcggataacccccggtaaaagtcgtttcggcgatcggcggcttaacctgatcctcatattcgccataaatcagcgcggtcggcgtgtgacccgtaatcatggttttattaagcgggttatgcgcaaaaatcgggtgtttacgactttgggtttgcttcatatcatagatataaggttcacgtacccacatccggttaaacggcgttgtttcctttaacgggtctgccagcgaaaagtctaggccggcgtgaatgagcaaaagcttatcaaaagcaatggcggttggcatctccgcgataaatgagattaacggtgccatatgtgtgcgcaccgcttcacgaagactcattcctttgacagtcggcgcaaaatccttgaccatttggcgcaacgttgctttaccgccattgataaaccaaggattatctttatcagccaggtagtctaagagcatctgatcatggttgccccgcactgcgatcgcctgactatcctgaacctgttcatgaatctgagccaagacgcggccgccataagggtagccatctatgtagtcaccaagatagaccgtcagtacatgcgggtacttttcctgcatcaaacggactcgatccattgtctttaagttgccatgaatatccgaaacaacaatcatggtcatcgcaatcgcctcctcaacgtcttcctgcgtgagcgattatggtctgattaaaataaccgttacgtacagtttactttattttttgctgattgtgcgatattaataaatggttaggggtgaaaagatggataaacggctgattgtcatgcataatttgagccgacattatggcaaacagtactggtggcaacaaaattcgctggaagattggctgatgatgattttgattcaacggaccagttccaagaatgttgcgcaggctgtccataacttgcggccatatatgagtgttaagcaacttttggcattgtcgcaggccgaacttgaagaacttgtccggccagcgggcttttatcgacagaaggcgcaacgcattcatgatctgttagtgtggtttgtggcccaaggtggcagtttcaccgaaattgccaaaaaaccgaccgaacagctgcgaaaaaccttgctggcgttaaacggcatcggtaatgaaacggctgacgtgatgctaatgtacacgtttggcaagaagacatttgttgcggacacttatgcaatgcggctatttaatcggctggggtttggcccgtacacgaattacgctaaaatgcaggccgatttcgcaccgttgctggcggatatcaatctggatgacgcgcgcgaatggcatgcgctgatcgacgagcacgggaagacgcaagtgcggcatgcctatgacgaccactttttactccaaccgaatctaaccgaagatcagtggccaccggaagcgactcaggttgaaccgccgcacgatgatcctggcagtggtaagtggcgtcacgcagaagaatcatccaacgagtgaataggaggacgaatttcatgaatgcaagtattgcggtacaggttttgccaatgtatccggatcaaaagaaagtgctggaggttgtcgatgcggtgattgcctatattcaatcaaccggtgtcaattacgaggtcagtgcgtttgagacaaccatggaaggcgattacgatcagctaatggctattttgaagcagatccccgtggtcacggctaaagctggcggtacgtcccagatggtgtatgccaagattaattatttttccgaagatactggcttaacgattgccgataaggtcgataagttcaagcattaggcagccaagagtggccaagcagccatcaagctacctgtgagaaaagcgctaacggattcagccaatcactggtatccgttagcgccttttcgttagttactgaataatgtggcgattaggatcacgccaattaatgatcaagacgagtaccatcatcacgacgaccatcatgaaaacaccgtgcagacccgtgagaatcgcggcggctgcttgcggattgtgaactgaggtggttgatttggcgctgattgccgcattgacggttttgaaagaaagaccatgcaggttcgcccgaatcaccaaagtcagcacggccccatacacgccagtcattaccgtctgccccagcgagcgccctagcgtcaaaatactggtagccgacccgacatagcgatccggcacaagatgttggctaagaacagtgttcatgctgatgacaatccccatcaccgttccattaaccatggcaatcacgtaaaaagcccataccggaaaattcggcgaagcaaccgtgagcagtaaataggcgcatgtcagaatgaagacgagcattaacgacaaggttcgcggtacaaatcttttaatcaagggaccgactagaaaagatgatgccagccataaaacggaactagacgtcaccaccagcccggctgcagttgcgcctaaatggtacaacgattgtaaccaaatcgggaagtaaacctgataaccaattaagaccccactaagcaataatgccgtcaaaatctgtacggtaaaagtaaagctctgaaacatttgcggtgcgattaacggatcggttgcccgttgttcttgccggaatagaaggtacccacccacacatgccaggactaacaaaagtgccgccagccagggctgttgatcaagcgcctgaatacctaacagcagggcaattaatgtaaccgctagccaagcaatgcccagccaatcaatcgttaatgacacatgcttgcggctgggttcacggtacccgacctgaatgaggaagaagaccagcatacctaatggcacgttcacgaagaaaacccagtgccatgacaactgatcgaccaaaaagcccccaataagcggtccaaccaaagcagacagaccccatgctgtattattaagcgccatcacgttcgcacggtgagcgaaatcatagtagtcggcaatgatggtaaacgtcagcggcatcaccgccccagcgccaatcccctgcaaagcacgggctaaaataagcaataaaatatgcggtgccaagccgctcagcaaggtgccgactgtgaacagcacaacgccccactggaaaatcccccggcggccgatcgcatctgccaattttccgtaaatcggcgtggtaatggctgtcgtcagcaggtaagcgctcatgatccagctttgataagccagcccatgcaagtcactaataattgcaggtaaagcagttgtcacaatcgtcacttcaaccgaagtcataaacgttgcaataaaaaccgctgccatcaccaggccgcggccttgaggtttcgttgttgtcgccatgtttgcatccccttagtacttacattgtaccaatcggggtcaagacttttagtattagataacggaggaaggggggatgtcgtgcacattgcttcgattgtgcaactactataaaaagaccgcccgccattttctagcgaacggtcgtcttaactttttacaatgcgggacgtcgtggatgacgtggcatgtgacgatccaccacgatcgcacttgccattaaaatgataattacggcggctgccagaatctgatcaaataggatcaaactaagcgcgccaaccaaggcgaagaacagcagcagccaatcaatttgtgatagtgacaaaacaatcgcccccctaggaattagccttaaaagtctgtccaatcatccttgtcaccggcgtctttgtcgggtgagacgtagacaacaagctcgtcactgaaacgcttcaagcagtaagctgccgcaccgactgccgcgatggccacaaaagttttcaaaaaatggtttttcataggcttcctccttcgcgtgcctccagatcgtcaaaccttgaatccaactttattttaccatcactttgcgttgaaacgcgttcaccagcccagaaacctgcgtgtaaggaccttggtcgcaatggcctaagcccgggccatcacgcccaaggccacttacactccggtttctaaccgggctgattcacgctctccataaacgcgttcactggcgcagaagtctgcgtataaggaccttaggcgcaatggccaaaaccgggccatcacgcctaaggccacttatactccgacttctaagcgcgccagttcacgctcttgtttaaaacgcatcattatcgagaagcagcttgccagattggcgttcataaaattaaccaaattaagattaaggcaatttaagcgaatttaagtcaaaataagtgctttttcgtcaatctgtgttatactgaactcattaaaaccgaaagtaggtatgagcatggatacaaaagttaagactgttgattactcatccaaggaatacttcgaccgaatgacagaatactggcaagccgctaattacgtgtcggttggccagctttatttgaaggacaatccgttgctggaacggccactgaaaagtgaagatgtgaagccgcatccgatcggtcactggggcacgattgccggtcaaaacttcatttacacccatttgaaccgggtcattaataagtacgacctcaatatgttctacattgagggcccgggtcatggtggtcaggtcatggtttccaattcttatctggacgggtcatactcggaaatttatccacggatttcgcaggataaagaaggcatgaagcgtatgtttacgcaattctcatggccaggtggtgtggcgtcacacgccagcgcccagacgccgggttcgattcatgaaggcggggagttaggctatgcgttgagtcacgcaaccggtgcggttctagataatcctgatgtcattgcggcggttgtgaccggcgatggcgaaacggaaaccggcccattggcagcttcatggtttagcaataccttcatcaatccgattagcgatggcgcgattttgccaatcgttcatatgaacgggttcaagatttctaacccaacgatcctctcccggaagtcggatgaagatctgaccaagtactttgaaggcatgggctggaagccgtactttgttgaaggcgacgatccgaccaagctgaatccggaaatggccaaggtcatggatgatgcgattgaaacgattaaggcaattcaaaagcacgcccgtgaaaccggcgacaccactatgccacattggccagtgattattttccgctcaccaaaaggctggaccggtcctaagagttggaatggcgaaccgattgaaggctcattccgtgcgcaccagattccgattccggttgatgccgaagacatggagcatgcagattctttggcaggctggctgaagtcctatcatccggacaaactgtttgacgaaaatggcaagttgattccggaattggctgccttgccgccaaagggtgaccaacggatggccgccaacccgattaccaatggcggcattgatccaaagccattggttctgccggattatcgcaagtatgcgctggacaacaaggagcatggcaagcagatcaagcaggacatgattgtctggtccgattatctgcgtgatttgattaaattgaatccgcataatttccgtatttttggccctgatgaaaccatgagtaaccggctttacagcttgtttgaagtgaccaaccgccaatggctggaaccaatcaaggaaccggctgaccaatacctggcaccggctggtcggatcattgattcacagctgtccgaacatcagtcagaaggcttcaatgaaggctacacgctgaccggccgtcatggtttgttcaccagttacgaagccttcttgcgggttgtcgattccatgctcacccagcacttcaagtggattcgcaaggcccatgaagaaccatggcacaaggcttacccgagtctgaatgtggtctcaacttcgacctcattccagcaagatcacaacggttacacccatcaggatccaggcattttgacccacatggcggaaaagaagcctgaatatatccgcgaatatctgccagcggatgcgaatagcttgttggcgatctcaccaaaactgtttggctcacaaaacacggtcaatgtgctgattacttccaagcagccacggccacagttctacagtattgatgaagcaaccgttttggccaatgccgggcttaaacgcatcgattgggcttccaatgacgacggcgttgaaccggatgtggtgatggctgcagcgggtaccgagccgaacatggaaagcttggcagcgatcaacttgttgcatgatgccttcccggatttgaaaattcgcttcattaatgttttggatcttctgaagttgcgtagtccggaaatcgatccgcgtggtttaagtgatgccgaattcaacagctacttcaccaccgacaagccgattctctttgcttatcatggctttgaaggcttgattcgcgatatcttcttcacccgccagaatcgcaatgtgctgattcatggttatcgtgaggaaggcgacatcacgacaccatttgacatgcgggttctgaacgaacttgaccgcttccacttagccaaggatgtcattcagcacgtgccggcatatgctgaaaaggctgcagctttcattcagaagatggatgacacgttgcaataccaccatgacttcatccgtgcaaacggggaagatatccctgaagtgcaggaatggacttggaagccgattaagtaatcaggtctaagtgttgtttgacgttaacagatgaacatgacgaaaatcgatctccgcaactggaggtcgatttttttcgttgagatatacgtgaaaattacgccattttgaaaaccaagacgttggcgttaatccgacaaaaaaatgtaatcgcatacaattccgctgcatcagcatttatgcgactatgccagctacgagttgacgcgataagtgacaaaaccgtgaaacaaatggcaagaagttgtgtaatatctgtaaaaaatcactttactttctctgaaatctaatatactcttaatgcaatgtcattttgagggtgagtaaatgaaagttaaacgattagttgcaggagccatgatctttgcttcaaccgttcttttggctgcgtgtggcagcaagagtagcagctcagacacttttaatcgaatggagaaagatgtcatctccacgatggacaatgcccatattacggacgttgtcagtgggcaggcggcagtcgataccggcgatggtttgtaccggtacaagggtaagaaacttcaggccgcggtcgcaaccaaagtggtgaagccgactaacaatggtttgacgtatacatttaatttacgtaaaaccaagtggagtaacggcgatcccgtgacagccaaggactttgtatttgcttggcggcgcgcgaccgatcctaagaccaagtcagaatatgcttatctgttctcaggcattaagaacgctgacgacatcacggccggcaaaaaggcaccttcaacactgggcgtcaaagctgaaggcaattacaaacttgtcgtgaccttggatcatccagtgccttacttcagtacgatgatggtcaacccagtcttcttcccgttgaaccaaaagacagttgaaaagtatggcaagaagttcggaacacaaagtaagtaccttgtctttaacggaccatttaagttgactaactggaatggtaccggtaattcatgggatgaagtgaagaacgattcatactggaatgccaagcaggttaagttaaagaagattcacgttcaggtggttaaggattccaacacagccgctaacctgtactcaaccaagaagcttgacgatgctgttctaaccggtgaaattgccaagcagcataaaaatgacaaggattacgtcggtgacaagcagggtcgtaccacatacttggatatgaacgaagacaaggttcctgatttcaagaacacgaaactgcgtcaggcggtttccatggcgattaaccggaaagagcttgctgataaggttatcggcgatggctcattcggtatcccaaccatcacaccggaaaactcaggcagcaaccctaagactggcgaagactttgccaaggatgcggccaaagaatccgaaaccgttcagaagtatgacctcaaacaggccaagaagctatgggctgaaggcttgaaagaagtcggtaaaaccggcgaacaagttacgctgacaacagacgacacggatgttgccaagaagaccggcgaatatctgcaatcagctttggaacaattgccaggtatgaaggtatcgatttcttccgtaccatttaagacccggatccaacggtcattggatggcagcgcacagttcatcctttccggctggcaaggtgacttcccggatccaatttccttcctggatctctattcaacaggcaacacctataacttcagccactggtcaaacaaggaatacgatgatctgctcaaggcttccaagaacgccgatgccaacaatgagaccaagcgctatgatgatctcctgaaggcacaggttctgctctccaaggaagcaccagtcgcaaccctgtatcaaaccgttcaaggacatttacgcaatccgaaactgaaaggcgaaaccttcagcccggccaacatgtataactttgttggggcgtatatggcgaagtagtttcaacatttttgatcaaaacgttcccgtttgtggttaatagccgtgaacaggaacgttttgtttgtgtttgttgcgttgatggtcatagaggagggcgatgttttggttcaagaaaaggatgatcttcgatttcaactaaacccccatgccaagtttgatgtccgggctgcggttttattaattcacgacgatcaggttttggtgacggttgaagcgacgagcggttctgcaattgtccccggtggtgccgtgaaatttggcgagacagttgcagaggctgctggtcgcgaagtttatgaggagctgcggctgaaagatatgcaaccgtctctggtgggcgtacttgaatcattttgggaacaaccggagcaaacttatcagcagttaatactggtgcatcgacttgaattgtcgtcagcgcaggctgaagccgtcgtttggcaagaaggcttgcagggtcaatggctgtcattttcagaggcgtctcggcgaatgcggccgcatgctttggctgaatttatgcggcctagtgagacgtttttgcatcttgttgatcatcacaaatagtgacacagtgtcacctcccttatggcacaagcttcaccggccagctttacaagcagcatcaattataaaatgtctaattagaggtgcttactttgcctttacctgctaaccttgatacgctaaaggtaggctacaggccggaagggagttgcattttgatggatataacgactagaccgacgttgcagcagtttttagcagacacgaagcaaggcccttatgtatcactgtatctatcttggccggacaatacaccagttgaggaattacggattcggtttaagaatatgatgaagcatgccaaagcggtgatgggcgaaacctatccgaagacggatttcgcgccatacgctgctaagcttgaaccgtacgaacaggatccgatgttttggcagacgtgcgagacgaatggtattggtgtgctgacaaacggcacgcaaacgtatgttaccccaatgtatgaaaccgttgatgatgtggcgatggtcaccgagttgccgcagattctgccgttgatgctggatgaggcgaccgcaacggatttcgatattctggcgcttaatgccgacagcatcaagctttaccataaccacggccatcaggtgcggccggtgtccttgccggatgacgcgccccagacgttgacaggaacgctgggcaccgaaattcgtggcggtgagttaaacagtgtgcctcaaggtagcggccatgtaacgtaccacggccacaatgacaagtccgccgaaaaggccagcgatcaacgccgcttttatcaggcagtcgatcagtatttgctcgcgcattatagcaatccgaataaaatgccgcttgtcctgatgggcttagccgaaaatgtggcggtttttcgggagatttccaagaatcatcatttattgccaaagcttgcggtgatgaaaagcccggcaacgcttgattttgtcgaattggatgatctactggcaccgatccgcgaaacattacgcgatcggcgccgtcagcgctttgcggcgaccatcgaaaaagcccgcagcaatgacagctacactgaagagctgacaaccattgtcacggcagcattgcgtggtcaacttgctatgctgtttgttcaggcgggcgctcgaattcatgcccgacttgatggtgaacgaatcgagcgtgagtccaaagttgctcagcatgccaacttgttaaacacattggcagatatcgtgttaggccatggcggtcaggtcgtggtattgccagaggaacaactaccggctaaggtcggggcaatgatgcgttacgcttgagtttgtttcgggaaagattaggcgtaccactaagcaaaaagacagacgctcatatttccaaaattatttggaaatttaagcgtctgttttatggttcatttagtgagtctaagtcaaagtggaagagccagaagcattgggtttactgtatggatcaagtgccgatggggataaaaacggaggaaccaatattctggttaaaggatcaattcctgtatactgcatgataattgcctcctatgctaattcaagagtgccagtcaattgtgcttttgttttaggggtgaggtgatgcgtgatcatgatcaccgtgagatctttttcggctaataaggcatcttcaatggcttgggcactttcgtcgtcaataccagccgtgacttcatcgacaatcaagattggtttcctgaatgataaagcgcgtgctagtgctaatttttgccgttgcccaccagacaagttactgccgtgttcgtgaatattcgtactcaaactggtgaatgtattgatgccaagaaactccacgattttattgagtgcatttgaagcgctaggttttcccaatgttatattttcttgcacactttcattgaaaatatatgatttttgatcgacaagttcgattttggcattcagcattgatgctggaagtgagtttaattctagatcatcaacgtgaatagaaccgctgtaattagtaagtcggccactcatcaggttgataagtgttgattttccagttccgctttttccgagaatggcatacttaccacctttctcgaagcgataagagatatccttgatgacaggcttttcgccataattaaaagaaagatggtcaaccgtaagtgcgtttttaaatgaatcatcttcagaagagagcgcgggttcttttgaggaggtatctttgtgaagcaatactgtaacggatttcatctggaagataccttgaatcatacctgcgagattgttgaagacagtgcctgccaacgaaccactagaagagatgacgccgactgtaaaataaccgccgacaactaacaagcaagtcagtgccaaaacgagcatttgtgctgttacattgacaccgctgatcaacaaattaaccaagccgacatttttggtgtaaagaactttctcttttccctgctgatcggaagcaacagccagcttatgtgtaaaggcgttgccaagattgtggctgaaaaacacggagaatccgccaataatgtcatccgcttttcctagaaaagaactgttggccgttgcaagccgattagtctctctggtcataattttagagaagaactgggggatggtcattgtgagaagtcccaaaataatagcggccagtgccaaactgtaatgatagaaagctaacgacgtaatggcaaacagcagcgttgtaacattacctaatagcgagaagaacgcatctaaaccattttgttcgatcatattgacgtcatttgttagccatgagacgtattcattatgattgactttcttgtattcgggaatcgatacagtgctgagcccgtctgcaatgtcagtacgcaactgatttgttaccttacggataatttgtgccttcaatactgaattcacgtagccgatggttagggtgacgccccagatggtaatggtcgacagtagccaaaagacgacaccgttaaagtttttgttgatgagctgatcggtcaagggcgcaagggttagtgagctggccacttttccaagcgactcgattagaatcagtagggttgttaataacgtcaacgccttttgtcgcgatagtaaactgatagttggtttcatggtgatcgcctcatattaatttgatggccctagtatatgtggtaatatgatgccaacaaaaaacgtttcagatatgaaaaagcaggggagcatcatggaaaagattggcgaagttattcatatttttcgtgagaacaagggaatgagccaggcggagcttagtgacgggattctttcgaaggcgcagttatctaagtttgaaaggaatttaacccaaatttccgctgataagcttctggcactccttgaacgcctacatgtcacatttgctgaatttggtaatgccttagctattcaggaaaacctgtatgagcagtcgatattggaagacattaccaaggcaattgtcaataacaacgggggccaagctgcactggtagaagacagggctgaagcgcatttcaagaatcatccaggaaagtataatcggctcattttgattatggttaaagccatgattgccgatatgaatggtgagtcgctttcaaaaaccgatgccagtttcttagcagattatctgtttaatgttgatggctggacccgatttgaactgttacttttcgggaatacgttgtcagttatgccgttagtaaccgttaaccagctggcacgggaattagcttctcaacttaatgaggctttggaaatacaccaaaatctgcaacttaatataagtcttctatacaatgttgtacttttaaacttagcggctaaggatttaaaaactgcccggctttttctacgcgtgatgaagaacagtcatattgaggataacatgatggctgaacgatttttgatcgcactcgcagaagcactttgcacgtactgtgaaaatccgtcatccgaaaataaagagcgtgtcgagaagatcgtggagattcagaaaacccttggatcaacaagtttttttgttgcattcaagaaacaggcagaaatgttcataaatgaaacgacaccttaaatggcacaacggttgataaaaatttaagtcgttttaaaagcgtactgcttcgatcagactttcaacttctagacatgccgactcacgaatactacaaaggctcagacatccaatgcggaatgcctgagccttttagattatttgtagaaacttttaactgcgatcacgaaccagccccagcaaaaatcgccttcacaatctgctccgcggttttcaaactcacatcattaacaagtgggcgtgggctggcggtggtgagccagtggacgccttccgttgggacaccccagaagaagaggccggcttgcggctgttcattggcatcgagcaattgctgggtccgcctgtcgatggcgatcgcgcctgactggaaacgtttgtcggcattgagttgcaactcatacggatgcgcgtagccgtcatgcagcagttgttgaacgagcggatcttgcgcagtcggagcattgacggccggaacacgcgcttcgagtaaggccttggcttgcaaggagaattttggatcgcttggtgttttcaaaagaaactgaccgtcgatgcccttaatttgcatgcctggcggtaagattgtgacgatacctgcaccgattaaggcctgcagttgatcaatgcgcagagccggtggtccgatcgacagaaaatcgttcagtgagttgaaccagcgcaagaagaagtcgagatactggtcctgactaaagaggccgcgttcgacaaattggcgaatgggatcgcgcatgtcgcgtaagacctccagtgcactggtcaacgggccggttttcgtgccgcgcatcgcctcgcgggcatcttgccggagataatgccgcatgaagtcttgataaggctggccactgggatgggctttggtcggatcagcgagcacatcccaatcgaggcgatctttggcggcgatcggtaaggcgcctaaagtcgcaaccggatccgcgagaaaatcacgttcaaacgctgtctcgtcaatgtcagggtagcgttgcggcaaaaggagacgatagtaaatcaactcagcttcatgctttaacccttcccagaaagtctggccgctcacttcaccgcgggcctgccaggcattgatttgctcaggcgtcagaaattgcggctgccattcttcgcctggacctttttgattgtggcctttagcacgatatggaaaaccgcgccgcgagccagcgaagatgtgcggttcgcgaccgcttgggtgataggcgagcaaaccatctgcggttttctgaaaccgtccaccgcgaccttccgttagccggctcattaagtcaaagaagctcaagccgagaccccgaacgatgaccggagcttgcggttcgatgttgctgaggtcgccttcttccggaaagcccggttccaaataaaatagtttgtgcgttttggcatagtcgtgtaaggctttttgatcgcgcgtcaatgagttttttaaatttcccagcgccatgacaacttggtcggtttgccagctttcctggtcggttgtgatggtgaatccgggatctttttgatctaagcgggttactgtttgttgtttgtaggtgatcgtattttggccggcttgtgcgcgtagcaagtcgaagaaccactgctgatacacgccgtaaagcgcgcgggacgcgtagctgttgagtccaagactggcagcttggcgtaacaaaattgcccgattatccagttcagggtgggcatccagatagcctgccgcgatcgtcagtgcccaagtgctcagatcgggtccggtgataaatggcccgacgtcagtgacgctctgatccgtaaataaggtaatttgcgaagccgcagtgttcataattaaattaggatcttgattgattttccatacccggccgccgattggataagggtcgaccagtacgatgttaagccggcgcttagggtagcgggtcggttgccaactcagcagccgacttaaaagcagcaagccacgcgggccggcaccgataagtgtgatgtgcatattaaactccttttatgaattgaccaattaagaagcaacaaagctattatacttgtaagcgtctcaaagccgttagcgacttgctttaggtttcgcccttttcgtgtcataatgtttgtattgataatctagaagggaaggcagatgctgatgaaagttgtcgttgtgggctgtacgcatgcaggaactgcggcagtgcgcgaacttttaacaagacacccggaaacggaagtggatgtttttgaacgtcgcgaggacatctcctttctttcttgtggcattgccttgtacctcgaaggaacggtcgggcggctggaagatatgttctatgctaccccggcttcgcttgaagcacttggccccaaggtgcacgttcatttgaagcacgatgttttatcgattgatgcagttgatcatcaggtcgtggctgaggatttggcgaccggccagcagcaacattatcagtatgacaagctcattatgaccacgggcagttacccggtgatcccaccgatttccggtgtcagtattccgcgcgtcttgatgtgcaaaagttatgatgatgcgcgcaagattaaagagagcgccaaagatgccgataaaattgccattgttggcggtgggtatatcggcgttgaattggccgaggcctatagccgcaaccacaaacaggtcattttgataaatggcgtgtcgccgttgttgagccactatgttgacttgccactcagtaaggaaattgcttcggtgttgacgaaacgcggcgttgaactcaagaccaacacgattgccagacattttgacagtgatgaaaagcatgtcttcattcagacggatcaaggagagattcaggccgatttggcggtggtctgcgtcggttttcgtccgatgaccgaattgctggtcggacaggttgagatgaatccggatggtgcgattcatgtgaatgattatatgcaaaccagcaatccggatatttacgctgccggtgatgcggttgccgttcattttaacccgactggtaaagatgcttatgcgccgttggcaacgaatgccgttcgccaagggaaaatggccggtgccaatatttttggcccgaatatcaaatatatgggaacacaggcgaccagtgcgttaaaattgtatgatcatagtctggcggttaccggactcacacttgcccacgccaagcgcaatcatctgccggcagccagtgtgaccatgacggatgattttcgaccgccattcatgccgcatacggtcaagattacgatggtgctggtttacgatactcgtgaccgccggattctaggggcgcagttttatagtcaatatgacattgccaatgcggcgaatctgatttcggtcatgattcagaaccgcaatacgattgatcagctggcctatgtcgatatgttgtttaatccgaattatgataaaccatggcattatctcaatttattaggccagttagcagtgatgcaggcagataacgcaaagttgtagggggaaaattatgaacgcgtggaatcttatcggactgtcagcgtgggtgatcttaattgcctacttcatcttcatcgtctggcacattcgccggcgacatattaaagcgatcgtcaaatccggtcgccaagtgccggcttcggtggtgctggttgatcttgcggaagtagccgtgctattcctggcgacggccgggttggtatgggcaagctggttgcggcctatcgattaccgcgacagtcacgccgtcaccatcagccatagcgcgcaaccgctgatcttacaaacaggcgacgagcattccttctacgttcgtgtccacaccggtaacggtaaaaatccgatcctctactacacttactggacggaaggcgcgaagtatgaaaacaatagtcataacgcggaggtcagttcaggtgcccaacccttaacgccgcgagctgccgcctatccgtggtcgaaaaagtatctgaaacgacttgatcaaaccgcggaccaagcctatgttgcaactgtaacggcacgctaccagccgggtttcctgaacggtctgggcatgcacgtaggccatattgctgaccggttctcgattctgcgggttcccaatgatacgtttgttgagattgatccggtcgaggattaagtcgaacagaaacaatctgatcgtttgatgcaaaatgttgcgtcaggcgatttttttgtgagtgcgagccagcccggttaaaaacagagtgtaggtttcaaggcccttacatgcaggtttctgggctggcgagcgcgttatggccttttaaattgaactgactaaaaattcagcaaaacctgatgcttaagtgaatggctcggtattcagcacatggtatgatgaaatcattcacaacccgattaaatgaaggaggcgaggggatgcatcggcacagctggtggttggtacccctattgttattgctgggaatctgcgttgctacactgcaaccggttcaggcgagttcaggaaaatggtatcgcgatcaaggggcgatgatggggcctgagagtcgccgggttttaaaccagctaaatgaccaaacgtttgccaaggttaaagggcatccgcaaatagcggtcataacagtggcatcgctggatgatgatgacatcgaagattatgccaatgaccagtttgcgaaggccggcgtcggcaaaaaggactgggaaaacgggctcctgctggttctgtctcgaaatgaccacaagtattggttggaagtcgggtatggtctagagggcgtcgtaccagatggcagcgccgacgagattgtgacggacagcgttaaaaaccagctcaaggccgaaaattacgatcgtgccattgcgatgtttttgacgaatatcgggaagcgcgtcgttgctcatcaaagtgcgattacaacgccaactcaaattaaggaaaaacgcgcgcgtgctgcggcaatcaagcaggcactgatgattgccgcactgattttgggcggattaatggttcttttctttttggcgcatgctgccatgaatgcgcggttgcatgacgcgatgagcgaccccggggcgatggcagctttgccgatttatgctgcggtgacagctgctggcattaagttgcgggtagattcagcttccttgccgttatttcactttgcttgggcgcatgaccaattacgcgtgatcggaatggctgggctagcgcgacgaaggtttgaatcctggacgcaggagattcggttcacgacgccacatccatattggtactatcacaatcttcaaggggcactccgggaactctcagatcaagaaatcgtcaacgtgcccacgataacggcactggctgatttgctgacgccggccttaacggagcgattggcaacaggcaagccgtacgaaacggcatatgcgacatggctcagcgggcaaaaaagcatctccagtcaggaagccgccacaacatggacgaagtttcttgaaaacgtgaaagcaacggatcatttttcggataaaactttggcagcaacgttttcggccattcttttccatattcgtcatccagacaaggatcagcacttagatcaagatgacttaccgctgtgggtgatgtctgattttggctctggatccagcagtagtggcggaagtggcggatccgacagttttggcagtggttttggtggcggatccagtggcggcggtggttttggcggcagctggtgactgatgaatctgcgaagtgtggcgacccgctttttgaaaatagcttgaaaatcacatatcacgtgggctaacattagaaaatacaaacaaaatggtgtgcggttttaactgtcattatttaacgcatgaaaacggggctagataaatggagcaaatactattgttaatgggcaccggtttgcttggcggcattctgggtgcggtgcttggcattggcggcgggatgattattacgccgattctgacgatgctaatgggtttgccgattcaatatgcgatcggtgccagcatcgtctccgtcattgccacgagttcaggtgcgaccattgcgtatctcaaagatgaaatgctgaacttgcgcgtggcgatgtttttggaaattgccacgacggtcggcgcggttttgggcgcgattgttaccgggcttgtggacggcaaagtgctgtacattttgttcggcgcgttgttgattttttcagcgttcaatatgattcgcaaaatgcggatgaaagaagacgaagcgcgccagacgacaccagatgagattgcgaccaagttgcgcttgaacggggcttattttgacaaggccaccggtaaagaagtcaattatacggtgaccaacgtgccaggcggctttgcgatgatgtttggcgccggtattgcctccggtctgttagggatcggcagcggcgcgtttaaggtgatcgcgatggatacgatcatgcacatgccgttgaagccttccagtgcgaccagcaacctcatgatgggggtcaccgcggcggccagtgcaacggtgtattattttggcgggcaattgcagccgcaaattgctgcaccactggccatcgggatcctcattggcgcgacagtcggttcccgcgtgatgcagattctgccgaccaaggttttgcgcatgatcttcattccggttattggctatatgggcattcaaatggcgcttaaaggatttggggtgtcaatctgatggacaataaacttaaaaccgaaattgatgatgtcgaaattatgatcggcaaggtcatgcaagttggcgtcattttgtcggcggtggtcattgttttggggctgattttgcttattgcgaccgggtcgaccgggtatccggcaggcgttcacccgacgcgggttggcgctattttgagtggaaccttcgccttaaaaccatacgccgtgttaatgacaggcatttttttgctgattttgacccccgttttgcgggtggtagtttcaatttatgcgtttgccgtggaacatgaccacctgtatgtatggattacgactgccgtgctgattatcttaatcggtgcgatgacgattgggtatttgggcaatcgttaagtcggttccgatataacgcgctcaccataacgcgttcgccagcccagaaacctgcgtgtaaggaccccagacacaatggccaagaccgggccatcacgcctgaggccgcttacactccggtttctaaccgggctggctcacgctcacataaaaaagaggaattcccgatcacagatagttttctgtgattcggagttcctctttttgcgttaccaaaccgccatggcgccgtctgttcgcgattcggacccgccaacataagtttgggtttcaggattgcgccagatgacctgcccgcggccaaaaacgttgggttcagactgaacgacaatatgatgtccggcggcaacaagtcgatttaccgtcacagctggcacttcacgttcgacttggacagtttgatcgtgcatccattgccagcgcggggcatctaacgcggcttgcgggtcaaggccaaagtcgatagtgttcattaaaacctgcaggtgcccttgtggctgcatgaaaccacccatcacgccaaaaggtccgatcggggtcccgtttttggttaaaaagcccgggatgatggtgttgatcgggcgtttaccaccttcaaggacattgggtgacgcgggatcgaaggaaaagttgttgccacggttgttcaaggcaatgcccgtgcccggaaccacgacacctgagccgaagcccatgtagttactttgaatcatggacaccatattgccatcccgatcggcagttgccagataaacggtcccgccactttgcgggtcaccagcttcaggcggtcgggccgattcaccaatcagtgcgctgcggctagcgagatagtccggtgcaagcaactgattcggatcaagctgcatggcccgcggatccccagcaaacttaaagaagtcggcaaaggctaacttaatcgcttcaatctggtggtggacggtgtcaaatgaatcccggttggtaaaatgccgaccctgcaataatcctaatgcttctaacgccaccacaccttgactgttagggggcagttccaacacgtcatagccatgatagtggagctttagcggcgtcacccaagccggctgatacgctgctaaatctttggccgttaaataaccgccattctgtgacgcagccgtagcgattttttgggccaaggttccttcatagaaatcgcgcgcctgtgtttggccaattcgtgttagggtatcggcctggtccgcagattgccaaacttcaccagtttgcggcgcatggccatttggacaaaaggttttgaaccattcgtcaaaaatcgccggattagctgcctttttttgggcttggcgataattttgcgcggcgcgttcccaaaaataagcgatggtctgagatacgggatagccatcttgcgcataagcgatggctggcgctaagtccttagctaaggaaagctggccaaaacgttcaaccatcgctgcccaagtcgcaggtgcaccgggaacatcaatggaggtccagccaaacttgggcatttccgttaaaccagcagcttgaagatctgcaactttgagattttgcggcgccggaccgctaccattgatcccatattgctgaccgttaatgctgataatcgcaaacgcatcactgccaatgccgttggtggtgggctcgacaacggtcagacaggcagcggtcgccacggctgcatcaaccgcgttaccgccttgttgcaaaatccgcaacccagcttgagcagctaacggctggctagtacccactatgccgtacttagcatagactgacttgcgcgaacgtgggtaaggattgttagggttcgtgaaaaaggacatcgaatcgcctcgtttgtgtcgaatatgtaatgtgagatataggtcacagaatatcacaatctaaatctaatgttaaatgcttgttataccagcgatataggcgtgtcaagtcacgggtcactttttaacattttttgttttggttattgacattaagacaatctaattctaacattcaattttaataaagctattattatttttatgcgaggaggcaagcgcatgggtcacttcattttgaaacggatgctgcaacttgtactgttattaattggggtatcgttcattgttttcttcagcatgcacctagcgcccggcgatccggcgcgaatcatggccggaccggcggcaaccaaaagcgatatcgctgcgttacataggagcttggggttagacaagccgattgtggtgcaatatcttgactggattggcaaagtcttgcacggcaatctcggcacgtcatatcaaacatcccagccggtaacccaagccattctcagtcgcctcccaacaacgattaaattagcaacagccagcatggttctggcattgataatcggcattccactggggattgttgccgccattaagcacaatacctggattgattttactagcacgacattatcactgctcggagtgtccattcctaatttttggttaggaacgatgctgattttgattttcgccgtgatgttgcacgcattgccaattggcggcatgtcgatgcattggtatacggtcgctggtctaaaagaattaatattaccagcgattgcgctgagtgcaggctcggctgccttaatcgcacgcacgacacgagctaccatgcttgaagtgctgcagcaagattatgtgcggacagcaaaagcagcaggtttgcggccttggaaaatcatcttaacccacgaatttcgtaacgccttgattccgattattaccgttatcggtatcaactttggcacgttattaggtggaacgattgtgactgaacaagtctttaccatcaacggtgtcggccgattgatgatcaatgccatctcagctcgagatttcccggtcgtacaagggaccgtattgttcattgctacaatattcgttctggtcaatctagtcgtcgatattatctacgccaaggttgatccgagaattagctattgaactaggacctagggcgacgcgttcagaagctggggagtcaatactttaggacattttaagagcgaccttattgcaaacttccggctttgaatgcaacgaattagcaaacaggcaagggaggtagaacatggaacgaaatatctcagctgcatcaagcaaagtagtcaccgcagcaagcgaaagtaaaatcaatgcgactgtaaaatccgaggtgcggtttttacgtgtcaaacgattactgcacaataaactcgctgtattcgggctaattgtcattacgttgatgattttagtagcaatctttgctcctgtgctggcgccagatagtccttacaaacaagatctgattaccggaaagaatcttggtatcggggcgccgggtcatttgctagggacagacaactatgggcgcgatcttttatcccgcgtgatttatggcgcacgtatttccttgggagttggtttttcggctgtagcgattggtctcagtattggtgttgtgcttggtttgatcgccggttattttcagtggctggatggcctcattatgcggtgcatggatgttcttttcgcattccccggaattttgttggcgttattgatcattgccattttggggactggtattgggaacattgttatcgccatcagcatctgggccatccccacttttgctcgtattgtccgtggcagtgttctagcagttaaaaacgaagaatatatcacagcactgaaatcggagggtgcccgcgcgccacgcattatctttaaacatattctgcctaattgcatggcaccgattattgtaaatgcaacgatgcgcctaggatcagctattttatcaaccgcagcactcagtttcattggtttgggagctcagccaccgtcacctgaatggggtgccatgattgctgaaggccagtcgattatgtgggatgcgccgcaagtggcagtggttcccgggattgcgattatgctagtgatcttttcgtttaatgtttttggtgacggcttgagagatgccttagatccaaacgctaaaattcgctaagtcgagatgatgagcgttaagttggagggaatgtgcatgacgaaaaaaacaagcaaatggcttttagtttctgtattgaccgctttattgacgacattgattgcatttgggactggtccaaccaacgtgacggcagcagctgggcgcacgttggtgtatggatcaacggctgatcctaaggggttatcaccgttgtccacggcagatacagtttcatcaaacgtcattcagcaagtctatgaaacactttttcgacaagatgccaagacgttaaaagctaaaccgtggttggcgaagtcttatgagcgtaaaagtgccactgactggattattcatttacgcacagggattaaatttcaagatggtacgccatttaatgctgccgcagtgaagtacacgtttgaccaaatgaaagatcctaaacgtgccgccccgcgcgcctcgttactcgagccgattgcgtcgacaactgtcgttaatgacagcactgttgaaattaagaccaaatatccgtatggtccatttttggcgatgctaagccatcccaatgcttcgattgttagtccaactgctgataaaaaggggaagctgaatacacatccggttggtactggaccattcaagtttaagagctggacaactggcgatagcgtcaagttagtacgcaatacagattattggggcaaaaagccaaagctggcaggcgtgacatttaaaactgttccggattatgccaccgcggtttcgatgttacaaactggcaaaattcagttactggacaatgtgacatcagattacttatcgcgaatcaagtcactgacaaatgtaaagctgacaaacaaagtcggaacgccaatgcgatattttggctttaatatgcagtctaatccaggtaagaataagaagttccgacaagctgctgcttatgcaattaacgccaaaacatatgtcgcccagttaaacggtttaggaacctataatcctagcctgattgggcctgagctatttggctataacaagaacgacaagaaagctgcgacaacctataacctgaaaaaggcgaaggaacttgttaaagcaaacggctttaacaagaaaacttataccattttagttggtaaccaacctgcttatgtgcaaatggcccaagtcgttcagcagcaactggcaaaagccggtatcaaagtcaaaattgaaaaacaagaatgggcaacttatctgacaacgctagcatcaggaaagtttgaggtgaccttctccggatgggcgaatagtacaggcgatgcaagcgaactgttttatcctaaccttgattcaaagaatattggcagttccaattacatgcggtacagcaacaaacaatttgacgccgaagttgagaaatcacgagagacgttaaatacttctgaacgtaaaaaggctttgagcgctgcgaataagatcgccatgaaagacttaccgtggatcgtaatggatcacaattccgttgcagttgcgcaagctaaggatctcaaaggcgtgactgtcttaccaacaggcatgtggtacttgggcggagcttacttcaattagtctaaagtccgttaagctgaatatgtctatcttagagaaaccagttggagggtgacagtcatgttggaaccagtcttagcagttcaaaacctgaatgttgattttgaaacagatcaaggtaccaaacaaattttacacgacatcagtttaaccgttcatccacatgagacggtctgcctcgttggtgaatccggttctgggaagagtgttacctcgttttcggtgatgggtcttctgccacaaaacggacacgttgccagtggttcgattcgttttgaaaagcaggatctgctgaaactaggcgacaaggccatgcgacgacttcgcggagatcaaatgtcaatgatttttcaagaaccaatgacggcgttaaacccggtgttacgcattggcaaacagctgacggatgtcattaaagcccaccaagcagtagatcgtaaaactgcttttgatcaggcgttggcattgttgaagcaagttgagatgcctgagcctgccaaaaaattgcaaatgtatccgcatgagttaagcggcggacaacgacaacgagtgatgattgccatggccattgcttgcaagccgcagttgttgattgctgatgagccgacaaccgccttagatgtcacgattcaggcacagattctcgaattgatcaataaattgaaagatcaagaagggatgggtgttcttttcattacccatgacatgggggtggtggcacaaattgctgactatgtggtcgtcatgaagcaagggcgaattgttgagcggggcactgcacaaacaatttttgagcatccgcaaaatgcctatactaaaaaattgcttgccgcggttcctgatgttgacgctccccacatcgcgcaacattcacaggtaaccgacaaacagccattgttagccgttcaacatctgacgaaagtgtatcaggataagaaacagctatttcgaaaacgtgctgctggactaaaagcggttaatgacgtcagctttcatatttatcccggtgaaactttaggattagtaggcgaatctggctcaggaaagtcaacgttgggcagaacaattttaggattggagcagaagactgctggcaagatggtttatgcaggcaaggaattgccaccattcaatcatcgtcaagccgcattaatcgccaagatgcaaatgatttttcaggatccgtttggctcactggatccacgtcaaaaaattggagatgcgattgaggaagtgatggctatccatcaccaaatgaatgcgcaagcacgccaccagcggatgttgcaacttttacaagcggttgaccttgatgaggccagtgcgaatcggtatccatccgaattttccggtggtcagcggcaacgaatcggtattgcccgggcattggcgcttgatccgagtttggttgtctgtgacgaagcggtatcagcattagatgtttcaattcaggcgcaggtgctagacttattaaagcagttacaagagaagctgaagctaacctatcttttcattacgcacgacttgggtgttgttcgggaaattagtgatcgcattttggttatgtacttaggcaccattgtcgaaactggaacaactgagcagatttttacgaacccagtgcatccctacacaaaacgtttactagcagcaatcccccggccaaatccagaatcagcggtcgcagcccgtcaacgaaatgagcggatcttggcagaacacattccgcggcccacaagcacagagctgcatgaggttgaaccactgcatttggtagttaatttttgagttatatggatatacaaaagccccgtcatcaaattcagcatttgatgacggggcttttcatgcggccaacttacttaccattcggtttgtgttccatgtaatccttcagcgtggcgacgacggaagaatccggcatctcacgcatagatttgatgttgtggatatgttccactgatacatggctgtttagcgccatctctgtgtctgttagatgatttttgcgctggaagtcgataatttcccgtgaaaatgcactgatttgagctttttcagccaaaacgattcctcctcgtgagcctttactaacagtataacgatttttgtcaaggtgcgcacgtatgacattcaatcgtaactttgtcatgattcattagcgaaaatgtcaggttataaagacgaaattcaggatgatattcgaaaaatagtcaggggatgaacttaaagattgcaagagcgaacaaatgtttgtataatgaagatgtactaaaagagagtgtcagaaccgccaacatcccgatggtaaaacagttgatttggcggcgtttggacaagattgccagtcgctcgatgttgtaagtattgccttgatttgaaaggtaaggtgagcttatggaacactatgcttacttgcaagacttagccgctagtcaaagtgaccgtgatttgcgtgtgcggatttgggacaataagaatatcatcattcggcgaaaccaaagccagcatcaaggcttggcaacccaagtttgggatgcctggttgcgtcaggaattgcggcgcttcaacggatttgagccgattatcgaagtggatgatttttcgggtcatcaggaaatcaagttttttaaagagaacgagcttgcggatgctgttcatttcatccttcaaggtgaaggaaccgttgaaacagccagttgaatgagttgcggagtcgcagtgtgagtgatactgcgactttttgagtggtcacagccaaacatcgcatctcatcagtcatgtaagcttttacaacctcgaagttatcagtatactgaacttaatgaggtgaggacgatgaaggcgatcattttatacgcatcaatcacaggcaatgccaaaggaatggcacggattgagcagcagttttttgaacattacggctgggatgtcacgcttggcgaaatgattcagacggatccaagtaagattaaagactatgacgtgttggttttggcgacatatacctggaccggcggcgtgattccggaagagacacaggatttctatgaggatttgagcaagatggacttttctgcgaagccgctggtttttggcgtgcttggcaccggcgatccttattacggcaaggattacaatacagctccggagttgtttgaagcggttttgagagcgagcggagcggttcagggcgcggagccggtcaaaattgcgttgaacgttaaacaggaagaaatgcctcaatttgcggcgtttactcagagtctgattaagaaagcagaagcgcttcaaagtgagaagtaacctgaggtagcgtggtatactggagtcacaaagagtttgctggcgcaggcgctggctcgcgctcacattaacgcgctccccagcgcagaagcctgcatgtaaggaccttggtcgcaatggcaaagtgcgccatcacgcccaaggccacttacactccggcttctaaccgcgctggctcgcgctcaccagaaagtgaggggatcttgatgagtgaggaaattgttttcttcaatcctggcgatgcagttgccaatgattatgactttgctgctgcccggcgcagtgcgcaaatttacaaggcccaacacgtcgttgacgagggattggttgttgcaaaagataaagatggcaagtactcggttttctatgaagccgctggcacacctgattcaaaggccaaaggtgactataagaatgtcggaaagtacacgatcctagctcacctatgactaagaacacttggtatcgtgttgcattggtggtgattgccattgttctcattgccgttatctattttttcatgcagcagcatcaaatcgcgaatccttttgtggttggcggtcttggcctaactttgggcgttgttcttgcgctgcttttagccagcttttggcagccacatgattcgcagaaacactagcttattgacaccatgatttttgtacaaaacaaaacgccaaacgacctgaagccgacatcgcggcaaacaaggttgcttggcgttttttgattggaacagtcgctgcttagccatttacaacgtattgcgggtgtttaccgtttaaaacagccagcgtattatcggtgacaattttggccatggcgtcacgtgcctcaacggttgcattaccgatgtgcggcgttagcacaacgttgtccagtgccttgagtcctgaactgacatgcggttcagcctcgtaaacatctagggcagcgccggccagacgatggtcggttagctgcttgagtagggcggattcatcaattaagggaccacgtgctgcgttaatgaggtaggcagtcgacttcatcgttgccagtgcctgagcgtcgagcaaatggtgtgtggctggcaccaaaggcaaatgaagggtgacgatgtcgctttgctgcaataaagtcgcccgatcggtaaacgttgctcccagtgcctgttcggcttcaggtgtcagttgatgatgttgcgtgtaaagaattttggcatcaaatgcatgtacgcgcttggcaacggcttgtccaatctgccccacgccgatgatgccgacggttttgccggcaagttcatggcctaagaagaacgtcggcgcccagccggaaaaaccgggaccgcgcattaaccgatcgccttctgtgacccgatgcaaaactgccagcatcaaggctagtgtcacctcggctgttgatgtggttgaaacttttggcgtgttcgtcacgagcacaccctgcgctttggcggcggtgacgtcgatgttattgaagccggccccgtagtttgcgataagtttcaaatggggcgcctttgctagtgttgctgccgtgactggcgttgaaagtgctgtaatgagaacttcggtgttagctaaatggctttggagctcctcttcggtaatgagtcccttaccgttgtacgcgtcaaaatccactccggctttttgcaatgccgcgttggcggatttaggcaaagctgctgaaacataaacctgtggcattaatatttgcctcccttaggtcaaaccgaacctacgacaaaatccattcattacttactcttagtgtaatacaggtcccgccaaatgaataagatcacgaccattttttccaagcgtcgctggcgggctggaacacctgaaaggttaaaaaagaagcaagaactgacgtgcacgatcaatttgtgttacactgacgttggtaacaaaaagtaagcaaaggggattgatcgttgatggcaactttgacgcaagacatgaaagacatgatcggtgcacagcttaactacttggcaaccgccgatgagaacggaaatccgcaagtcggcccaaaaggcacgatgcgagttttggatgatcatcacttgatttacaacgaagaaaccggtaaacaagcgtggcacaatttgcagtactccaaaaaggctgccgttgcctcagttgattacaaggctttgaagggctttcggtttgaaggcaccgttgaatttcataatgatgacaagatctttgaagatgcgcaggcatttgccaaggaacgtcacttgccagcagccatcagtgctgttgttatcaatgttgatcggatttacaagttggatgccggtccgaatgccggcgatttgatcgaaggctaatcgcgaaccgaatccgtaaatggcatttggataagttgatggtttttcgattaatccgttaatctttttaattaacggattcataaacccgtcgttgtgtaaaccgcataacggcgggttttcttgtgtcttcaattaaatactaattgttattattagcatatttattgcgaatgataagttcggttcgttaagcttaagatagtcagaaagttgttagtcataacgcgttccccggcgcaggagtctgcgtgtaaggaccttggtcgcaatggcctaagcccgggccatcacgcccaaggccacttacactccgactcctaaccgcgccggctcgcgctcaaaaagaaaggatgattaccatgatgcatttaatctggacactgattatcggtgctgtgatcggttgcattgggcagctcatcgttggtcgggacatgccgcttggttggctcgggaatattatcggcgggctgatcggtgcgtggcttggcacggctttactcggtaactgggggccgtcactggctggcatggcgttgattccggcaattatcggcgcagtcattgttgttttcctcgtttccttgctgttgggatcgacccggcgcaaggcgtaggaggccgtaaaagatgaaaccgataacgaaaggattatttggcctcgttgccgtttgcggattgctacagagtgtgggctttgggttgttgctttggcccaatcgcgaatttacccggttctatctgcagcaagccgtgtggttacggccgctcatgatcggtttaacgggattggtgctgttggtctttctgatcatgctgctggttgccattttccggcggtcaacggctaatgcattgattttggcaggggatgatggtgatttgacccttgataaaagtgccattgaaaacacggtggcaaaagcaatcgtggcccgccattttgccaagtcagtggacgtggacgtcagcattcggaagaagcaagtggctcgcatgcgcatcgcagccttttccggaaacggtaaagagctgaaacaggaagccaagcagattgaagaaactgcgcgccaaaagttgcaggaatgtctcggcgttcccgtcaagcatgtgcgggtgcagttgcttccggcaacgaaagtgaaggccaaaactgctcgggtcatttgatgtcgcggatggatgaaggctgattgccagtcaaaccgggtgcgcactcaagcaccgttggcagcagtgttcatcagctacgaaagggtgataacagcatgcagcaaggaacaatcggagctgtgattggcgtcattcttgcctttgcctggatgcgcttcgggtttatgggcatgatgcttgtcgtgatttttggcggattaggttggctcattgagcgctatctcgtccctaactggggcaacctcatgagctggctaacgtctggcaaagatgcatttagtaaaggaaagtaggtgagtcgatggatgcagtagcgtcgccaaaaaccgcaccggcaccaaaagcgaatcagcacgagacgctgatggccaatagtcgggtgacttttgaagataaggtcatcgagaaaattgccgccatttgtgcccagaatgtcgatggcattctggggatggacggctccgtgatggacaacctgacggagactttttctagcggcgagaacctgactaaagggatctcggcagaagtcggtgaaaagcaggttgcgatcgatatggatgttttcctggaattcgatagcaatgcccaggccattttcaagcaactgtgcggcaagatcagcgcgcaaatcgagcgcatgaccggtctgcagctagttgaattgaatatgcacgttaaagatgtattgacgaaacgcgaatggcaaaaacgttaagttacgaaacgacctcaaaaaaggagcgattaaaatggacaacaagaaacaaagcggcatcaataaggaattgaaattcgacgacgcggtgattgctaaaatcgtgggcatcacctgcaatgaagtcgaaggcgtatactcgcttgaaggcggcatgatggcgaacatcaccgacatgttcagcaaagatgaagatccgaccaaaggcgttaacgttgatttaagtgatgatcaggatgtttccgtctcacttgacgcaacggttcgctacggtgaaaacgtaccggaaattttcaacaaagtcaccatggcgattgccaaaaacgtccgccaaatgaccgggttgaatgtgactgaagttaaaatgacagtcaaggatatgctgacaagagaagaaattgcccgcaatgaggcaaaggataaagacaaggacaaagataaggaaatgcaaccggcctaagagcgtgaactggcgcgtttcaatacaaaagggataaccccagccaacggggctatccctttttagatactctcattgcgtccgttcaacggtgcaacagtcagaagattgtcttccataaaatagtatccgttataaatagttgcacactttaatcaattgaccttcctacaaataacctttaaacttttcaccattatcaataaggaggcacagcatttggaatatttgaaattactcggcattgttatcatcgttgtcggctttgctttgaagtgggatacgacagcggttgtggtgctggcggctattgtcacggctgtcttctccggcatgagtgtcccggacttattgacgacattgggccagagtttcgttgataatcgcatggtgtcgcttttcttcttgacgctgccgatgatcggcctggttgaaagccatgggttaaaagaggtagcagtgaccggcattcagaaactaaagaagctcacgcccagtcgcattttgaatctttacttagtgatccgtgaattaggtggtgtctttggaatttcattgtccggccaggtgcagtttgttcggccgctgatcacgccaatggtcaccgcggcggctgaatccaaacgcaaactgacggataaggaaattgatcttatcaaagcgcggtcggccgcgacagataatttcggtaacttttttgcccagaatctgtttgtggcaacagccggggttttattgatcgccagtacgatgaagggcctcaagcatccggttgagccgatgcaggtcgtgttggcatccattccggttgcgatcatcacattagtcgttgtggctatttataatcgctggtttgatcggcagtttgagactgacccacgggccgataaaggaggcaaacgctgatggtgaacacgttgcttctagtgctttatgccttgattggcgtcgtgatggcactggccggaattgagtcgtttcgcgcaaaagataatccagcgcgtatcggcaccggcctgttttggctcattctggcggttattttcgcctttggcacgttattgccggcgatggttgtgggtattttggttgtggtgattggcgtacttgcgctgttcaagcagattcaaatcggaaaaatcaaaccggttgacggtgcacatgcggcccaggcagctaagcggctcggcggttgggtctttgtcccgagtgtcgtgctggcagttgtttcgatcgcggttgcccagttcacgaagctcggtggtcaggtcggcatcgggattggcgcagcagcttccctagtggtcgcgatcatcatgaccaaagcttctgggaaaatggtttataatgatacgcagcggatggttcgctcagttggtgctgccggtattttaccgcaattattggcaaccttaggcgcggttttcactgcagccggggttggctcgctgacggctaagttgattgccggcctgtttccggctggaagtcatttgggtggcgtcattttatactgtgtggcgatggcgctgttcacgattattatgggtaacgcgtttgcggcctttgcggtgattaccgccgcgatcggaattccgtttgtcattgcccaaggtgcgaatccggcgattgttgcggcgattggcatgacgtcagggtattgcgggaccttgctgacaccgatggcggccaactttaatagtctgccggttgcgttgctggaaatggacgatccattgggcgtcatcaagcaacaggcaccgattgccgtgttgttattggtgattcaaatcggtttgatgtacttcttggcattttagaaaggatattaaatatgaagattcttgtaacgggttttgacccttttggcgatgataaaattaatccggcgattgaggcggttaaacggttgccggacgaaattaacggcgcaacgattgtgaagctggaaattccgactaagtttaacgtgtctgcggacgtggtgcatgatgcgattgtcaaagaaaagccggattatgtgcttagcattggccaagctggcggtcgctttgaattgacgccagagcgagtggccattaacttggacgacggtcggattaaagacaacgctggttatcaaccgctgaaccatccgattcacgaagatgggcaaaccgcttatttcacccaattaccgattaaagcgatggcaaaggccattcgtgaatccggcgttcctgcttcagtgtccaacaccgcgggcacgtatgtttgcaaccacattttttatcaggttcaatacatgcgcgacaaagagttcccgaccatcaatgccggcttcatgcacattccatttttaccagagcaagtcgttgcgcggccagaaacgccagcgttgtcgcttgatgacgatgtgaagggtatcacggcggcgatcaaagccattgttgagcgtgatggtaagggtgatttggaaacggttgagggcaagactcactgagggtgaagcgtcttccacgctggtgagttagttatcaaagatgcaagataggtgctcatgcgaaagtgtcaaattttttctgtctgctttttatcctgtaccatggggatcttaccggtgattcagaatcattttgacaatctctgacgacagttcgataatgaagtggtaactaaactcagaggcgaaaaaaatggaattagacggcaaagaaatcaaggaaaacgaacaactgaccgatgcacagctgactgacttgcaccagcaatatcaggctttgtgggataaattaaaaaaagacaactatcgaaccgagcatcagttcatggaagtcttatatgaagaacccgacaacgtccagaactatgaagcggcgtttttcacgtatcaaatccgcaaagataccggtgacaatcagttcgatcagttgaatatcattttaaacaataaaccgacttttcatgatcagcctgaggaattcgtatttgagattagtgattatcctgatatggatgcgatttataaggcgatcgaagaaaaggcccagccttggattaaggctcataagcgttagcattttagctaggctcgtggtttaaatatcaatgcggttaaagaaccgatcaggatttacaatgaccgatctttaaccgcattctttttgatgccgaagtgtctgatgatccaagcacttctcttttgtcccagttttgtgataagctgttgccaatcaaaccaaacggaggcacttgattcatggcggatacaatcaaaatcgcgtacttgtacgaagatctcatgaatacctatggcgacagcggcgatgttaaaattttgcgctatttgttgaatcaacaaggctaccaggtgcaggtcgataacatcagcctcggcgacgacttcaatgccgacgactacgacttcatcttcttcggcggcggtcaggattatgaacaaaccgtggtcgctaaggatctgcttcggtacgcccaaactttaggccggtatatcgaaaacggcaaacccatgctggcgatctgtggcggctatcaattgctcggagattattataaaaccagcgaaggtaccgtcatcaaaggcctcggcattttgccactgcatacggtgttcaagccggacagtcgcatgattggcgacactaagtaccaaactgaattcggaaccgttaaggcgtttgaaaaccatagcggccgaacctattttgacgacaagaaaaaacttaagcctctgggaaagatgattgaagggtatggcaacaatcctgaagacggggttgaaggtatgcgttacaagaataccatcggcagctattcccatggtcccattctcaaaaaccagaacatcgccaaagccattgccaaaatgatcgtgcaaaatcacaaagaccgcatcggacagcctgcgcactaacactgcgactggcactgaacgattcggccttgatcgctttaaaacttcagacgcatcaataaaacggaaaactgcctcacgcccgagcccgaaatgacgcgtgcatgaacagcagcttcccgttatttgtttgcctgcgcccgcacctgatcggcatcacccgtaaacaggaacaacgggccatctgcctgtgccggataactatccgccaaatcaccaagatccacgacatcaaatccgattttttcaatcaaattcgtcacggtctgcttggcagtagcatcatctccagcaatcggaatcgcaattcggtcgcttgactgattcggcttagccagactccggatcttcgtcatggcgatggtattaaatgctttcaccactttcttggtaccgaagtgctgtgccaccagctccgatgaagtggtgtgatgctcggtcaatgccaggcgctcgccatcacggctgggaaaatagttagtcgcatcaatcacaaccgcatcggcttttacctttgtcggcaactcgtctaaggcgttgaacggcactgccaacacgacaatatcctgatcagccgcctcagcgaccgtgcctgcctcgaccgttgaccgcatctcggcaataaccggcgccaacgaagccacaccatggcgatgggacaaaatcaccttttcaccaacatgactgaaaagctggccaagcgcgcggcctacattacctgatccaataatcccgatactcacgcaaccaccctccttgtataggttcattgagtgaaaactgacttccactattattatatcgcctatggggaagaaacggaaaagacagggttattctggtatgttttaatcatgcttggtgcacgttttctttgtcgcaaagtgagtagattcaggtgcgcatgagaaccgaacattttggcttgataaaataattttgaaatataaaccgcaaccaatatagcgtaaaggattgtggtcgcatgttgcgattacctgtttggtaactactatcagatatatcagacgcaaaaaaccacttcatttcgagaagcggtttaaaaagactttcctttgtaaaatgttatttttgctgtttgctagttccaactaaaatggcattaatacaaagaaaagccagtggaattaaccataccgagttgttcaatgagccaagaataacaaagactaagcacgcaacaataattattgttacttcaaaaaggcggatagagttttggactatgcgtctgttaaagtgattttcaaagctggaattcccataaatgagcagaaaagaactgattagaaaaaaagagggtactgataataggcttccagcaaagaagaggatatatcccatatttattgctaatgcgattttagtcatatcatatggttcggattttataagccagattcctatgcctaatactgaaaaatacatgtattttttcacagcttttttattaagcaaggatacgcatcccccttaaaaatgaacttgttcttagaattttttctgatcaaaaacagagtatgcttgtgtgtatttatttatgtcaacaacaacgccagcgccagtattgttgtaggtaattgaactggccagccccccagcataccatgaagtgaaagcggaacttcctgcaaaagcagcgcccatagctgcaccgacaggcccagcagcaagagcaagtgcgcctccaatgccaggcccaaagtagccaaaatctcttgcagcattgttaagttgttgtgccactgccttacttttccatgtatcgtagaaacttctacggtagttccaaccttcagcagttccattgtaattgtaatatctgccgcgttttgtgcgtcttgggagtcgtgttgaattgatgtcgttaatagcaacagtcaagaagttttttgcagagaaattagagccagtttctttgtttaacgttgcaaagtcgaatttctctacaattttctcaatagtgttgaaatcatatacatactttccgtttaaaacatccagctgatttgtaatctcatcctgcatagccaagaaatcacgctggatttctgttcttgcaacgattgtctttccagcttctggcgtgttttgaacagtggttgattcaactacttcagctgcttggacaggtaccactgattcaattagtggcgtagtaactagagctgaaacgattgctaaggttgtcagacgtatagcattggacattaacgttccttcttcaaaatgagctcgactagtgacaatatagaaagcggtttctatatcgataaagatatcgtaaattaatcattgtgtcaacaaaaacttgtaataatgataacgaacgttttttacatgtattattaacgactggttataagcaaaaatgatgtttaaaattaaaagcataaatcggattaataaaaactttgagggccgttaaataggtgaagcaatgtcagtcactgcttgcaaataaggaacaaaagtatcaacaaacaccaatgctgcgggtattgactggaaatgtatgggcaaaacattgccaccaaaaagacgatgcttggcactgtagctatgaaatcaaaaatgatgggattctgatcacaagaaattcttttaccgactacgatagcaaatggtcgcaaaaagcgcttattgaaatgatcttctgacacgtcatcatcgccgtgtcaaaagtgaaagagaacgcatagaatatgaaaaaggccaacgtcctaaattgacgttggccagaatgggaatgcttattctcaatgattcatagaattaaagtttcctcgaatcttccctttttaaattttcgcctttttagcaggttgggcacataaatgcgacaacctttgtttgatcctttcaagtgatgcgcattacgatatgcaacaagctgaatcgtaacgcgctaatcgtgagaatgttcgaaactaagacctttttacgatttccgaccatgatgctaattgataataaagatcatgttaggtgacctgatcctttacatcatcaatcggaattttagcaacgtcaaggccatcaagtaccttgaggcagttggaggtctttaaatgcatgataaaaagtctagcattaccgctaccaaaccagccatatcaaaggtgatgcgtgacggtcaagacatgctgggtatgcgcccaggctttttgattaggaaaagtgagtaagccgccgatctgaacaattaaatacgtgagcgagaaccagaaaaaggcgagaacggcttttggcgtgatcaaccacttggagccttcccaattagcgtcatacaagaagccggcaatcatggggatgaagccttcaagcaaaatcagccagttgatcaatgttatcggtacgaaataactgcgatcgacatcgatgagccagattggatgcagaccaagacttggcatcacaagactgatgacccacgcgatgccaaagaaagacgcgagcagatattgaaagttttggcgcatggaaaagagatagctaagttgatccaagtcacgcaagtcgccggttttcaaaaagtgatgcaataacggcagcaaattgtgaaaggcagtataccaatgtccgcggctccaccggaaacgttgggtcatactggcgtgcaaatgatccggcttttcatcataaatgcgggcaaaatgattccagcccacggtgccgccgctttctacaatgcgaatttccatttcaagatcttcggttaagctgtgcgattgaaaaccatggttggcttccagccactgacgctcaacaacaaagccggttccaccgatgctgttgtccaaacccagccgatatttactgagctgaaagaagcgattcatggtccagtaactcatcgcgtaacccaacgtcagcagcgtattgtcatttttgctatcaagataggcctggatggcagtaaagtgctttacctgatattggctgtccaattctcgcagaagattagggtcggtgaagttgtcggcatccagcaccattaccaagtcgtattgttgcagggtgcccgagtcggtcagttcatccaatgcgtattggaggccagccggtttgccgacgccgacccgctgatagcgatggcgtgacgtgtcgaccacctgaacgccttgagccgcagccagcgccgttgtttgatcagtggattgatcgctgacgaccacaatgtgatacgccgtttttggatagtcgagttgttgaaggtgctccaaggtggatgtgatgacggcggcttcattgtgtgccggaatgagaatcagaaatcggctcttaggcgctaccaatggataatcgcgccgtgccttgccccagccaaatagcatcataaacacataatacatcgtcagcaaaaggacccaggtactgctgctaattacaatcatgaaaatcacgaagccgaagtggtgaataaacggtaaaaaagaatcactgatactgaacagaatgaggatagggccaccaatgacaatcaataggaacaaaacgagggcccacgaatccaatttagaaaaatgcttaaacatactgactaccccctttgcgcttttcgggtgagcgtgaactggcgcggttaggagtcggagtataagcggccttgggcgtgatggcgaactttgccattgcgaccaaggtccttatacgcagactcctgcgccagtgaacgcattatggtgagcgtgaactggcgcagttaggagtcggagtataagtggccttcgtcgtgatggtcgggttttgaccattgcgaccaaggtccttgtacgcagactcctgcgccggtgaacgcgttatggtgagcgcatttttcggtgcccctttttgtaccgatcacgcgcggctccaatccgttcgtgcacttagaaaatctcgcgtagcatcgccctattcaggcagacttaacgcggaaaattttctcccccttgcgttgacgaacttaccgaaaaaagtgaaacgattgagccaaaaagattgactgatgatgcaaagcccctctttttggatggccttagattagcacgaaaacctgattgtagaattagttatgcttgtgaactagtacaccatatcgacaagttgatttgtggtaaaatgaagcgcttgaaaattgcgttgcctgtgcgtacttcatgactaggcacaaggtgacgtcacaagatttttgacccgttttcacgtcaagaatacggttgagcacacggcacttttacgttacacttgacgagtacgtgaaaccttgtttgttccacaaaatcaattaaaaaaacggaggcagacatggatccaacagcttttgtccacgctctggctgatcacggcatcgtcttggatgaccgccagcaggatcagttcgcggcttattaccaatatctgatcagcgagaatgagaaaatgaatctgacgggcatcacagctgaaggggacgtctacctcaagcacttctatgactcattgaccttaggcttggtgctgcctgaattacagagccagccgttatcgctttgtgatgtcggtgccggtgcgggatttccgtcaattccgcttaaaattgcgttcccgcagttaaaaatcacgattgtcgactccttgcaaaaacggattggcttcttagaacggttaacgacgcgtctggagctgacagatgttcagttattccatgatcgcgccgagacttttggtgctaaaaaatcatcgcatcgcggccagtttgacctggtgacggcgcgggcagttgcggcgctcaatgttttagctgaactgtgcctgccacttgtgaagccgcaaggaagatttgtggccatgaaggctgccgcaaccgcagaggaactcatcgccgccaagccagcaatcggtttgctgggcggcaagttggtccaggatgcggcgctaaccttaccggaaaccggcgatccccggcatttgctggtgatcgaaaaagtgaaggcaacaccaaataaataccctcgtaaaccgggggtgccaaataaacaaccattgggaggtgcataacgcgtggcattatcattttttggccataaaaagccaaacgacgaaaccgttgtgcaacagttgccactaaacgccattacgccgaatcaatttcagccgcggaaggttttttcagctgattcgattcaggaactggcggccacgattaaagaacacggcttgttgcagccgattatcgtacgtgaatatgcgcctgaccaatatgaaatcattgccggcgagcggcgttatcgggcgatgcagttgttgggatgggaaaaagcaccggcgattgtccagaagatggacgatgatgaaagtgcgtccatggcgctggttgaaaacctgcagcgtgaaggcttgagcgcgattgaagaaggccaggcgtatgtggctttaatgaagctgaatcagttaacccaaggcgctttggcgcaacaactggggaaaagtcaggcgtttgtcgccaataagatccggttgctgaaattggatgcaccggtgcaagaagccattatgaagggcctcatcagcgagcggcatgggcgggaattgctgaagcttggtgatgatcaacaggcacaggcattgcaccaaatcgtggccgacaaattgacggtgaaggaaacatcggctttggttaatgaatggctaagacctaagaagccggaaaaaaagccgaagccaaaagtacgccggtcagcggttagccacgatacccgcgttgcctggaatacactgaaacgttcagtcaaaatgattcgcgataccggaatgacagtcacggccaaagaagaagataccgatgacgcttaccgcatgattatcgagattccaaaagagaagagatagggggagctcatgacacatatcatcgctgtcgccaatcaaaaaggcggggttggcaagaccacaacgaccattaatttgggggcctgtctggcaaaccttgggaagaaagtcctcattgtcgacgttgatgcccaaggcaatgctacaagtggggtgggcgttcaaaaagcccaagttgaaaaggatatttacgatgttttggtcaacgaagatccgattaccgaagccattttgccaaccaaacataaaaatttagccattgttcctgcgaccatccagttggccggtgccgaaatcgagttaaccagtcaaatggcccgggaaatgcgcttgaaactggggcttcatccgatcgaggatcagtacgactacattttgattgattgcccgccttcattggggcagctttcgatcaatgcgtttacggcgagtgattcgattctgattccggttcaaagtgagtattatgcattggaaggcctgagccagttgcttaacacggttcggcttgtccagaagcatttcaatccgaatctggcgattgaaggggttctgctgaccatgtatgatgcccgcacgaaccttggcgcgcaggtgatcgatgaagtgcgcaagtattttggcgataaagtatatgcaaccgtgattccgcggattacccgattggctgaggcgccgagttacggtctaccaatcgtggattttgatccaaagtcgcgcggatccgaagtttacgaggctttagccaaggaggtgctggctgctcatggcgaataagaatagtaagggattaggccgcggcattgacgccattttcaaagattttgaaagtcctgatctgagtgctaacaataccgttgaggaactgccactggtcgatatccggccgaacccgtatcaaccgcgaaaaacctttgatcaagaaggtttaaaagaactggcggattccatcaagcaaaccggcgttttccagccgattattgtgcgcaaaagtgtttccggttatgaaatcatcaccggtgagcggcgttttcgtgcgtctaagctggccggtaaggaaaccattccggcgattgtccgtgatttcaacgatccggaaatgatggagatcgcagtgctggaaaacctgcagcgcgaggatttgactccgttggacgaagcgcaggcttatgagacgttgatcaaacgcttaaacctgacgcaagcagaagtttccgcgcggctaggcaaaagccggccgtatattgccaattatttgcgcttgttaacgttgccacagcaagttaagcaaatgctcagtgccaaccagctctcaatggggcaggcgcgaactttgttgagtctcaaagataaaaccaagatggtcagtgttgccaagaagaccattagtgaaaatctaacggttcgccagcttgaacggctaatcaatcagatgaatgccggcacaggccgctcgacatcgaaggagaaacctaaatcaccgtatgttcgggcaaccgaaaatcagttaggcgaacgcttcggcacgaaagtcaatattaatgaaggcagtaaaggcaaaggcaagatcgaaattgattttacatccgagcaggatctcaatcggatcttagcgatgctagacgtcaatatcgattagccggccaacccgctggaggtagacgaatgtaccaattacatgatttggttcaaatgaagaagccgcatgcatgtggaacgaataaatgggaagtcattcgcctaggcgccgacattaaaattcgttgcaccggttgcggccatattgttatgatgtcgcgccgtgattttgagaagcggcttaagaaagttttaggtcaagcagaacaggcagattaatatagaaagtgtgaaataaccaaatggctttaacagcaggtattgtcgggcttcccaatgtcggtaagtccacgctttttaacgcaatcacaaaagcaggcgccgaaatggccaattatccgtttgcgaccatcgatcccaatgtggggatggtcgaggtgccggataaacggttggcgcggattgatgaattgattccggccaagaaaatcattcatacgacttttgagttcacggatattgccggaatcgtaaagggtgcttccaaaggcgaagggcttggcaacaagtttctggagaatattcgccaggtagatgcgatcgtgcacgttgttcgggcattcgatgacgataacattaccagtgtgaccggcaaagtcgatccgttggaagacatggccacgattaacatggaactggcgatcgccgatttggattcggtcaataaacgctatgccaaagttgaaaaggttgcccggacccaaaccaaagataaggaagcccaggcggagtttaaagtgttgcaaaagattaagccggttcttgaagacggcggaatggtgcgcagcatcgacttcgataaagatgaacagaagatcgtcaagggcttgttcttattaacgagtaaaccggtgctttatgtcgccaatattgcggaagaagccatggccgatccggattccgtcgattatgtcaaacaaatcaaagccgaagcagccaaagaaggcgccgaggtgattgctatttcggccaagaccgaagaggaaattgccgaattggatgatgacgagaaagccgactttctggcagcagaaggtgtcgatgaatccggtttggataaactcatcaaggctagctaccatttgttgggcttagcaaccttctttacggcgggcggcaaggaaacccgcgcgtggacgtttaagcgcggtatgaaggcgcctcaagttgccggtatcattcattcagactttgagcgcggctttattcgagccgagacgatgtcgtttacggatctggacaagtatggttccgtgcaggcagtcaaggaagccggacgttatcgttctgaaggtaaggaatatcaagtgcaagatggggatatcattgaatttcggttcaatgtttaacgtgcaagccgaaaggacgcacgcgacgatgatgactttaagataggagttacacatggcaaagaagcaagaaacggacacgaatcaaacagcggacagcgctgcagttgatcaacagcagactgcggcatcgtcagcggctgatgcgcagcagtcggcagcaacggtggcaagcaagaatgcccatgttaagcaggagcggccagctacaaccgttccggaaatgattgcaagactgaccaataagaacaacgagtatgtcttcaagctgcggcgtgaattaaaagacggcggtatgagtgaggcagatgaggaaaccctgctcaaaacgatgctgccggaaatgattaccgcccaacggcaaggcaaaccggccacgcaactttatgggccggtcacagtgaaggccaatgaaattctgcatacgccaaaaccggaacctaaaaagccgctgtggttattggtcgccgatcaaggtttgtttttcatggccattcttgcggctgtcttcgccgtgatgacttacatcaatccgaaatcgcagaacaacgccagcaacagctttgcttatcttgtcatgttaagcctcatggccggtcttttctttgtgtactacgccgactggatggaacgagacaagaagaatcgccgcagtgcctggttagtgcttggtggcgggattgtgttggttcttgcggtcacctttatcggcggcgccctcatgatgcttgacacaccattcactcgagcaatgccgtggtttgtggacgtgatcatcgccgtggtcgcgtatggttcccactggcttttgcaacgtcggtatcatctcaagagctttttcaggcggtagtgggttgcggtttaaaataagttgctttgttaatgatggtcacctcgatagtggggtggctttttttgtgcaagtgcgctggctcgcgctcaactataacgcgctcactggcgcaggagtctgcgtgtaaggaccttggtcgcaatggcaaagtccgccattacacccaaggccacttacactccgactcctaaccgcgccagttcgcgctcaccataacgcgctcgccagcccagaaacctgcacataaggacctcaagccaaaatggccaaagaccagccattttaacttgaggccacttatgctccggtttctaaccgggctggctcgcgctcaactataacgcgctcactggcgcaggagtctgcgtgtaaggaccttggtcgcaatggcaaagtccgccatcacacccaaggccacttacactccgactcctaaccgcgccagttcgcgctcaaaaaaaataagttgacgccctgtttttcatccggtaaacttcatgtgggcttaatcgtaatgattacgctttagaaaatttgggaggttttttggatgaataaggggcatcaacagcagtacggacgcggatttgtcctggcggcggtggcattggcaggttttggcttggtgaatgcccaaccgactcaggcggcaacatctgctaacggttccgctagtcaggcagttgagcaggcatctgctgtcaagtcggttgcggctaaggatcaaacgctggtctttgcattactgaatggcatcgcagcgaattatcaccaggcgatcacagtgcagatcgttgcggccgataatggtcaggtggtcgcgaccaaaacgttagcgtcaactgatgagtacgaaccgtcagcatcgatcagtgggttaaaaatcggcgccgctgacggactacaggcaggacacacataccgacttcaggttgtagcttccggtaaccaaggctggaaggccgtgccagacagctttgtttacacaccagggcagacaaccaaaattgaaatggacaagtatacttatcaaaaaggcgagcgggcgttccaactcgtcgaccagcagaccaagcagccattggcaaacgtgaaagtggccgctattcctaacctggttgatggcgctaagtcggcaatcgtcaaaacaacggatgcccaaggtcgcgtcactttttcaacagatgatccgcaattcaagcgcaatgtgttctatcattttgaattaccggacaagcacgtgacagtgggctataactggaacttaatcggcggcgaaaaggcggacgataaggcagcggtcgtttcagtgaaaatgcctgcggttgcttcctcaagttcgcaggcgtctcaggcaagttcgcaagcatcgcaaaagccatcacaagcaccatcacaaaagccatcacaaaagccaagtatcgacccgtcagcccagtcgagccagccatcgctacgtgcatcctcatcagcgagtgcttcccaaaaagcatcggttgagtcggtagcagcacaaacgtcgcaggcggcttcgtccgcggaaagtggatcaactcacggattgccaaaaaccggcgaagcacttggccaatcaggacttttagccgggcttgcaaccctgctttcggcgttaggcgcttggttgtggcgtcgccaaggctaagagcggccgctgaagcgttaatcggttcccgtttaaaaatgacagcagctattaatccgaacgatagctatgatggtacaaacccaatgactaaaatacgaacattaaattctcatatcaagcatcgctaattttttgttcggactagactgaacaattatgagactttctttcatttttaggcctatgataccggtcttttcaaaaaaattaccagacacgtttgacgtgttcacattccggtagtacattagtcaacaactaaaaattgaaagagggatttacgctatgagtcattgggatacaaagtttgcccggcgtggttttacatttgatgatgtgttgttgatacctgcagaaagtcatgttttgcctcacgatgtcgatctgtctgtacaacttgcggacaacttgaagttgaatatcccaatcatctcagcggggatggatacggtgaccgaaagtgcgatggcaattgccatggcacgccaaggcggtctgggtgttattcataagaatatgagcattgccgcgcaggctgacgaagtgctcaaagttaaacgcagtgaaaatggcgtcattgtggatcccttctatcttacagccgataaaccggttagcgatgcagaagcattgatgaagaaatatcgcatcagtggtgtgccgattgtgaacaacacaaccgaccgcaagctgaccggcattattaccaaccgtgatttacgatatgtcgatgacaagagtgtgctgatcgataccgtcatgaccaaagaaggtttggtaacggctccggcaggcacttcgatcaaggatgcagaagcgatcttgcaggctcgtaagattgaaaagctcccgttgattgataagaacggccggttgagtggtttgattaccattaaggatattgaaaaagtggttgaattcccgcatgcggctaaagatgcacatggccgcttgctggtcgctgctgctgtcggtgtgacttccgatacgtttgatcgggcacaggcgttgttagatgccggtgctgacgcgattgtcattgataccgcccatggtcacagtgccggggttattcgcaagatcaaggaaattcgcgagcattttccactggcaaccttgattgccggtaatgttgcgacggcggaagccacggaagcgctgtatgatgccggcgttgatgttgttaaagtcgggatcggtcctggctcgatttgtaccacccggattgttgccggtgtcggggttcctcaactgacggcggtttatgatgctgctagtgtggcacgtaaacgtggcaaaacgatcattgccgatggtgggatcaagtattctggcgacatcgtgaaggctttggcggctggcgggaatgcggtcatgttagggtcacttttggccggaaccgacgaagcaccaggtcagtttgaaatttatcaaggccggcgcttcaagacttatcgtggcatgggttcgctgggcgcgatggcgcaggcacacggctcaagcgatcgttacttccaaagtggcgtgaatgaggccaacaagctggttcctgaaggcattgaaggtcgagttgcttacaagggcagccttggtgatgtgatcttccagatgcttggcggcattgaatccggcatgggctatgtcggggcaccgaacctgaaagagctgcaagacaacgcccaattcattcagattaccggagccggcttacgcgaaagccatccgcatgacgttcagatcacgcgtgaagcaccgaactattctgttcaataatttaagacgctattaaaaaagtggctgaaccttaagccatggcgacaataaaaaaagcgaatgcactcaacaacaacgagtgtattcgctttttgttttcccaagagcaattcgttaggaatgttcagacatcagtgccaaagcggagcaatcgtaggccagatggggctcagtggtgagattgtactagctgggcggtcttcccagcgtagtacaaggccgagcttagagactctgccgattttgcagaggctctaagtcgtgcccaccacgttccagccccagctggccggagattgcgcagtttggcacgccatggaacttattgcctaagaattttctgtttcgacctgaattcattaaactataaacgttctgcggaattgtgtcacaatatcgtttgtgtttaaaacttaacgatgccgcaatcgcgcctggtggaaaacctcaagtacctgtgttccaaaagttgttgccactgttaatggccaggcgcgtgtcggcggcatgatggtcaacatcgtctgcaaccattgcgcggttggtaacagcttaatcaaatgatgaccggaaaattgcgtaaatagcaggtttcgactataaaaccgaatcaagtgttgcttcagccgctgatcagcgaccggtaacaacaaatcgttgctgttattccgatcgcccaggaaaagcggcaacggttcaagatcctgatgcaaatcgaattggcggtgcttgtgggcactggccattgccggtgtcaggcggagcatgaataccagtttgcggttcgccgcccacaacagcatgttagcaatggcgatatcggttggcgtgaattcaaacgcagcttggtgcgctgccggactcaacaatgcgtgcgtcaaaaccggtttgagcccggcaacatcgggcatatcaggccaaataacctgtagttgctgcaccccatttaaccaatggacgtgcgtggcaagccgcaacgttaaccagtctgactgttggtacaaaagccaataggtactgccgctggtatgcgcgatattgataccggcgattcgcatgtcctgaggcagactggcggccacaacattggttaatttttccaaaaatgccgcctccttttaagaatgaataacgctgcaacccgcattttcttaggtttttcgtaaagaattcccgcttcaattttggtacaatggacattgatgtgacagtccttaccgatcgttctataaatggagttaaaaacatgaagatattaattgttgacgatgataaagaaatcgttgaattactaagcatttacgttaaaaacgaaggctatgaaccgattcaagcatactcgggaaaagaagcgattaccaaactcgtgaccaatccggatattgctttgatgattttagatattatgatgccgaatatgtcgggcatggacgtggtgaaagaagtccgcaaagactcgcagatcccgattatcattgtgtcagccaaaacggcggatatggacaagattcagggtctgatcaccggcgctgacgattacgtcaccaaaccgtttaacccgctagaagtgatggcacgtgtcaaaagcctgttgcgccggagccaaaacgaagtcaccaatccggaaccggatgtccttgaggttggcccgttaactatcaaaaaggacagccatgaagtgaccacgttgactggcaaacaaattcagctgaccgcgttggaattcggtattttgtatttacttgcaagccatcccaaccgagttttttcggctgacgaaatttttgagcgggtttggcaacaggaatccattgtttcggcgaaaaccgtcatggtccacgtatcacatctccgcgataaaattgaagaggcaactgatggtgagaaggtcattgaaaccgtctggggcgttggttacaaggtcgaggcctaattcatgagcgaaaaagtcaaactcaccgcaaaggaaaaatccgaactgtggattgaaggcattgtgacggtgattttgttactgatgcttaactttgcgttgctggtgctgattaatcagatgatcgcgcataaccccggactggaaaatgccatctggggtgtgaaaacgaatttgacttttggccgcggcggttttcacctctggagctggtcgaatctgtttcttaccatgatggcgattgctgacgtgattgtggtgtattggcgcttggcgcgacggtatcggcaaatgcagatgcgccacgtcatcgccgagttgcattatattgcagacggccatcttgatcatcggattaagtttgaagtgaacaccgagctgcaaaaggttgtcagcagcatcaatgcgctggttgattcgacggtcaattcaatggcagaggaacgacgcatcgagcaaagcaaggatgagctgattaccaatgtcagtcatgatattcgaacgccattaacgtccattatcggttatctgggtttgattgaagaccatcaataccgcagtgaggaagagctgcttaaatatacgcacaccgcttatttgaaagccaaacaaatgaaggtgttggttgaagacttatttgaatatacgaaagtcaaatccaccaccaccaagcttaatccggttcgtttcaacatgattgcgatgctggaacagctcgctgccagttttgagctcgaagcgcataagaaacatatgcggattctcgtcagcggtgagccgaatccgttaatgatggaggccgacaccgagaaactgggccgggtattcaacaacttaattgtcaatgcgttgaagtatggccaaggcggacggcatatttttctggacgcacagcgcgttggcagcgaggtcgttgtgaaagtttccaacgatggcgcgcagatccctaatgatgctctcaatcagctgtttgaccggttctatcgggttgaagaaagccgctcgcaggaaaccggcggaaccgggttggggcttgcgatcgcccaaagcattattgcgttgcatggcggttatatttatgccgattccagtccggagttgacgagttttgtgattcatttaccactaaaagtcggtgcttcattgaccgataaaccaaaacattctaatgaggaagcaggaaagtcaaaatgaagaagttgttgcgtgggttgattgccgccatggccgcggtgttgatgattggtggtgctgctccggcagtctcggttgctgctgcggaaagtagcgatacgaatgtggttgatgccaaggcagcggttgctattgaacccacaaccgggaaagttttgtacgccaagaatgccgatagtgtgttgccgattgcatccatgactaagatgctgagtatcgaactggtgctggacgccattgattcgggaaaaatcaaatgggacgacaaggtgaccttggacaagacgatctggtcgcttagtcaggatcgcgaccttagcaatgtgccattgcggcgggacgggtcctattcggtacgcgaattatatgatgcttcgctgatttattcagcgaacgccgccatgatgctacttgccaaaacggtggccggcagtcaggaaaagttcgtcaatcaaatgactgccaagcttaagagctggggcattacggatgccaaaattgtcaacgtgactggcctcaacaacagccagttaaaagacgctaaagtacccggtaccggcgatcaagcagagaacgaaatgtccgccaaagatatggcccaagtcgcgcaacacttacttaaagaccatccggaagtcctgaaaactaccagcatcgccaaacagactttccgtaaaggaaccgatgacgcgattaatatggaaaactgggactggatgttgaagggcctggtttcatacgacaaaaatctgccggttgacggattgaaaaccggcacatctgacgctgctggtgactgcttcaccggtacagtcaaaaagaacggcatgcggattatcacggtggtcttgcacgccaatggggatgctaaaacccggcgttttgaccaaaccaagaaattgatgaatcatgttctggaaaactggaagacagttcaattggctgatgctggacagagcatcaaaggttatcgcagtgtcacggttaaccgcggcaaatcccggacaacgccgattgcatcagcagctagggctgtcgctgttgttccgtccgataccagtaaacaggatctaaagtatacttatacacctgcaaaaggggttaagaagaacacgattgaagcaccggtcaagaaaggggccacgatcggccatctggaagtgacagcaaagggtgattcgctcgggtttgtcggcggtgcgaaacgtgaaggcatcacgcttaagaccaccaaggcagatccaaaggctaacttctttgtcctgatcttccgtgggattggtgatttcttcggcaacattttttaagcgacaacaatgatgttaagcggtgaatgttttggactccgaaacggagatcaacacgttcacctttttgttagggaggcggtcatcatggtgacttatcacgaaattacgccggccggattggctagtctgaagcaagaggttgaagatctgaaagcgattcgtccggcgaagatcaagaatcttgccgaagccgcagcgttaggcgatcggtcggaaaatgccgaatacagtgcggccaaacgtgaactgcggcagttggaagggcggctgcggtatcttgataagttgattcgttatgctaaagtcacggcgccggctgcaagcgacatagctgatattggcaatatggtgaagcttaagtttgatgatgacgatgatcaggccacctatgagttggttggcccggcagaagctggcatgggtgctgataaactcgccgtcaattcgccattgggagcggcgatccggcgccatcatgcaggtgatacggtcaccgtcactgccccaagtggcacttatcaggtgacgattcttgcgattcagacaggaaaagcgaacgcgtaacgcgtcccccccatttgaagtagtctgtcagttgatcacatgaacaatcaacctcaaagccacgtcaatgcttatgctataatgaagcttgaaataacggcatataaaaaggagcagcccaatggcactatcacttagagcttgtattttattgttgaaggaacaccatttactcaaaagcgcggccatccaaaccaccgaagatgtggacatgaccggcattgcttatgattcacggaaagtgtctggcccgacgctgtttttctgcaaaggggataagtttcggccgatttatttgtcgatggctaaagacaatggcgccaaaacctatgtcgcggaaaaaccgtacgtcgaaggcaatgggctcaatgccttaattgtccggaatattaccaaggccatggcgattcttagcgctgcctttttcgactatccgcaagatgatctgtttgtgattgcctatacgggtaccaaaggcaaaaccacggcatcgtacttcactgaagccattttgaacgaagcgcgtccgcggcatatcgccttattctcaacgattgacacggttgtcggcccggaaccgaatcaacgcttcaaatcaaacctgactacgccggaaagcctggatttattccgtgatatgcgggaagcagttgaaaacggcatgacccatctggtgatggaggtgtcaagtcaagcttatctgcgcaatcgcgttttcgggctgacttatgatgtcgggttcttcttgaacatcacgccggatcatatcggaccgaatgagcatccgacatttgccaactatctgcacaacaagctgcaattgctggttaacgcccgtaaagtcgtgatcaatgccgaaaccgagcattttgaccaggtttatgcagccgcgacaacgacgacttatccggaaagtatttatttattcgccagtgccggattcaagcctaaacgcgatgatattgacatcgactttcgttttgacagccaggaagcggacgttgccgaaagtcgctttacattagtgccggtaacggaaaaagcggccgcactcaatattggcggccattattcgcttgcgttaatcggcgattttaatgaaagtaacgcgaccgcagcgatcattggtgccggattggcaggcgttgatgcatcagcagcagttccggggattgctaaggttaaaatacccgggcggatggaacatgttcagattgctggtcatggcacggtttatgttgattatgcccataactatgccagcatgaaggcacttttatcatttttgaagcgttcatacaaagatccgcggatgctggttgtggtcgggtcgcctggtgacaaaggcgtttcccggcggccggggtttgccaaagtgctcactgaactggctacggaagcttatctgacaacagacgatcccggttacgaagatcctgccaatattgtcaacgaaattgacagcaaaatcgaccacagtaaggtcaaagttcataaggtgcttgatcggaaagaagccatcaccgaagcgattaaagccagtggcccgcaagatgtggtggtcgtagccggtaaaggcgcggatccttatcagaagattcgcggcgtcaatacgccgtggccaaccgacatggcagttgtaaaagaagttggcaagtcgttacaggaaggctgatattaatgcgtcaatttttcacggtaatcggaggcatgggcacacccgcaacagaaagttacgtgcggctgcttaatcaacggacgcatgcccacagtgatcaggaatatctcaattatattctggtcaatgatgccaccgtgccggatcgaaccgattacattttggatcacagcaaaccaagcttttatccggatttacttgaggatatccaggcacaaagcttgctgaatcccgagtttattgtgattgtctgcaatacggctcactatttttacgatcagctggcggccgcaacgccgatcccgctgttacacatgccacggctggcaattcgcgacatgtgcgaacgttttcctaatgaaaaacgcgtcggactcattgccacgcaaggcacgatcaaagatggcatttatagccaagagatcgaaaacaccggacgtgaggtcgtcttgggtgatcaagcccttcaggatatggttacggagctgatctacaagtacgttaaggaaaaaggcgaagttaacgctgaattgtatcaccgcatcttaaagcggatgcatgatgattttcatgtcaacgtcatcgtgctcggctgcaccgagctgtcatttgcgcaggaaaaggcgggcgaccatccgtatcacgttatcgatgcccagagcattatcgtcgacaagacgctggcattaggcaaagccttccgcaagagcgaagcggacggtaaggcgcttttgaatcaactaatggtgtgagccgagcgtgaacaggagatttctgcgactgcgaacgcgttatcattcatttttgagtggtagacggccatacaaaacgctacttacttgtggtaagcttaaattagttctcaagtaaaggagatgcagaatttggcacatttaaccaaattgacagacacgtatactttaaacaatggcgttgagattccgattgttggctttggcacttggcagacacctgatggagaagttgccaagcacagtgtggaaaccgcattggctgccggttaccggcatatcgacacagctgctgcctatggtaacgaagatagtgttggtgcaggcatcaaggcatccggtgttccgcgcgatcagatctttttgaccaccaaactgtggaatgccgatcatggctatgaagcaaccaaagccgccatcgatcgctcattgcaaaagcttggtgttgattacgtcgatctttatttgattcactggccaaacccgattcaattccgtaacaactgggaagaggctaatgccggttcgtggaaagccatggaagaagcctatcaagcaggcaaactgcgggcgattggcgtgtcgaacttccgcgccaagcatttggacgcgttactcaagaccgctaacgtcaagccgatggtcaatcagatcttcctgaatccaagtgatttgcagccggaagtcgtggactataacaaggcacatgatattttgagtgaagcatatagcccactaggcacaggcaaaatctttaaagtcgaagcccttaagaagattgcggaacgttacaacaagagtgtggcccaagtggtgcttcgctggtcactgcagcatggcttcctaccgctgccaaagtcagtgcatgacgagcggatcaaagaaaacgcccagctgtttgactttgaactgagtcatcacgacatgacgctgattgatgcgttacatggcgaagccggtttggcgacggatccggatactactgatttctaggagcaaaatgacgatgcagtcagcattgtatgactgcgcaaaaccctcgcgggagaccgcgggggtttttgtgtgccgtgacgaaatttatgaaggtgagacggcctgctgctttttggcattgatgagctgaacgttgttttcagtcagaaaatcgcgatattttgcgtcaacatcgccataggtgacaatcgcatcgatgtcttgcaaggcaccataagtgagaagcgatacgcgaccaaacttggactgatcgatgagcaggatcttgcggtgtgcctttttaaagatctcggctttgatcagatattcgttgtactccgaattggacaagccgcgtgtcagcgaaatcccggttgcggccatgaacgccttgccaatattaaagcggctaaagatgttcatatcatcaataccggtaaacgactgggtccgccgatcaaaattcatgccaatgatgacgagtttgatgttcgcaagcggtgcggcttgattgataatctgcagattattggtaactaaagtgaacggaaaatctgtcggtaaaaaaccgcccatctcagcagtcgtggtcccggagtcaataaaaatcaagtcttcaggttcgatgagttgggccgcagcgcgtccgatctggtgtttttcggtcggtgccgctaattgacgctcactgtaaacggtgagggcgttgcctttcgtgctgggagtcgtggtgttatccgtcacgccaccatacacttttttaacggtgccggcagcgatgaggctggccagatcgcgacgaagcgtgctgggagcgatgtcaaacttatcttcgagttctttcatggaagccgtcttgacgtcgctgatataggcttgcatggcatcaattcgttcttttctaagcatggatgtcaccttcttcatttctataagcattttgattatagcatttaatgacaaacttttgaacaacttttgatcaacttaccagccgaatcatgattaatttccggatgagcaattggtcagctccggcgcccgaaaaaatgtaccgattttctcaagaaaaaatggcaacattcaaacataaaatctgctttgatctatgcgcaaagcggcgaccataacattggctttctttggcaaagccgctagttgtttgcctttatcataccatcatggtataggaagattcatctttttggctggttttgtgaatagctggtcattttatgagcaaatgttgaatactttttagttgactttgatctagtctgcttatatgatggcaatgtgatcataaagtaagcgcttaactttgtactaaaaaacttcagaaaagtttggaggctatgggaaatgcgcaaagcaggaattgttaacgacaaaggcgaggctgcgcttgctccgcagacgtctggcgggattaaatctgaaaagttgcctaagtcggcacggcgccggttacggattatttccgtgattgcgacatttggcggcatgctcttcgggtatgacactggggtgatcaatggtgcgttaccattcatgaccaaggcaggagaattaaatatgtcgccttcgatggaaggcttggtagcaagttcattaacgttgggggccgcttttggggcagttttgaccggtcggatttccgatcgtaaaggtcggcacaaggtgattaccgcacttgcgatgttgtttgttgtctcgacaattgcatcggcattgtcaccaacggcaccaatattggcgtcagttcgattcgttttgggtctggctgttgggggcgcttcggtcattgttccgaccttcctcgccgaggttgcaccgtcaaatcttcgtgggcggattgtgacccagaatgaattcatgattgtttccggacaactgctggcctttgtgtttaatgccattttaggaaccacactgggtcatattcccggcatctggcggtggatgttagtcctggctacgattccggcgattattttatggatcgggatgaattttgttcccgaatcaccgcgatggttagcggccaatggcaagttggatcaggcactgagcgttttgcgagaaattcggacagaagagcaggcgcgtgacgaaatggaaaagatccagatttccttaaaatcggcacaggaagttaagagcgcttcgattgccgacttgaagatcggctggatcagacggctggttttgatcggtattggcttaggcatcatgcaacagattgtcgggattaacgtcatgatgtactacggaacgacaattctgcagaccaccggctttggtcagaacgcggccttgattgccaatattctgaacggtgttacatcggtggtcgcaaccattgtgacgatgcatttgatgagtaaattcaaacggcgtcaaatgttattaaccgggatttccggtaccttgttttcacttgtcggtattacactgaccagccactttctggcaggcagtccaatgttgccttatttcacgatcttgttgacgattatctatctggcgttcttccaaggcgcattaggaccgctgacatggttgctgctatcggaaatttatccggcgcggatccgtggtttggggatgggatttgccaccttcttcctctggatcagcaacttcttcgtcggttatttcttcccggttatgttggcaggcatcggtatgtcgaataccttccttgtctttgtgggagccaacatcatttcattgattttcgcatggcggtttgcaccagaaacagccggtcgttcgctcgaagaaatcgaattggacaacaagtttgatgacaagttcccggaaaagagcaagatcaacaaaaattaagtttccgaagtcaatttgtttgaaaatgtaagcgcttcatatcatccttgaaaaagaagcacgaaaggagtcagtttcaatgacaacgcaacaagcagtgaagacactcaagaattttatcaatggcaagtgggtggatgccaaaaccgataccttcgaagatgtttacaatcctgcaacgggcgaggttctggcccgggtaccgcattcaagtagcgaagatgttgccgatgcggttgccgcagcaagtgctgcctttaagacctggcagcgggtatcaattcctaagcgggccaaaattctattcaaataccagcagttattggtcgagcatcaggaagaattaggccggatcgtgactgaagaaaacggcaagagcctgagtgaagcagttgccgaagtcggccgtggtattgaaaatgtcgaatttgcagccggcgttccaaccttgatgatgggcgattcgctgacaacggtggcgaccgacgttgaggcgaccaattatcgttacccagtcggcgttgttggcggcattacaccctttaactttccgatgatggtgccatgttggatgtttccaatggcagtggcaaccggcaatacgtttgtgctgaaaccatccgagaaaacgccactgacaagtcagcgactggtggaactgttccaggaagcaggcctgcctgatggggtgctgaatatcgtgaatgggtcagtggatgttgtgaatggtcttttggatcacccggatgttaaagcgattagttttgtgggttccgagcgggtcggcgaatatgtgtataaacgcggcagtgagcacttgaagcgggttcaggccttgaccggggcaaagaatcacaccatcgttttggaagatgcagaccttgatgcagctgtgaaaggcattatcagttcgtcattcggatcagccggtgaacgctgcatggcaacttcggttttggtactacaagaaagcattgccgacaaattcatggcgaaatttacgcaggcggctaaggatatcaagattggcaacggattggacaaaggggtcttcctgggaccggttatccgcaaagaaaatcaggaacggactttgaactatatcaaaaccggggtcaaagaaggcgccaaactggttttggatggttcggaagaagccaaggaacgcgatggctacttcgttggaccgaccattttcgaagacgtcaaaaccgatatgaccatttggcacgatgaaatgttcgcgccggtgctttcggtgatgcgggccaaagacttgccggaagccgttgctattgccaatagttccgagctagcgaatggtgcctgcctctttacggactcagccgcatccattcgttacttcagggaaaacatcgacgccggcatgttaggcattaacctcggcgttccggcaccgatcgcggtcttcccgttttccgggtggaagcattcgttcttcggcacactgcatgccaatggcaaagacagcgtggacttctatacgcacaagaaagttgtgacggcacgatatgatcaaagccgattcaagtaaaagttctgcagctttgaaaagaggagggtcacgatgagcttactgtatcaaaagcaaaatcaggaaattcggccaggcgtgcatttgattcaggatgtcaatgcaagtaattcgccaatgaaatatacggcagtcaaggttttggcgcttgatgcgaacgcttcatatgacgaaactttgggagattttgaggccggcattgttgttttggccggaaaagtgacggtaaccgccgaccaacagcgatttgaaggcattggccagcggcagtcggtttttgacaaaattccgactgacagcgtttatgttggcactggcttgccgtttggtatcacggcacaaacagcagccaagattttaattgcttattcgccaaccacgacgtctttcccggttcgtttgcttaaaggcgacattcatcaaatcgagcatcgcggcaagtatcagaataaacgactggtgcaaaacattttgccagacgacctgccatttgcggacaaattgttgctggtggaggtttatacggactcgggaaactggtcaagttacccgccgcatcgccatgaccatgacaacctgccgacggaatcgttactggaagaaatctattatcacgaaatgcaaccaaagcagggatttgtttttcagcgtgtctatacagacgatcactcgctcgatgaaaccatgaccgttcaaaaccaagacgttgtgattgttcctaaaggctatcatcccgttggcgttccagatgggtatgacagctactacctcaacattatggcaggaccgacccgggtttggcattttcacaatgccccggaacatgcgtggattattgatcggaagtagaaaaggttgatgcgcaagggaggaagcattttagatgtctaaaaaatttgatttgattgccattggccgggcagccgttgatttaaatgcggtggaatataatcggccgttagaagaaaccaagaccttcgcaaagtttgttggcggctcgccagccaatattgcgatcggttccgccaagctaggccaaaaagtcggcttcattggcaaggtgtcagatgatcaactgggacattatgtgacccagtacatggctgaagtaggcattgatacctcacaaatggttaaggatgatgccggccataaaatcggactgacttttaccgaaattattagtcctgaagaaagtgacattttgatgtaccgcaatgaagctgctgacttatatttagcggccgatgaggtttcaaaagactacttggaccaagcacagatgctcgtcatctcaggaaccggattagcgcagagcccgtcacgcgaggcgattctaaaagcacttttgctggcgaaggaacttggcgtcgaggtcatcttcgaactggattaccggccgtatacttggcaaaatgccgaagaaaccagcctgtattaccaacttgttgctcaaaaagctgacgtcatcatcggcacccgcgatgaatttgatgttttggaaaatcatcagggcaataccgatgagcaaaccatcgcaacgttattccaatacgacgccaatctgatcgtcatcaagagtggcgttcaggggtcaaatgcctacaccaaagcgggcgacaagtatcattttggcgttttcaaaacgaaggtgctaaagagctttggcgcaggtgattcgtttgctgccgggttcctgtatgcttacagccatcatctggggattgaaacagccttgaagtatggcagtgcagcggcatcgatcgtcattagccagttaagttcttcggaagccatgccgaacttggcgcagctgaccgagtttattcaaaaggctgagacgcagggggtgcattaagatgagcgcaatggagttggagccgcaaacaaaagcgtcgcaacggtccgcacctgacactgtccggctgacgaccgcacaggcgttggttcgttttttaaatcaacaatatattgacgtggatggagaagtgacaccttttgtcgaaggcatcttcgccattttcggacacggcaatgtgctggggctaggagaagccttacaggaagatcctggtcatttgaaggtctatcaaggccacaacgaacaaggtatggccagcacggcgattgcttatagccgtcagttgtatcgccataagatttttgcggtgacggcatcggcaggcccgggttcggcaaactttgttacggcggccggcaatgcttacgttaacaatattccgattctctttttgccagccgacacgtttgcgacacgccagccggatccggttttacaacagattgaagtggatggcagcgcaacgacgaccactaatgatacgttgaagccggtatccaagtactgggatcgggttgagcggccggagcaattgatgagtgcgctgcttaaggcatttgaagtcttgacgaatccggcgacagcagggccggtgacggttgcactgcctcaggataccgaaggcgaggcttttgattatccgctcagttttttcaagaagcgcgttcatgtcgtgaaaaggattcaaccaagcgcggcggaattggcggaagcaacacggatgatcaaggcaagcagctatccggttttgattgttggcggtggcgcgaagtttagcgaggctggcccggcaatcgaggcgttttcgaataaattgaaaattccgattgttgaaacgccgacagggaagtccaccgtttcatccgcttttgcgaacaacatgggtggcaccggcgttctggggaccgccgctgccaacgatgtgattgccaaagccgatctgattattggggcgggtacgcggtatacggactttacgacggcatccaagaccgccattgatccggagaaaacccacattagcaatattaatctgaatcgcatgcagtcctataagtttgatggattcccagtggttgccgatgtgcgcgataccataacgcaactgacaaacgcgctgtctggatacgaaagcggatttaccgacttagctgacaccaaggcggcttggcaaaaagaacggaaccgtctggcacacacgaattatgatgcgccggactttacgcctgaagttaaaaaccaatttagtcctgaaaccttggctgagtacgcggcaaaactgaaaacccatttcacacaaactgaagcagtgattgcggtcaacgacacgattgatccagacagcatcatggtcgcagcagcaggttcactgccgggggatgttcaacgtatctgggatccggtcgagccgaacacttatcacatggagtatgggtattccatgatggggtatgaggttccagcagccttgggcgtcaagttggcggagccggataaagaaagttatgccttggttggggatggcagctttatcatgttgcattcggaactcgtcacagccctacagtatcacaagaaaatcaatattttggtctttgataattccggatttgcgtcgatcaataatttacaaatggcgcaaggcagcaatagttacctgactgaattccgaacagccgatcacgatattttgaccattgattttgccaaaatcgctgaaggatacggggcgaaaacctaccacgctaatgatcgggaaagcctgatcgccgctttggaagacgctaaaaagcaaaccgtttcaacgttaattgacatcaaggtactgccgaaaacaatgacgcaaggttacggtcaaagctggtggcgcgtcggggtgtctgaagtttccgacaatccgaaagtccaaaaggcgtatcgggccattcaagaaggtattgatcaggcgtttaaatactaggagaaaacaacaaaaggagcgatcaacatggttgtcaaagttggtgttatcggaacaggcgcaatgggtcgagcgcatattgatcggctgacgaatgtcttaaccggcgcaaaagtggtggcagttaccgacattaatcaagaagcggctaaagctgcggtgcgtgattttaaactggatgcaaaagtttaccttgacgacacgagtctgttacaagatccggatatcgatgcggtctttgttgttagttttggtggggcacatgaagcgacggttctcaaagctttggatacggataaatttattttcacggaaaagccgttggcgacaaccttggaaggcgccaagcgcattgtcgacaaagaaatgggtaaaccgcgaaaggtcattcaagtcggattcatgcggcgctacgacgaaggcattcatgcgttgaaggcccagttggattcaggcatcattgggactccgttagttgttcgggccagtcacatcaatccggatgtggccgcgaactattccaatgaaatggcgattaccgatactttgattcatgaaatcgatgagatgcactggttgcttgatgacgattatgcatcgattcagatcacctatccgcggcagtcaagcaaagtgaacaacgaaggattgcgggatccgcaactggcgacgttgacgactaaaaaaggcgtggttattcaggtgctggttcatgtgacggcgcaatatggctatgaggtcaaacttgaagtggttggggaaacaggcgagttgaaactgccggattatggatttgcgccaattgtgcggacccaggcaacgcaacaaaccgcaatggaaacaagttgggtcaagcgattcttgcaggcgtataacaccgaagtacaggaatttattaatcaagtggccaagaatcagtcgccaattggtcctagtgcgtgggacggctatattgccgctgtgaccgcagaagccggcattcgctcgcagaaagatcaggaaccggttctcattaacgtagccgcaacaccggcattttatcaaaagaaacaggcagtaaaagcttaatgaaccaaataaatgacttgaggaggatataaacgatggctcaacggacagtaaaaatcggcatagtggggttaggccgactggggaaaatccatgcgaccaatctggcaaccagtattcagcacgctaagctgcaggcagccacaagtgttgttccagaggagttggcgtgggcccgcgaagaacttggggttgaagaaacctatgaagatttcgacgatatggttcaaaacgcagatattgatgctgtgtttattgtgtcgccttcaggattccatttgccgcaaattgaaagcgctatgaatgccggcaaacacgttttcagtgaaaaaccgatcggcttggatcttgcggcgatcaaacacacgcaggccgtgatcaaccagcatcctgatttgaaattccagcttggcttcatgcggcgcttcgatgattcgtacgtttatgcaaagcagttagttgatgaaggcaaaattggcgacattacactcatccgcagttacagcattgacccggcgtccggaatggaaagcttcgttaagtttgcgacctcggctaatagtggcggcttgttcttagatatgtcgattcatgatattgatgtgattcgctggttcaccggtaaagagattgacaaggtttgggcgatcgggttgaatcgcgcctatccggttctggatcaggctggcgagctggaaaccggcgcagcgctgatgcaacttgaagataagaccatggcgatcttggtagccgggcgcaatgcggcacatggctatcatgttgaaaccgaagtcattggaaccaaaggcatgttgcgggttgcacaggtaccagagaagaatctggtgacggtgatgaacgaagaaggcatcatccggccaacctcccagaacttccctgaacggtttgcccaagcatttctgagtgaagaaaaggcgtttgttgacagcattttgcaagacacttcagtcgggattacggcagaagatggcttgcaaggtacgaaagcagcgctggcattacagcaggcatttgaaaagaacgatattgtcaaagtcgatgacgtagataaaaaggtgggtgcttaaattgacgattgagctaggaattgcgccaattggttggacaaatgatgatatgccggaactgggcaaagaagtgacatttgaacaagcgattgatgagatggcgttggcggggtaccaaggaaccgaagtaggcaataaatacccaaaggatccggcagtgttaaagcattatctggcattgcgccatctgaagattgccagcgcctggttcagtgcctttttgacgaccaagccgtatgaggaaaccgaagcggctttcattaaacatcgggactttcttcacgcgatgggcgccaaagtcatcgtcgttgcggaacaaggacatagcgttcaaggaatgctggacaaagccgtttttgatgacaaaccacattttaccgatgaagagtggcagcggttggcgaccggattggaacgattaggcgatcgggcacatgaggtaggaatgcaaattgtgtatcaccatcacatggggactggtgttcaaacaacggctgaaatcgataaactgatggcgatgacggacccagacaaggtttcacttttgtttgacaccggacatctggtcctatccggtgaagatccgttagacatttttaatcgctacaaagatcggattaagcatattcacttcaaagacgttcgcccggagcaagctaagcaagaacgggcagaacacatgagtttcttggcaggggtcaaaaacgggatgtttacggtgcctggcgatggcatgattgatttcaagccaatttggcaagccattcaaaagagcaactatagcggatggattgtggttgaagccgaacaggatcccgccaaggcaaatccgcttgaatatgcattgaaagcaaaacagtacttggataccatcatggcaatcccacaagcggtttaaagggttagatttagaaggggtatggtccttatggcgttgataccagcaacaacattgatgcaagccgcactggctcaccacgctgcaattggtcattttaatattaatggtcccgactggctggagacgtatcttagcgttgctgaagaaaccaaaacgccgattattgtggcaacttccgatcggattatggattttcttgggggcttcgacttcatgtcgcgctacgtgcgtttcatgatccaagcgttggaaattaccgtgccggttgtgcttcatctggatcacggcttatccgtcgagcacgtttatcaggcgattgatgctggctatacatcggtcatgtttgatggctcaaagttgcccattgctgaaaatgtcgccttaaccaaaaaggtggtcgcctatgcgcatcaacgtcatgtatcggttgaagcagaagttggcagcgttggtgggaatgaaaatggcctaatcagcggtgttcagtatgccagcgtggcggatgcggtcaaaatggctggcaccggtattgattcgttggcagcggcactgggttcggttcatggcgattatgttgggcggcccaagcttaactttgagcggatgaccgagattgcccaagcaacccaactaccgctggttttgcacggtgcatcaggtattcctgacgaccagattcagcaagcaattcaaaccggaacggccaaaatcaacatcaatacggaagtgaacaccgtgtggacggaagcggttgccaaagcgcttcaacaaaaacactccggtcacgatccgcagccaattcttacagcaggcaagcaagcgatggcgcgcctagttgaaagtaaaatgaacgactttcatattttggggaaaagtgcccggctaactgcgatggagtgaaagcgttactgatattgtgttcagtaaatcatgaagttgattaactgaatagtgcgaattatgaaagcagggatgatatgccactggttcggtttgacatgttaaagggccgatcacccgaaacgattcaacagattttgcaaatcacgcatgaggtcatggtggcggcttttgatgtaccggcacgtgatcggtatcaaattgtccaccaacatgagccttacgaaatggttgttgaagataccggattgggaataccgcgcacggataaggttgtggtcatttcattggtcagccgtgtacgtaccgttcaccaattaaagcagttctatgcaacactggcggaacggttatcggcggcagggctagtcgataaaaacgatctcatgatcaatgtttcgttcaacaatgaccaaggatggagtttcggccaagggaaagcgcaatttctggatggcagtttgtaggtgaaccataagatagattgaaaatgccttggccgtttctggaagtctgcaacggtcaaggcattttctgtgcggctgcaagacgtgttagaaaagctgacaactagcagtatcaaaacagtgtgtgcaagaaagcagaggcgttaaatatgacgattcaaatagaaaaaatagcgctcaatcgaaaagtggcgcagaaccgttcactcgaaagttttttccagttagcgacagaggttggcattcatcaggtggagttgcgcaacgatatgacggcgtccgatcgtcccgaaaccgtcattgatcaaatgccggtcgcggattttaatgcgttaaaagccaaatatggcatgaaaattctgaccattaatgcgctccaacaatttaatcagccagcaaagttagtcgcgaatcggcaacttttgaccggattggccgagttagcggttcaaatcggcagcccagccattattttcgtgccggaagttaatccgcaagataaccgaacgccgcaacaacgacttgaagacgcggctcacaatctgcaagtgtttggcgagatcttagcgacttatcacctgaccggcttggttgagccgctgggctttatggctagcacgttgcggtatccgtggaccgcacaacaggcgatcaaattgtccggtcgcacggaattcaaactaactattgataccttccacttcttcttggcgcatataacggcggcgcagtttaaagcaaatgttgacgtgaagcgaatcggactcatccatttgtccggcatcgaaccgattcacgagttgcgcgaagttttagatgaggaccgcatgtttatcacagaccgcgacatcatgcaaaatgttgaacaggtgcaactttttgaagccatgggctatcagggcaactattcctttgaagccttctcgacacggttagctgccgaaagtaaccagcagttggcgcacgaaatcaccaccagcatcgcgcaattgaatcaaccaacggcggtttcaggcttggaggtgtgagaccatgaaattagcttacgatccttccatgtttcgcgacaccatgacgttgaagcagatgtttgatgaggtggctcgtctcggctatgaatatgttgaactttcgccacgtagagatttcatttggttctatgaacatccggtagcggacacggcactgatcaagcaggtaaaacggtatgctcaggatgccggcgttaaaatttcctcggtgcttccggtgcaacaatggtcgtcacccgatgaacaggagcgtgaatttgctgtccgcaacctgaaacgcaccattgaaatcacggcggcgctgggtgtaaaagtgttgaataccgaattttcaggcgataagttccagccactggtatcacaagggcagtggtacaagtccatggaagagctggcgccggagtttgaaaagaacggcatcacattggaaattcaaccgcatcccaatgactttattgaatcgaacctggctgccagtcgcttaatccgttcgttggatgtggactgggtacatcaggtttggtgcagctcccatgccttttatatggatgacgggcgcggtgatattcgccaacagtttgccgaatccggtgatctcattacccatgttctgattgcagacacgtttaaccacaaaggcaatcaaggcttgcgttacatcatcaatccgccaggcgcaccggtgacgatccaccagcacttaaacccgggcgaaggtgaagtcgattttgccacactttacgccgtgctgcgggaacgacattttaacggcatcatcaccaacaacgtgttcgcctggcccgacaaggttgactggtcgaataaaattacgctgcaatcgattaagaatggtttgcagctttgacaggtgctgctaggtcatagtttgcgtttgcttactgtgggtaattcgctaagactatttagttactagtgccaaagcggagcaatcgtaggccagatggggctcagcagtggaaacaacacagcgaccggtctttgtcgctgatgttgttaggcgactttgagacagtggttttctggctcaaagcgccgtcacagcgttccagcaccatctggccggagattgcggagtttggcacggcttgtaatttattgcctatgcctttttatcttgttcagaactcatcaaactgtaaactttcttaagaaattatgactcaacctctaaattaaaatatttccgatccaaaacgacacctgatgcatgaattctcagatgtcgtttttgtatacttaaagtgacataagctgctgatgattgattatcggcgcgtcgcatcaatggtggcgcgcacccgacgaaagagtggggccgtctgactgttggtttgaatagcactgatcataaacagcgtatccatgaggctgagttccgcgattaacgcatggagcgcttcggttcggtagcgcgattcttcggcaaccgcgacaaacgcggcatcggccatttttgccagacgagaagccggtgcgccggtgatcacgataagcggcacctgctgttgcttggccaagtcagctaacgcaatggcgtctttatcttcaccggaatgcgatgtcaaaatcatggcgtcattggcgcccagatgcgttgctgccatgagctgcatatgataatccgcggcataggaaacggggatggccgtccgcagaaacttgtgatagccatctaacgcaacaagattgctggcgcctaatccaaaaagaccgagatgatccgcatgggtaatccaattaatcgctttagtcaaggcagccgtgtccaagttggccaaggtagttcggagcgcatcgatattggaggtgaagattttttgcgctaaggtctcgaccgaatcgtccgggctcagttccgcaaatagcttttgatccggttccggtggcgactgaaccaacgccatccgcagcgcctggaagttcggataacccaacgccttggcaaatcgcgaaatggtggccgtactgacgcccgttattgcgctgagttccgcgatatttgcctgactagcgcgatccggatgcgtttgaagaaaatccgctaatttcttttcttggcgactcaagtttggtttgtaaatttgtagttgtaccagaaaatcgtgcatatgcccctcctccatttcctcaagatgagtatagcattaaatgtatgaattgaaaattaattacggacactttgcttgatttttgtaatttttttacatacaatggcaccatgatcacggaggagcgcttttgacccccgagaaagtggtcttggcgttcacattaacgcgttcgccagcgcagaagcctacgtgtaaggaccttggtcgcaatggccaaacccgggccatcacgcccaaggccgcttacactccggcttctaaccgcgctggctcacgctcacattaacgcgttcgccggcgcagaagcctgcgtataaggaccttggtcgcaatggcaaagaccgccatcacgcccaaggccacttatactccggcttctaagcgcgccggctcacgctcagggagggatagcatatgcaagtaggtatggtaggtttaggcaaaatgggtatgaatctggtcgcgaatatgcgcgatcatgatattgaagtggttgcgtttgatttgaatgatcaggcgcggacggaagtgggtcaatatcaagcgagagctgttgccagtctggacgcattggtgatgagtctggcgtcaccgcggattatttggagtatggtaccggcggggaaaccaaccgatgcaacgattaatcagctggccaagttactgcgtcctggcgacatcgtgattgatggtggcaattcttattatcaggattccatcaagcgaagtcagttgctggcaaaagatggcattcacttttttgatgtcgggacgtccggtggcatggcaggcgcgcgggccaatggcaatttcatgatcggcggcgaccaaacgcaatttgccaaaattgaaccgctgtttaaagccattgccgcgcctggtggctatctgtatactggcccagccggctcagggcattatctgaaaatggttcacaacggtattgaatacggcatgatgcaggcaatcggtgaaggcttcgatgttttggcgcatagtccctatgattacgacaatgaagcagtggccaaaatgtggaacaacggctccgtgattcgcagttggttgatggaactggctggtaatgccttcagcgacgatgccgatctcgaaaagattcaggggatcatgcatagttcgggtgaaggcgcatggacagtcgaagaagccttgcgcttgcacgtggcaacgccggtgattgcaagtgctttgatgatgcgttatcggtcagaagcggccgataccatgaccggtaaagtagttgctgctttacgcaatcaattcgggggacatgcagttgatcccacgaccggaaaacaaggcggcaagtgaaataaaggagaagaacgtgatgtctatcaaatatatgatcggggttgatttaggtacaacgagtaccaaggtcgttttgtttgatctaaaaggccaagcaattgcgacggcgaataacccttacccgttatatcaagatacgccggatatggctgaagaggatccggaagaaatctttgcagcgacggttggcggattaaccgaagtcatgcatcgcgggaatgttcagcccggtgaattaggcggcgtttcgttttcagccgccatgcatagtctgattttgatggatgagcatgacaaaccgatcacacgggttattacctgggcagacaatcgggcggcggcttacgcgacgaaactgaagcaaagtgacctggggatgacgctgtttaaggcgaccggagttccgacgcacccgatgtcgccgctggtgaagttactgtggctcagtgccgagcatcccgagcttgtcgcccgcacgcgtcattttatcgggattaaagattatatcttgttccgctttttcgggcggtatgttcaagactattcactggcaaacgcgacgggcttgttcaatattcatacgatggattgggatgatcgtgccctagatgtcgccaatgtccggcgcgatcaactgccggagttggtggatacgagttatcagctgaccgggttgaatgctaattacgccgccgtgaccggcattgacgacaaaacaccgttcattctcggggctagtgatggcacgctaagtaaccttggcgttggcgcgattgatcctggcgttttggcggtcacgattggcacttcaggcgccgttcgcgtggtgacggataagccggttgttgatccgcaagggcggttgttcacttactacttggcacctaataagtgggtcgtcggcggtccggtgaataatggcggcatcgtgttccgctgggtgcgcgatcaattgtttgcgccggaaaaaatcaccgccgagcaactacaggttgattcatatgaagttttgaccgatattgccagcaaaattcctgccggtgccgatgggctattattccatccgtatcttggcggggaacgggccccaatttgggacgcgaatgcgcgcggcagtttcttcggcttaacccgccagcatacacgagcacacatggttcgcgcggcacttgagggcatcgtttataacctgtatatggtgatgttgatgatcgaaggcattactggcaaacctcgcgccattcaagcgacaggcgggttcgcccgcagcgcattatggcggcaaatgctggccgatgtgtttgaacaggaggtcaatattcctgaaagttttgaaagttcagcactgggagccgtggtgatcgggatgaaatcgctagggttgattgatgatctcagtgtcgtcaaggatatgattggcgtcaccaacacacacgaaccgaatgaagctaatttccaggcttatcgggaattgttgccaatctggattcggctaacgcgcaagctaggcagcgagtatcaggcgattgccgattatcaacgcgcgcatccggatccgagggcacgtagcaaagaacaggattaatcaggcatataaaattaggcgacagacgcaaacgatcacaaaagcggctgccactttttatcgatagttttgtaagcggtttctataagcgcgggcatatgctcaaattaacgcgttcggcgacttctaaccgcgccgattcatgtcaaggaggactgaacatggatttacttgtcttggttctaggcattctattactgttggtgttgattattaagtttaagttcaacacttatgtttctctgataataacagctgttgttgtggcgctggggctggggatggcgccggctaagatcgccacgagtattcaaaccggtattggctcgcaattaggtgagcttgcgctggtctttggttttggtgcgatgctgggacggctggttgccgacgccggtggtgcttatcgcatcgcccacacgctgattaacgcgttcggacgccggggtcttcaattagcggtggttttggcttctttcatcatcggcattgctttgttttttgaagtcgggatcgttttgctggttccgatcgtctttgccattgctgccgaagccggtgtcccgattttgacacttggcattccgatggcagccgccttgtcggttacgcacggcttcctaccgccgcacccggcaccgacagccatttcgacagcgctgggtgcttcagctggactggtgctggcatatggggtcatcattgcagtcccaacggtctacattgccggcccgctattttccaaacttgcccatcggctggttccggatgcttttgaacggcgtggcaatttaaaagcgttgggcccgcaaaaaaccttcaagcttgatgaaactccgggcttcggtatctcggttttgacctcgctgtttccggttatcctgatggccattgcaacggtctatgaactggttctgcatggcggcaaaacgccaaaaacaccgacaggcatggacaatctgatcgtctttatcggatcaccgagcattgcgatgctaatctcacttctgttcgctatgtgggccatgggttatgcccgcaagctaccagccaaggatatcatggctacgctggaagatgcggtgaagtccattgcgatgctgctgctcgttatcggtggcggcggtgcgtttaagcaagtcttaattgatggcggcgttggtgattccgtgaaaaatctattcgtctcatcgtccatttcgccactgattcttggctggttaattgctgtggttttgcgaatcgccttgggctcggcaaccgttgctgccatgaccgcctctggactggtgttgcctctgatgcaaagcgccggcatccaaccggcgttgatggtgctggcaattggcgcaggatcattggcagccagccacgtcaacgatgccggattctggatgttccgtgaatattttgacctcaccattaagcaaaccctgctgacatggaccttgttggaaacaattatctcggttgttggactgggtggcgtgcttttgttgagtttgtttgtttaaaggcaaaaatattaaaaagtcgacgatacgtcggcttttttgcgtttacaagctgaagccgatcgtcgcagtcagccgctcaatatgataaacttacgccattcacaaatacagaaatggagatctttaacttatgtacgaaccaaccaaaaaacgccgtgttgccgaagatgttgccaaggtttttcccgaagaagtaacgaatcagctttttgatgtcattgccgtgatgcaaaaggccaagcaactagtgacggcgccggtggcgattgccttttcggatgattataccgatgacgaaatgtatgccatgattattcaaggtaacctggcgcctgcgcaggaatttccgttgacctataaaggggacaagccgtttttggggcatggctatattcttgtggtgaaagataagccgaagacgattcggattgactttagtgccgcaaatccgtttaaagcagataaaactaaataaaactggccttttcatgaaaacttaggtaaaatagtagatcgtaatcgttaccgtctacgattgggaggcagctatgagcgaaccaattttgtctgtgaagcaccttagttttggatttcgcgatcaacagctttatcgcgacctgagttttcatttggatgtcggctcgataacgagcttggttgggccgaatggggtggggaagaccacgctgattcgcctgttgatggcacagttaaagccgcaagccggcacgattcagtttcgcaagcagccaccggttcgactgggctatgtaccacaatttcgcaatgtcgacgaagaattcccgctgtcaatccgcagctttattcagttgcggcagctggaccatcttttcttttggcatacgcctaaggaaaaagcggcgctgaaccgggttatcaaagcgacccacttaacgcatattgctgacacgcggctcgggatggcgagtggcggtgaaaagcagaaggcctatttagcccaggcgctgttggacgatcccaactttttgattcttgatgaatcgacggcgagcctggatgtgaataccaagcatgagttgatggatctggtccaggagctgaacgagacccagaagttaacggtgttgttcgtgacgcatgacttgagcctagcgaagcaatataccaaacaatatttgctgttgactggcgatcgttacgaaatgaagccaactgccgaaatggatctggcttcaatgccggaagagttgcgcaatgatgccgagaatcgcggggtgatcgcatgaatttatttgcttatgccttcatgcaaaatgcttttatggctagcacgtttattgctatcacgaccggtattgtcggcgtctttgtggttgcccgtaacatgtccttcctggcgcacaccttgtctgaggtgggctttgccggtgccgcatttgcggtgtttgccggcattagaccgcttgacgggatgttgatgtttacagccattagcagtatcagtgtcggccgcatgtcggttcaggcctcacgccgggaagcgtcgattagcgcggtttcgagcttgttcatcggcttgggcattttgtttttatcgctttcgagtgccaatgctagctatgcgacgacgattctgttcggtagcattatcggcatttcgcgcagtgacgtttggcagctggttgcgttggctgctggcgttttgtttacgttgtattttgggtatcgccgcctagcatttgattcatttgatccggtgggctctgccgcgcaggggttgaaaagtaaatacatttccatttactttctactcattctcgcggtgtcggtttcgatcggcgcgcagatcgtcggtagtttgctagtattcattttactcacgctgccgcctaatgttgccaagtatctgggaagaaccctgccgcagatgattgtgatttccgtcatcacggccctaatcggagtctggagcggcctttacctggggttcctgacgaactggccagtgacgttcttcattgccgccattgagtttatcttttatttcctggcgctgtggtatcaccaccagacaaattgattgaatcgtaggaatgaggctgggtcataattcacagccagactaaaaaagatgaacatactcttgtcgttattgagagtatgttcatcttttgtttctatggggtaattcggtgaggttatttaagatatgagtgccaaagcggagcaatcgtaggccagagggggctcagtggtgagattgtactagccgggcggtcttcccggcgtagtacaaggccgagctttgagactcagccgggtttgctgaggctcaaagtcgtgcccaccacgttccagccccctctggccggagattgcggagtttggcacggcttgaaacttattgcctaagctttttttattgttcggaattcactaatctaagagcgttctcgtaaaattatgacttagcctcattttcctgttaatctaaattccactagtgccgctcacgctgctggcgcaaaaattcagcgacctctgcccgatagtggtgggattggtcaaactgggcaaggtaggcggcatcgtgggtgcttgtcgcgccagtgtgccgcaacttggtgtaaacctccagataaggcagttgggcttccttggccaccgccaattcggccgagacgtcataggaaacctgccgtaagttcagattggtgatggcgccgttgctgagttccaataatgcgtaatctgcatagctggtggtttgcaacttggcgcgcggtgaataggcttggccaatcgaaccgggattgagaataacctgaccgctgctggtatagcgcagcaattgctgatgggtgtgcccataaatcgcaatgtcgatatcttgactcggagcaatctggtcaaagtttgcctgtggttggtcggggtataagcgatgaccgtgattagagtctggcagattgtgggccaggctgatcacgaggccatcttgttcaaaaacgtcatgcagcggccaatgacggatggtcgtcaacatgtcggccgtcagctgcggccacagatacgccactaagcgactgaagtagacatcggtgggttgcgccaagtcgaccggaccatctaaaacccagaataagtcgtcatcccagtttcctttaacaagatgggtcagtggcaaggcatgcaaatcgtgccagaggttggctgctcctgggcctggtaagaatagatcgccaagaaaccagtattcatctggatgatgtgcctgggcgtctttaataaccgccgaaaaggcagtcatattgccgtgaatatctgataaaatggcgattttggtcatgcttcatcccaccgttcgttcatcgtgactaatccttgcgtgcctaaatcacctttgcctgctgctaccattttggcataaagatcttcggccaattcggttgccggtaactgtaaatgcattttcttggcttcgtctaacgcaatgcggaggtctttgagaaaatgcttggcgaaaaagcctggcgtgtaatcggcttgcagcatgcgaggaccgtaattactgagactccagttcgccgcggcgccactgccgacgactttcaggatttcattcagatccagtccggcagctttcccatagacgagcatttcgctcaatccggtcatcgtgccggcaatcataatttgattggccattttggcatgctgcccggaaccggccggaccaaaataattgacggatgatgcgatcggtgcaaacagctctttgagtttcggcagtaagtctttttgaccgccgatcatgatggtgagagtgccttttttagcgccgatgtccccaccggaaacgggtgcatcaatggcaatgacgcctttttctttggctttttcggcaatttgcttggccagtgtcggggtgctggtggtcatgtcaatcaccaagtcaccggcctgagtaccggccagaatgccatcgcaaccaaaatagactgcttcgacatcttgcgggaagccgaccatcgacatgacaacatgacattgtgcggcaacggcatggggcgactctgcccagaccgcgcctgcatctaagaccgcttgcgcatgggtcttagtgcgattgtaaacgatgacttcctgaccggctttaagaaaattcttgatgatcccggtgcccatcacaccagtgccaataaatccaagtttcaaaggactcatcctttctgtaaaagttcttccaattccgttaaacgcttttcaaacatcgaaaatgccgcttccagatagtccggtttggtcatatcgacgccagcggttttcatggtatcgatggcgtattgcgagctacctgactttaaatagtccaagtagcgggacgcggcgttgggttcaccgctactaatgcccgcggctagcgttgatgctgcggcaaatccggttgcatactgatagacataataattgtaatagaaatgcgggattcgtgcccattcgaaggcaatttcgggatcgcgggcaacatccggtccataataccgggcattgagatcggcgtagtaagtcgccatgctggttgccgtgagtggctcgccttgttggtcctgttgatgaatccagtgttcaaattcggcaaattgcgtctggcggaaaacggtgcctttgaacccatcgagatagtaattcaggatgtaggcacgtactttgggatcatccgtatgggtcaggaagtaatcggtaagcagattttcgttagtggttgaagcaatttcggcaacaaaaatcggatagtccccatacacataaggctgattgtgacgcgtgtaccagctgtgaacgctgtggccggtttcgtgaatcaaagtataaagctcatccaccgcgtcatgccagttcagcaaaataaacggattcgtatcgtaagacccgcctgaataggcgccggagcgtttgcctttattttcgacgacatcaatgtagcggttatcgaaaatttcccggacatggctgagataatcatcgccaagtggcgccaaggcctttaatgcttcggctttggcctggtcaagcgtgaacgtcaatggcggcttgcccgtcaacggggtgtaaatgtcatacatgtgcagttgatcgacgcccaagacttttttccgcaatgcgacataacgatgcaaaagtggcagatgggtgttgacctggtcgatgagggtcgtataaacactttccggaatgtggttgcttgccattgccgccgcgcgggcattggcgtaatgatgggctttggcattgaaattgtgcgccttgacctggccgctcagcgtttgagcaaacgtgttcttcatgctttcgtaagcacgcagtaacgtttcaaaggcttctttgcgcaattttcgctgagttgagcgaatcagctggccatacaagccgttactgagctggaccgtttcgccgtcttcattttcgacaaaaccgaattgcaggtcggagttgtctaggacgttgaaagtggcatgactggcgttcagcgcatcaccggcactggcaatcagagcttccgatgcggttgtcagcacatgttggcgattgacggtgatcgcatcaataaaatgcccaaacggcttaagactttcagtgtcgcgccatgctgccagcttgtcggccggaattgccagaatttccggatccaaaaaggctaactgactggccagcccggcgccgagactttcagccttggcattcatcgcctgataagtggcgttgccagtatcctgatcgcttttcaggcttgaataaacatagactttctcaaatcgtcgaaagactgctaaaaccgccttgatgccggtgatgagcgcagcggctgaattgcctaacgttcccttgagcgcagccgcctctttggcctgttcgcggacagcttcaaagtcggctgtccacgccgcatcatttggataaatggtggttagatcccatgtcagcttggttgggacatcttcacgtaccggtaaatgttgcatctgatcagctccaatttctaatatttctttaatgttaccatatcacgctgatttttgagctaaatcccttctttcttcataattatctgctacactaccgtagaaactaaaactggagtgaagaagtaatgtctaagcaacaagattcaaatctgcgaacgacacatgataaacctaagcggcgccatccgattcttcgggcagtggtcgtcatcgcgctcgtggcgttattccttgcgggcggctatgcggccagattctactcccaagcgaagaaagccgtggcgaaaacttacgatcccgtcagcaccaaggccgttgactctgaccttgatggcaaaaagcccatcagtattctcctgatgggaaccgataccggcgcttttggtcgtaaagataccggtcgatccgataccctcatgttagtgaccattaatcctaaagaaaagaaaacaacgatggtcagcattccgcgtgataccctggcagaaatggtggggactggcaacgactcttcaacctatgaaaagatcaatgcagcgtactcttatggcaaatcaagcgcagctatcaaaaccgttgaaaagttgttgaatgttccaattaattattacgtgacggttaatatggaaggcctgcaaaagattgtcgatgctgtcggcggtgtggacgtcaacgtaccatttacctggacagacgccaacaccggtggtcagacgttcaagaaaggcaaagcccatctcaatggcgaactggcacttgcttacgcgcggatgcgtgacgaagatccggaaggtgactatggccggcagaagcggcaacaggaagtcatcaatcaaattgtcaagcatctgttgtcagttaagtcgttgaccaattatcagaaggtcatggattccttatcttccagcatgcggacgaatctgacgtttgatgacatgatggcgattgcccaaaattaccgggcttcagcgggcactatcgaacgtaagcaacttcgaggtatcggtgtttacattgataatgctgcctatcaggttatgaagaccgatacgcttcagaaaacgtcagacgaactgcgtgaacaactaggtttacaaagcgaaaagctaagtaacttcaatacccggcaaaatgaaattaacaatgcggccggttttgactggaccgccaacaatccggtttatacggtttcgcttgacggtgccactactgggccgtgatgttctgagatatttagtgtctcaaacctaggcataaccgaaaaaagacgaaagaattctcaaatcgcagtttgcgatggcgagaattctttcgcctttttgtttctgcatcgaggcgggcaagccagcgcggcaagcatcgtcccttttacactcctttggttcatatacagcaaggttagtctggatcaggcaggtcaggtgccaattttgccccgctaaacttggcagcaatgaagccgcagataaacccgatgaggaggaatggtacaaagtccatgccaatgccaaacaaggggatgaaggttgaagcaaaatgttgaatggcggcaaagaaaggcaattgcgccaaaccggcaggcagcgcgtgaatggcatcgagtaaggccggaatcatggtaaaggcgatagttgtcttatagatgcgggtattcttgccgatccacggatgaagcaggcctaacatgatcaaggcaatggccaatggataaagcagcatcaagattggcgtggagtaagcaataatctgatccagcccgaaattagcgatgaaaaacgccccaatcgtcgtgatcggtaaaaagaaatggtaacccagtttcgggaagcgatggccaaggtcctgggagaaggaagtgaccaagccgatcgcggttgtcaggcaggccagtaaggtcatggcaccaagcaaggcggttccgatgagcccagtataatgggtcatgatttgattaaaggcggtcccgccatttgcggttaatttagcaaagccaaggctgatggcgcctaacatgatgagtagcaagtagatgaccgcctcgagccccatcgccaaagaaccaactttcgcaaccgctttggcccgactggaagcccgatgcagccccatgagtttgagggcggtaataatcgtcaccccaaagcctaagcctgctaatgcgtccatcgtgttgtaaccctgcaaaaagccattaacaagattgccactgattaagttggcgttaccggtaaagctaatggtccgaatgtcacctttgatcaaaagtgcccagaagaaaatgaaggctaataaaatcaagaaaagtggatttagcagtttgccaatataggtggtaattttgctttcattccgggcaagaagaaaggttgtcaggaagaaaatgaacgaaaagatcagtaagccgatttgttgctggccttttcccaaaaaaggcgaaattccaatcgcgtaagtaaccgtggccgtccgtggcgaggcgatgagtaagccaaggctagcgtgggtcgcaagcaggaagaacaaggcgaatccatgacctgccggacgagctagatcgtacatactactcgcacgggtgaggctgatagccataatggacagaagcggcagtaacaccgctgataacaaaaagccaatggcggcaggtagccaggcacttccggctagctggcccatgtgaatcgggaaaatcagatttccggctccaaagaacatcccgaacaacagggagccaagggtaaggtactggcgtttggtaagtttgggttgtgttgacattgagaatccctccattttataaacgattgcaatcgcgacactgactgcaagtagcttattgaggcgggcatgtggcgcattgcccataacgcgctccccggcgtagaagcctgctcgcgctcacatcaaaaaaacgcccttaacagtcagaactgttaagggcgcggatcacgctgtaccaccttactttaccgccaacgtcaccgtcagcggcctcgccgcgtacggccggattcccggcgatacgcgattgctgtaatgggcgcaatcccagccactactcccgaagtcgcaatggcaactcgtagactactttccaccaggcaatcagaggtctctttccaccaaccgagactcgctgacactgacaacctgggtactcttctactcatcgtttttgaacatttgttgaattgaaacttattttacaaagaaatcggtgaatgtcaagaattttaattttaaaatcgtaagaaatgtatgggagtgactttttggaaggcataaaaaaacctcctcaggcttgtgaagaggtttaccgaactgatgaattagccaacaacttcaacggttgctgacatcacacctgctgaaggaatctgggagttaggcatcgcgacgtccagttggttagggttgcctgccgcaaaactaccggtgtcattaacggttcgataccaaactgtaccatcagacaaggtgatcttcagacgtgtgcctttagggaagaccgaaagattggcagcaacgccatcgtatcccatgtttgagccgaggacagcaggatcgtagaagcttaacttgaaggttcccttattggtcgttgtctgggttgtttgtgcagtgctcgttgatgctgcacttgccgcagcagcgttagcagccgcttgggatgcttgtgcctgagcctgttgctcttgagctgctttttcggcagctgcctgatctgcagccgctttttcagctgctgctttttcggcagcggcttgttcttcggcagccttggcagcagccgctttttgatcagcaatttgatgtgctgcttcggcaatatcatttgtgccgactgtgatggtattttcattcttaggattgatcagtgaatatgcattcgcctgttcaaccttagcctcgttgcttaacacaattgacttagcgctgactttactgttgtcactatcagatgtggcatgatcggcaatcgcttcaaccttttgtgaatgattgcttgccattcctaacaaaggtgccacgctgagtaacgtaatgatcgataatttaatttgcttagtaaagataaaaattcactcctatattttgaatagccgtcgttttgttcccccgagaacacaaacgaagtatataggtgtggtgtgtcaataaaataccagcatcattacaaaaatagctaaattggtaatattgttacgctgacgtaacaaacggaatgttaaattttttcgtaacaatcactgaacatttttcgaaaaagtgggttcaacccttgaagattctatgatttgcgaccattttctaccacaatttgtgaatttttccaaaatttatgggagcctaaacttttagcaatcgggaaatgatatgctaaattcacggctaaaaagtcaaaatcgtgaccttttatcgagggtggtcaagaccaaattgcgggttattcacttgtaaaaatcgataattggacagtaaatgttcttccataaacgcgttcgcgtggccagaaacctgcacataaggaccttggtcgcaatggccaaagaccggccatcacgcccaaggccacttatgctccggtttctaaccggccacgcttacgctcttccttgaaagtcatttaacgcggttttcaagaatcaggtataataaggcgagacaagtggggaggtttgtgcggtggcaatgtatcgggaaaagcgttttgaggagatcaaaagactgctggcggtccgtaatgaactgagtattgacgatattatgaaagcagttggcgtttctcgcgacacagcgcgccgggacattgtagccttggatgctcaaggaattgcccgccgaacccgtggtggcttggtatcgttaaacttcggccacagtattcccagctactcggctcgattaaaacggttttcgacccaaaagacgaaaatggctaaggcagcattatcgctgatcaaaccgggcggcgtttatttcattgatgactcgaccacgctgttgaaattgtcacagtccattcggcatccggtcacggtttatacgcacagcctcgacaatgccattgccctttcagtagaagaacaggttaacttacatctttttggcggcaagcttgaccaccacgcgcggttcttctttgagccgaccatgctggaaactttgcgccggattgcttttgatgccgcgtttatcggcgcaacggcgattgccgaagacggcgtgtatttttcctatatggaagatgcacaggttaaacaagcagcagcgttatcggcgcgtcaggtggtcgtagtgtctgaaaccgaaaagttccagattgaagcgccttatcgcggattggaacttggacagattagcacgctgattacggacaagaaattatcagcaccgcaaaaacgctggttcgccccacaaacaaatttcatcgttggcagctgagcagtacttagcaaaaaaggatttgatacgtattcaacttaagcaaacagcctatcagcaacggattcacgaggaggtggcgtcatgacaacgccgcttgtgacgattattgtgccggtttataaccttgaggcatatgtggcgcatggtttacaaagcctcttggcccaaacttattcccatttacagatcattgtgattgatgatgcttccgacgatcggtcaccgcagatcgtgagccattttgcccagctggataaccgaattcatgctattttaaaatcggttaaccaaggcgtctcggcagcgcgtaacagcggactggcgcaggcccggggtgagctgatcgcattcatggatggcgatgactggtatgagccggacttcattgcccatgccgttaaaatgatgaatcaaggatgggatctcattgcaatgccgtttttccgggatgatcctgacccaaaaccggtacgatcggggttacgcaaggcaaaacaactgacgcgcgaaggcctgattcggcagatgctgcatccagtgggttatattcgtggttatctatggaacaaagtttttcgccgtgacgttattgaacgaatgcagttgcgcttcgacgagcaaatgtccattatggaagacgaactatttacggcaacttacgtgatggcaacgcaccatttcctatataccggccatccggcttatcaccatgtggtccggcgcgattcagccactcagtccttgggcgttttcggtgcgattccccaacaactgtatgctttatggcgcattcatcgcgttttgcgccacgcacgccgccgtgccaaagcaaataagaaggaaaccgttaaaattgatcattgatcaggaggatcatggactttggcagaaaatttaatgactttcccgcaattgaaacaagcagccaagaaacaactgaagacgggaacgaatcgtcgggatcttatgctggcgtatttgttgccgagcttgttgcaggccgcggcgacgattaccgtttatttgatgatccaggcggtggtgcaaggcttcggtgccgaaaaagtactcaccgatccgaccggttttcaggcctactacgcccaaagcagtaatgacagcggcatggtgaataccattcaaagccttgtggtgacgatgttggcccaaggtgttaactttgcggtgctggatctcgtccgcaaccatgaacgtgtacggccgcttcaagctgtgttaggtctgtttaacggtaaatggttttggggttccatttcattgtggatctttatgtgttttctgacactcatcgggttttctttcctgatctttcccgggatcatgttagccctgggatggcggcaggcgttttgggtctttaaagatgggcacgaagccgatcaacggttttcgtccatcacggcattaatcggatcgtggcgcctcatgaaaggctttaaatcagatttactgggcttgtacctctcaatgattggctggtatttgttggaaaatgccacgttccatctcttcgactgggcgattaatccttatttgcagctggttcacgcgaattactacgaaaatcgccgggcatacaaaatggcggccttgcaccgcaatggttctgacgtgcacttttagcacaggcagggtatactgacatcgattgaagacggagtcaggaattgcgtggtgctaaaagaagaaggttggcgctgttattatggaaaccgaagcatatatgaccttggcagaagtcaaaaagcggcaggccagtttaaaagataaaatgccgcttgaccaggcaattgccgaaaatattcaaaactgggcacagtggctgctagacgaaggatttgaaggcagctacttcactgccaaactaaacgggaatgcgattatgattagcgatctcgatggtcggcaagtcgcaaccatcacgaccgatgcgtctagttatgtcgatgcgttcaagcagtcagatagaatgacgatgctgacagttcaaagcaagttgcgccggctgattgaccagcacggcattaaaacgcagtgagcatgagtgagtcgtagcgactgactgtgcgaaaacaaaatgaaggacgaatggatttccacattgtgtgggaaatctcattcgtcctttttggtgttgacgatttgctgcgtcagttttcaattaacggaaataaagaaggattcaacagaaaccttagacgttgtcgcttgcctcaatcttgtgatcgttgaaggcggatccccaagcggccatggcttcaataaccggtgttaaggatcgcccaaatgaagttaagctgtattccatcgaacggttgtcactaacggtacctatttttttcacgataagatgatcagcttccagttgtgccagctgcagtgccaacattcgttcggtaacggatgggatcgcgcgattaagcgtgctaaaacgtgtcgcgtcacctctcaaaagatgatataaaatgacgctcttccattttccggaaatgaattggaccgtgctttggacgggacaaccgtcagcgcaatcataaacttcgcgtgccatagagaggacttccttcgagttaaaatgacttacatttttctcacttacattaatatagtgctaatcgtatcataatgtttgcaaggacaacagggggtcagacaaaaaaactgattgatcgtttggcgaattatcagcttcggtagcgactatcggcagacgcttccttttgtccctgcgatcccgggataggtcattaacgaatggataagcacacggaggttataaaatgtttaacaatcaaattgtagctgctttaaaaaaaacggcggtcgatttaccaactgggcagatcggtcacgacgccgacgaatgatattgtcaagatagcgcaagatgccatcattgaatcaccaacggcctttaatggccagacagtgaaagcgatttttctctttgatgagcatcacgaacacttatgggacctgacagctgaacgtttgcgctcagaggttccatcagatgaggcttaccaagcaacgttgaagaaactaaatagttttaaggctgcatttggaaccattttgttttttgaagacagtgcaacagtccggcaagaagagaaggattatccactttaccgcgacaactttcaagattgggctgaacaagctcagggaggggcgcaacaggcggtctgggtcgcgcttgctttgaataatatcggtgccagtttacaacactataatcctttgattgacgagcaagtacgcgaagcttttgcagtccccgccgaatgggtgctccgggctgaaatgccattcggatccattgaggcgcctgcgggggaaaagtcttatttaccgcgggagaaacgctttgtggtatttcaacataaggctgtttgagaaagcaggggcgcatacatgccagaagaatcacgcgctgtgatcattatttttggaggatcaggggatctagcttcgcgtaaactatatcccgcattatttaatctttatcgccgcggcgtgttggctggacattttgccgtgatcgggactgcccgacgaccatggagcgatgaacattaccatgaggtggttgaaaccgcgattgccgggcttaacccggagccggcgcaagcacacgcgtttgcccaacatttcttttatcaaagccatgatgtcaccgatgcggatcattacatcacgctaaaaaatctggcggctaagttggatgatcagtttgcgacgggtggcaaccgggtcttttacatggcgatggcaccggacttcttcgaaaccattgccagccatctcaagtccgaacatttgttgacagatgtcgggtttaatcggctcattatcgaaaaaccgtttggccatgactacgccagcgccaaagaactgaatgactcgttaacggcaacgtttgacgatgatcagatcttccggattgatcattacttaggcaaagagatgattcagaatcctttggcgtttcggtttgacaatacgatttttgaaggcatctggaataagaagtatatcgacaacattcaaattacgttggcagaagcggt

SEQ ID NO: 295 - DNA, 5342 bp, Lactobacillus casei
gcgtttgacgcgcaaatcgacgcagctgacactgaccttcaagccagtcgctgcgccgttgttcggccaatccgccgacagcaaaccggacaccttgaccatttatatcgagccaagtgaaggctattcgttacagctaaacggcaaggcgttgggaactggcctcaccattgaaccggatgaattgcgttaccgtcatgatccaaaggcagcggctgcagcaccagaggcttatgaacggttgatcaacaacgtgttggaaggcgatcagaccaattttacccattggtccgaattgtcggcttcgtggcacctcattgacgccattcaggcagcctggtcacaagaaccgaacatgccaacgtatccggccgcaaccatgggaccagaggcagcgtttgatttgttgtcgcgcgacggtcgcgaatggttctggcaaccgcatcgtgttcaaatggctgattaagatggctattaagaggtggaaggcattaatagctttgattccgatttaacgaattgctgggaagtgcacctaaactaaaaaacatcgtcaagcccagcttagggtctgacgatgttttttaattaggaaatagcgtgtatcagaaaatcttcatccgatttagcggccaataccgccaaacaacgactgattgaatcttggacttatcaacaaagccaaaatcacgactgtcgtgggaaaccaaacgattgtcgcccatgacgaaatattttccggcggggactttggctgatttggttgacgaaagtgtcttgatattgaaatcattggtgaacttaatactggacggatccagtccctgttgactggcccatttattaatttcatcacgtgaaaacttatgattcaaatagggttcggcaattgccttgccattaacatacagtttgtcgtttttggaactcaccgtatcgcctggcatcccgataacccgcttgatgtaaagcgactttggccgatcaggcgcattgatcacgacaatatcgttgcgtttaggtttcttgatccgaacggaatataaccgttcattattctccaatgtcggttgcattgacgtgccctgcaccacatctttgcttaagacgtaacgcatcagcagctgggacgcgaagaaaataacgacgaaaagaagcagaaactcaaggatcgttcttaaggcggattgattgttatttttcaaaatgacaccttccggtacagattaaccttagtctaccacaagcgttctatccacgactagaaagttcgtctttcaatcatacttcgggaaaaagccgcttttttctgcttgccgacatagatcaacaatctgggcgtattcagctagcatcaagcaccagcgatgcggcaggcttgtgtaaccataggccaagcctgctaagccgccggtcaacgcggccgcggtatcagtcgcaccgccgagcatgagcgcatttaaaaccgcatcgtgataatccggccaggtttggagtgcgtgtaaggttcgggccagtaaacttagtggatctgtggcagtgccgtctggcgtctgagcctcgaattgtgtgttaaaggcggcaaaagcaggttgataagttggctgatcagcaaagtacgcgccggttttgttgatgccagtggtgatcgccgtgggtaagtcaggggcatcggcaagtagttcaattgcaatttgggtataaacggcagcagcgatcatattttcaggatccagattggtgagcgtgacgaaattttgaaatagtcggctgccttctgccttttcgaatagcttggtgtcaaaagtttggtaagcaaagaaggcaaagggcaatgtgcgaatcaaagcccctggttcgttaggcgccgctgtggcttttcccgtcgtcaaggtcgtttcgatactcggccaaatatcaggatttctttttccgtagggtgcgtactcgccgtttttgaaccaagcttggtaggcattgaccagtgcatcctggtcgaacccatgctgcaacgcatccagaccggccagggtgaggcctgtctcatctgagtaagtgccggctggctgattaaacgtgccatagcccttcatcccagtcaccggcgaagcggctaactcagcctgcgtttggcccttgaccggcagtcccaaagcatcaccgatagcaaagccgactgtggcgtgaatcaaacgtgattccatgatgcccattatttgtctcctccttatataagaaagcgcccattatgcatgtcgcaggcacagcatcagcggacgctatgtttgccagcgagatgcgtcatgggcagcaccgattaatcatagacatgaagttattatttccctagaaaagaagaaattgcaaaagatttgcctcgttgtaaaacaacagtggctgtgatagcctagcaagcagtagctattttcagaaagccagcctgccaattgtttgattaaggctttggtgtacggctagcaaggcagccaagcacgtcgcggtaagcacgattgagtgtgcccgtgatgcttggatttcaggaaaaagttgatccatttggcaagatgccctgcaatgagcaaaaggtgctgccggcattttagttggatcaatgacggttcatagattaaggagaacgcatgagtgttttaaccgtaaccgggttgtcacaacggtttttagataaagtgttatatcaagatgccagctttcaggtgaacatcgaggaccatcttggcgtgattggccaaaatggggttggcaaaagtacgttaatcaagattttaacgggagccttgacgccggatgccggtaaaatcgtctggcaaaaacacctacacgtcgggtacttagaccaatacgcgaacttggtgcctggccaaaccgtgatcgaatttttgcgtacagcctttgaggaactttatcgcaaagaagccaaaatgaatgagatttacgcagattatgcgacaaacccggacgatgcgctgttgacaaaagctggcgagctgcagcaggaactggaagctggcgatttttatgaactcgaaaccacgattcaaactgtggcggaaggtttaggcatcactgccatggggatggatcatccggttgacgcgctttctggtgggcagcgctcaaaattgattttggcaaaattactgcttgaaaaaccggacatgctcctactcgatgaaccgaccaattacctggacgtgtcgcacattgaatggctgaccgactggctccagaacttcgaaggagcctttattgttatttctcacgattttgatttcctcgaaaatgtgaccaacgcggttttggatattgagttcggccagatcacgaaatacaccggcactttgaaacaggccatgcgccaaaaggaagccgatcacgaaacttacctgaaggcatttgccaaacagcaggaaacgatcaagaaaaccgaagcattcattcgcaagttcaaggccgggacgcgcgccacaatggctaaaagtcgggaaaagcaactggcccgcatggataaattgacgccaccgggaactcgttctaaagcccacttggcgtttccttacctgccagtgaatcggcagattttggtcgatgtgaataacttggttgttggctatgatcaaccattgttgcagccaatcaatttttcagttgcaaaagatcagatcattgcgtttgaagggtttaatggggtcggtaaatcgacgttattaaaaacgatccttgggttaattccggccattagcggcagtgtcgaaattgccgacaacgtggtctttgggtattacgagcaggaactacattgggatcagcctaagcaaagtccggttcagtatttgcagcaacgtttcccggcgttaacccaaaaagttgtccgccaggtgctgtcgcgaactgctttgacaagtgaagaggccaataatccgttaaccatgctgtccggaggcgaacaagccaaagtcaaattggcagagctcatgttgcagaccaccaatattctgattgtggatgagccaaccaaccatttggacgatgacaccaagaacgcattgcgcaccggactacaacaatatcccggcgccgtcttgctcgtctcacatgaggcaggcttttatgatcgatcctgggtggatacggttgttaacgtggaacagttacaagttaaggcgtgattcaatttccgtctgaagcaaatcaactaggctaattttcgtgaaaaaaaggcgctaccgacaaaatggaattgtcggcagtgcctctttttggtgtttagttcgtattggaacgcgcagtggcatgttgaattgctaatgatccgaatgccaaaccagttgcgtataggtataagtgagatgatcagtgactggcatgtgggcattttcgtttccagtcagcgccttggaaagctggctggccgcctttacacccaggggcacggttagctcaggcaaaagatcgctaatcgttgtctgctcctcaagatgataagtcagcgtatgcgatttgaacggaatgtggtgggcacgtaaccagcgctcatagctggcaacgcgactagggtctgcctgataagcgaccggcacggtttggcctaaataagttagcgcgcgatccatcaaagcgtcagactgttcgctttgaaagttcaacacaacgctttgattagcccagtcggttaacaatgacagttcattggcctccagcgtgggcaactggctaacaaaaataagatcggcagcaggcagcgtttcgagctgatgccaatcggcggttatgaagttgaccgatgtagtcgaattggctgttagctgttgccttgcataagccagcatggcagaagaccagtcgattaacgtcagttgttggacatgcgcggcgaagcgagcggcatagtggccggtcccggcagcaaggtcaacgagtgacttagtcggcagcagcccttcagcgagcagccatgcggtgacatctcgagcaattggcaaacgtgacgctttctcggccgcggcgtagtcctcggcgaattgattccaaaaggcccgatcttctttcatgaaaagatatttcccctctgaaaatttttttgaaaaagtagttgacttaaacggagaacctgcgtagtatattacgagttgtcagtcatcaaaatagtttaaaccgcacagcgatttaaaaaaagatgttgacaaaggattgccaatttgatattctaattaagttgtcgcttggcaacaaagtcgtcctttgaaaactgaacaaagtttcgtttaaatgtgcagggtccttgatacttcggtatcgaggcaaaaagtaacatttgcgaagtc

SEQ ID NO: 296 - DNA, 208435 bp, Lactobacillus casei
ctgttcccatgccgaacacagaagttaagcttcttcacgccgagagtagttggtgggaaactgcctgcgagggtaggaagctgccacgctaagataagatccggtcatattgactgggtctttttttgatgagcgtgagccagcccggttagaaaccggagcataagtgggcctgagttcgttggccgggttttggccaatggactcagggtccttatgtgcaggtttctgggctggcgagcgcgttatagaacgcggaaatctgaactcacacttgccaaccatagaacaggtcttccattgagactctttgccattgcgaccgaggtccttacacgcaggtttctgcgactgggagcgcgttatagaaagcgaaagtcagatttcacgtttgccaataatagaacaaactcccaattgatatttgtttaaagccacttacacgcagacttctgcgccagtgagcgcgttaagaaagcagaagtaggaatttcaaacctgccttaaacagaacaaaattcataactctccacaaacggaaaatcaaaaaataatcttgaaacaacagtaccatgcgtgctacattgcagaagcaagcggaaaagggggccataaaatgccagtgaatgcgacgaaagagacactaaaggagttgaccgctactggaacggtggttgtcgacttttgggcgccgtggtgtgggccttgtaaggtggttgatccgattttaagtgcgcttgaaaaagaactgtcagggctaaaagtagtgcgctataacgtggaggcggatgcttcggtgccgcaaacgttgagaatcatgacagtaccgacaatagtagtctatcaacagggacaaccaaaagaaaaagtgagcggcgtttatgctaaagaaaaactgaaacgttactttgaaaagaaattagaggcagcgcgatgacacacttagttgaacaagcgcaaatgcagaccccaaatcgtgtcttagctacctgccttttagccgggcgaattatgatcgaaggcggttcggaaatgtatcgggtggaagacacgatgcgccgaatcgcttttaacgctggtcaaccgcaaacgttggtgttcacgacgccaactgggatttttgccagcatcgaaaatcaaccgtatattcaggaacggccgattagcaaacgctcgattgatatggaaaaagtctcccgggtgaatcagctttcccgatcgtttgctgacaaagaaattgacttggatgcattatatgcggcactgcttaaattggatcagaatacgcccttctttccaatttggtggcaagttatcggtgcggccgttgtcagtttgaccttaatggttttatttgcgcaaaaatacaactggtttgatatgcccttggcggcgttggttggcgcacttggtttttgggtgaatatcaaggtgaatgccttaacgaatattcgctttatcagtgaattactcggcgctttggttgtcggattaacggcctggatcggtgttaaattagggttaggtcatgatctggatgacattatcatcggtgcgattatgccgctggtgccgggtgtggcgattaccaattcgatccgggatatgttggccgggcacctgttgtccggcatggcgcggggcatggaagcgatcttaagcgcctgtgccattggtgttgggattgccattattttccggttcttttagtgaaggaggcagtgctcttgccgtggtttgttgcgttattgatccagctatcttttagttatttagcaaccgttgcgtttgcggtgattatcaatgttccgcgcaaggcactgaatcttgctggttgggctggcatgatgggctggctggcatactggctattgatggaggcaggtattggccggatgatggctaacttgaccggtgcctttgtcattggggtgtgcggcatcttctttgcgcgttataaaaaaatgcctgtcattatcttcaacatcccgggatttgtcccattggtgccaggtgccgttgcctatcaggcggttcgcgcggtggtgatggggcaactggatagcgctttacaatatgtcagtcgcgtgatcatgattgccggtgcgattgcggtcggttttatgttggcgcaactcttgtcagaattgttgtataaacaggcagtcttaaagccgaaaaagtgatatactgtctctatgcgatgagtcgagtaagcacggttcttgtgctgaaagttgcagctgactggttaaaagccacccgccggattgtggggtcagcgatctcaaggttgtggagccagcgagatcctatccaagttaaattgggtactgtaaaaattggcagtcaagcttaatgcttggctgctttttttcgtttcacgccgttttggctgttttcactctgtttttttaaaatcaaaaaaagttccgaaatcattcacttattaacaaaattatgagaatgatccccttgattttagtgatatttcacattagggcagcgtctggaaaacgttaagatagcgacacatcagctgcttttgttaaacgtgcaaaaaattgaaaatttaagttgactttttgcgtgaatccaattagtattctaaccaatcattaattttaacaggagaaggcgattcaatgtcatctatgtgtatgtcatctaaaaagagcaatattcgtcaaagcatatgcttagtcttgttgttgatgccagggacccgacagtttgatcgttaatggtcagcgtatcgagccccgttttcgtattgacaatggggctgatacttggcacccattcgtcggaatgggtgcctttttgttaaagattaatgaaaatgctaaggatgttaaaaagggggaaccaaaatgaaaaagagcgttgtgaaagccttgattggcgccggggttgttgccatgtccatgctggcactgaccggttgtgcgaccaagagtgcggcgaataaaggaaatacggcgggtactacgattaagatcggcgtgaatatggaactgtccggtgccgtggctggttatggcgagcaggaaaagcaaggggtcgagctggcagttaagcagattaatgctgctggcggcgtgaaagttggtaacagcaagaaaaagctgacggcagtttatcgcgacaacaagtcgtcaaccagcggggcggcgtcggttgcggcgcagttggcaaataacgagaaggtcgttgctatcgttgggccggcgacgactaataacgggacggcttcgattccaaatatcaccaaagcggcagtgccgatggtggggccaagcgcaacggatcctaattttaccttgcagaaaaacggtcaggtgcagccttacgttttccgcgcctgtttcacggacactttccaggggcaaaaagccgcggtgtttgccgatgacacgttgaaagcaaaaaatgtggcaattattgccgacaactcaacggattatggcactggcttggctaaagcgtttaggaagaagtttaccggcaaggtcgtaaccacggaatattatcaatcaggcgataaagacttcaatgccatgttgacgaatattaaaaacaaaaaaatcgatgcgatttatgcgccgggttactattctgaactgggcctgttgattaaacaagcgcgtcagtccgggatcaaggtaccgatcattggggcagatggcatggccgatcctaaactggcgcagattgccggcaacgaaaatgcgaccgatgtttattacaccacgccattttcgacgttggctgccaatcgcagttcgctggttaagacgttcatgaataactatcaaaaacagtacaacgcgagtgcaccaacattttctgcgctggcctatgattcggtttacatgatcaagcaggccatcgaagatcaaaagtcagcggactcggcaagtatcgctaaggggctggcgaaaattaagaatatgcctggcgtgaccggtacaaccagtattgatagtaagcataatccggaaaagccgattgcagttgaagaactgacgcaaggcaagattacgaaggcctataccgttaaataggcgttttccacagttctgggaaggggggtactaactttgcagaccatgatgcaacaaatgatcaatggactttcactcggcagtatttatgccttgcttgcgctgggctacaccatggtctatgggatcatcaagttgatcaacttcgctcatggcgatatttatatgctcggcgcgttttggggttattacgcgattaattttttacacttagggtttgttggcgctttattatcggcgatggtgatggccagtctttcaggggttttaatcgagtatctggcgtatcggccattgcgtaattcaccgcggatcgccgctttgattaccgcgatcggcgtatcgtttttccttgaaaatggcatgtcgttcctttttggcgctaatgcccggaattttccgcaagtaatcaccaccaaaacttattatgtgttcggcgtgggaatttctaatgtgcaactgctgattttgtccacatcgttgctgctgatggtgttgttacaattcatcattaagcaaaccacgatggggaaggcgatgcgcgcggttgcggtggatccgcaggcggcgcaactggttgggatcaatccggatcacgttatctcgttcacctttgctttgggttcagccttggcaggagcggccggcgttatgatcgggctttattacaactcgatcgatcctttgatggggatggtgcccgggatcaaggcgtttgtcgcggcggttgtcggcggcattggctcagtgccgggtgcggcagtcggtggcttcctgatcggtctgctggaaaccggcgtgcaggccattggtttgtcggcttacaaggacgcggcggtttatctggttctgattttggtgctggttgttttgccggcgggcttgttcggcaaacgtcaacgggagaaggtgtgagcgcatgctaaaaaacttacgcagcaaattaatctggttggcgatcatggtcagcggttttgttctgatcaatgtcggggaattgaccggcgtgatcaacacctttatcgaaaatgccttggtgacagttggcattaatattattttggcagtcgggttaaacctgattatcgggttttcgggtcaattttcactggggcatgctggcttcatggccatcggtgcctacgcaacggcgattgtgacgcaaaatatggcgacaccgcttggcttttatctggcgatggcgctggggatggtgattgcgatcgtggcggcgttgattgtcggcattccgaccttgcgactgcgcggcgattatctggccattgcgaccatgggagcggcggaaattattcgcgtggtgattaacaatctgaaaatcaccaacggccctgccggtatgttcaacattccgccgctggcatcatggccaacggtttacatcttgatgtgcgtgacaacggtggtcatcgtcaactttattcatagtcgcgccgggcgtgcggtgatggcaattcgtgatgatgacattgcggccgaatcgatcggaattaacccgaccaaatggaaattggccgcgtttgtgttaggcgccgcgactgccgcgattggcggatcgttgcatgccagctatttgcaaaccattgcgccaggggactttggtattatgaattcgatctcactgctcattattgtggtgttgggtggtgtcggcagtatgactgggacgtttgtggcggcgattgtcttggggatcatcgacacggcgttacagaattttggcacgctccgtatggtgatttatgcactcgctttgattttgctgatggtcttcaagccgtccggactactgggacattacgaactttcttttgggcgtaaacggcgcgcgcgaaaggaggcagcatcctcatgacgaaccaacttgtaatcgatcatgtcagcaaagtgtttggtgggctgaaggcagtcgccgatgtaagtttgaccattgagcaaggtgcattaatcgcgttaatcggtcctaatggggctggcaagaccaccttgttcaacatgttgactggtgaatccgggccaacgactggaaaaataaccttaacgactgctaacggtgatgtcgacattaccaaaaagaaggcgtaccaagttgccaagttaggcgttgcccgaacctttcaaaacattcggttgttcggcgccatgtcagtgaaggaaaatgtgctggtggccagaacccatctgtaccacgaagattttctcggaacggttttacgcttgcctcaattttatcaacgggaacatgacgtcggcgcggcggctgatgagttactggacttttttgacctagctgatgtcgcagatgaacccacggcgagtttgccttatgggacccagcggcgcgttgaaattgttcgcgctgtcgctacgaagccacagttattatttttggacgagccagcagcggggatgaatccggaagaaacggctgatttgagtcggctgatcgcccgggtgcgggaacattttggcattaccgtggtgttgattgaacatgatatgtcgttggtgatgaatctggctgaatatatttatgtgttggatcacggcgcgatgattgccgagggtacaccgcaagtgattcaacgtgatccgcaagttattcgggcttacttgggaggtgacgtgcatgcttgaggtcaaagatctggtggtcaattatggcgggattcaggcggtcaaagacgtcagcttccgcgttcacaccggcgaaattgtggcgcttatcggggcgaatggtgcgggtaaaagtaccatcttgaaaactatctcaggcttgttgcggccgcgttccggcaccatcctatatgaagataaaaacattgtgggcatggcggccgctaaaatcgtaaaaatggggatctcgcaagtgccagagggccggcatatctttgctgggctgacggtcagcgaaaacttgcagatgggtgcgtttggtctcaaagacaagcaagctgccagcgaccagttggcggtggtttacgatcgttttccggttctaagggaacggctcaatcaggatgccgcaactctgtccggtggcgagcagcagatgctggcaatgggacgcgcgctcatggcacggccgaagcttcttttgctggatgagccatcgatgggcttatccccgattttcattcaggagatcttcgacatcattaccaaaatcaacgaacaaggcaccacggttttgttaatcgaacaaaatgccaagcaggcgctggcaattgcaaatcgcgggtatgttttggccagtgggacagtgaagttgaccggtacaggtgcggaattgctggcggatccagcggttcaggcaacttacctaggtgcgcagccggcgacttgagtggaaatcaaaattttaattgttttgaataggtggccatgagctgcttattttttggtcaaaaagcatggcttcagcaaccaggctggcgtagtatggaaaacgaatgtaatttttaaacgaagtcatcaaaacatctgttgtgaacgacatcaggaggatgaaaattgacattaaccgaacaccagcagtggctagttcacttttaccagaagcacaattggtacgcttatagtcccttcatccgacttaattttctgaccgaagaaaccggtgaattatcgcgggcgattcgggcgctggaaattggtcgcgatcatccgggggaaccggttaaaagtcagcatgccttggatgccaatttgaaagaagaattggcggatgttctcgatcaggttctgattctaagcgacaagttcggtattgatccggaaagtttgcttgaacaaagcgaacgaaagctgacgcagcggtttaagcgccatgcgtgaagcctgagtcttgccagctagtttagatcttttgtgaatcggatcgggtaactagcaaaaaacaggccaccgcatgaatgcgattgacctgctttttttatgcttcaattatcgcggcttgttcatcaaggattctgactgccgtcacgtggcgctgggccgacaccacggccgctaccgccttgtcctggacgaacgccttgttgatttggtgttgcgaccatgtattgactgattaaattaacaatttgcctgttttgcggcaagtcactgtggccggcctcgtcacccgaaacggtgatttgggtgtaatgggcgacctgattttggaaaatatacttccctgcctcgacactttcgatcggcacggtgccgtcaccatcgaggttttcggttccggcaatcgagtaaacggttagggtgctcggcagcttgtcccgactggtaatgaagtcgttcaacatctgggtgcggttgttagggttactttcttcaagattatatggcgtcccaatcgtcatgaggcgggtcatctgcacgtcggactcgttgtaatatttttcgagaaaaagcgtgaaaatgaggccgccgttactgtggccaatgccgcggaaacgattgaagttataggttttggccagctgcttgaaggcaatattaaaccacgctgcctgctttttgatgttgttgtagccgtccttgttattttcaaatgcgacaacaatgtacggctcggtgtcacgcgcagcgattttcccactataagtcagcgtgccatccgttttcaccgtaatcttcaggagactgtgaccattcgtctggttgttgagttgggtgattaaggtgttaaaacggtcttcagtcgccgagctcccgggaattaagatgatgggctgcatccgcgaattatggacgactcgtgccgatttgacgttttgggccatccatttggttgctgggaacacgactgctccgatggcaagaatgctgaaaagaataagcagccatctgcgccagtgtttaatcatgatgatcaccgactttcgctgattcaagactgacagtttcggccaaccggacaaacggcgcgtaaatcaacaccgagacgattaagcagatcacggccaccactaaggcaaccagattgccgttcgtgccaagaaacgctgccagcggtcccggcgtggtcgtcggcaccgtgtaaaccgaaggcggcatgagacgcagacgaatggcggcccaggcaattaccatgttgaccaaaggcgtgatcaaaaacggcactaatagaatcggattaagggttaccggccacccgatcatcacaggggaactaacattgaccaaacccggcagaagcgatagcccggcaatccgccgtaatggtttggatcttcctacccaaagtgtcgcaataatcagcgctaatgtcatgccgacgccgccaaagctggcaaacggatggtagatggtattcatggtgatcgggttaggcacgttgaacaaattagcgtgttccagcgcatagtttaagttcgccgtgccagtcgtacttcctgactgcaccattaacggattaatgggaccttcaattccgccccaccacataagcgcattgatcgttgtgaccaacgcaaggcgaagcgatacatgcggtatgttcgtggccggcacctggaaaacgacatagaaaagaccgataaaaccttctgttgacacaaaagtaagaccgtaagtgatcgcaacacaactaataaggatcagtacagtcaaccaagtgccccgcaaaccgcgactgattaggccggcgatggtgtaatgttgtgagggttcctcaaaatcggcgtgggtgaagcgaaataaccagccgatcagcaagccgaaaacaatggcgatgaataagccgcgatagccgaagttgttcatctggaacggcgattgagcattgcgctgtgcattaaaattcaaaattaaaaaagcaccgacactggtgagcgccgccagtgaatcatcttttttataagaacgggcaatatattttgcaacaaagaaggcagccataacggacatcaggtcaacggtcacggtttcaatgatcagcaacagcgtgcggatttggttgtaatgagggatgacattgtcgagattgtagatgaccgcaaaaaaaccattgcgtgaaaagacgcttagttctagcatctgggcccacgcgccgaccatgacaaacgggaaaatgacagcaaaagtttgctgaagtgcccgataaatccggttatgccgcaatcgaacactgtttgccacgagcatgggaagcaatctttgcatgagattgctcattactgccatctcccttaatttttatttgatgaagttctattaaggttattctaacaaatattaatgtgggcgagtagccttaagccggaatcttgacgagtttaacgatttgctgaaaaagtaggaatgagaacttattttccagcatgcaagggcttccgtaccatggtattcttaagttaggacagtaaacggaaacgcgttcgctggcgcagaaaccggagtgtaaggaccttggtcgcaatgaccaaaaccgggtcatcacgcccaaggccacttacactccggtttctaagcgcgccagctcacgctcttaatttttggaggcgtaaaaatgaataagaacgaaaaaccattggcaaagtatattgatcataccttattgaaaccggatgcaacgcaggacgagattgatgtcgttttggatcaggcaaagcagtatgattttgcctcggtttgcatcaatccttattgggttgcgcgggctgcggccagcttacacgatacggacgtcaacgtttgtaccgtgattggattcccgcttggcgccaacacaacgcagaccaaggtttttgaagccggtcaggcgcttgatgaaggcgcaaaagaagtcgacatggtcttgaacatcggcgagctaaaagcaggccatgatgaccatgttcgtgccgacattcaggccgttgcggatatgacccatgcaaaaggcggcttgttgaaagtcatcattgaagcagttctgttaaccgatgaggaaaaggtaacggcttgcaagttggcagctgctgccggcgctgattttgtcaagacgtcaactggctttgctgcgggcggggcaacggtgcatgatgttgcgcttatgcggcagacagttggcgataagttgggcgttaaagccgctggcggtattcactcctatgccgaagccaaagcgctgattgaagccggcgctgatcggctaggggcaagcgccggtgtgcagattttgaaggaagcgggggaggcatagtatggcatttgagcgagttattaccatcgttctagactcgattggcattggcgaagcgccggatgcagcaaagtttcatgatacaggcgccgatacacttggtcacattggtgattattttggtgggaaactagcgctgccgaacttgcaggcgatcgggctgggcaatatcgatcggagaacgccaattgctggggttggaccactgggaagtcccagcggctattttggcaagatggcggagatttctgctggtaaagatagtatggatggccattgggagatgatgggtctgccggtcactgaaccgcttggctattttcctaagggcttcccggctgacttgattaagcaaatcgaagacttttccgggcgcaaagtgattcttaataagccgtattccggcaccgaagccattaaggattatggtgagcagcagttgaaaaccggtgatctcattgtttatacgtccggtgattcagtgttgcagattgccgctcagaccgatgtgattccgcttgaagagttgtatcggatttgccgctatgtccgcagtattacgattgatgcgccatatcgaatcggccgggtcatcgctcggccatatgttggcaccgatccgacaaccttcacccgcaccagtgatcgccacgattatacgttgcagccggataagccgaccgatctcgatcggctgcaaggagctggcgtgccgacttatggtatcgggaaaatcaatgacattttctcgggacaaggcttagacgatggcgtgcacaccgtcagcaacacagacggcatggacaaaacgattgaagcggcgaaatctgaccgtaaaggctttatttttacgaatctggtcgacttcgatgccatgtatggtcaccggcgcaatgcccaaggtgatggcgaggcgttaatgacgtttgaccgccagctgggtgatttactgacggctttgcagcgcgacgatttactcatgatcacggccgaccacgggaacgacccgactttccgcgggacggatcatacgcgcgaatatgtaccattgttggcttacagtaagcaattcgttggcaatggtgatttgggtgtccgatcgccgtttgctgatttaggcgccacgattctcgacaatttcggcgtcagcggcaatcaggtcggccaatcatttctgagcttgttaaaataacacaacccagcgaaaggggatcaacaatgagtacacatattgcagctccaaaaggcgccatcgcggatatggtgttgttgccaggcgatccattgcgcgcccaatacattgccgagaactttttggaaaatgcgacgcgctacaacaccgttcgcaatgcgtttggcttcaccggaacgtttgaaggccggcgcgtgtcggttcaggcaacagggatgggcattccgtcgatttcgatttatgtcaacgagttgattcaggattatggcgtcaaaacgctgattcgcgtgggtacggccggcggaatgggcaaggacgtcaaggttcgtgatgtggtgttggcgcaaggctcatcgacagatagcagcatcattttgaatacctttggcgctggcatgtactttgcgcctttggcagattttcagctattacgcgaagcagcaaatttggcagatgacagttcgatccgctaccatgttggtaatgtactaggcgaagaccgtttctataatgatgaaatggatcgccaaaagctgattgactacgaagtattggcaacagaaatggagacgccagcgctatatttgcttgcagctaagttccatgcacaggcgttatcaatcctgaccgtctcgaatcacttgattacaggcgaagaaaccaccgctcaagagcgacagaccagcttcaatgacatgatcggattagcactcggcgtggctaaaaaggttcctgtacgttaaataacatataaattttatgtataccagcaatgttgtttcgattgtttttcagctgtaacagcaatttaatatgcgaacaagtgggaaacgtgttattctgtatatggtatcttaagaaaaggtaaatgacaattgaattgtaaaactcagtctcatgcaattattcagtcgaagaatggaggagtacatacatggtaaaatctaaaaaagtatggtcagtaacggcaggctttgttggtgctgccggtctggcggctttagcaaccggtgctaatactgtttctgcatctacaacgggaacggtcaactacaagaccggtgcaaccaccgtatggaatagtccatcatggaaccacgtaaaacgctatgtaacgtttggcgacacggtgcagctattaggtaagacagttgatcacaatggtgcgacttggtacaaggttggcgacaaccagtggatccctgagctctatttgaacgttgacgggaagactgctcaagttgaagcaccagcatcaactgctagccaggctcctgctagccaagcgccagcaagtcaagcaccggcgagtcaagcgcctgctagccaggcggcacctgcagcgactccagcagccacccaaagtgctaacatccagctctatgttaagaatgttggttcggctgtgaccgtttgggcaacgcctgcatacggtcgcgcaacggggcagtatcttgaaggtcagcagtccgtcacagctgtggcacaacagcaagcaaatggtgaaacatggtaccagctttctaacggtggctatgtacctgcacgctttgtcagcacgacacctgtagcagctgcaccgcaatccacagcaccacagtcgactgcttcaagcgcagctgcccaacctgcacaatctgctgcgtcacaggcacctgcttcaagctcagcagcacaaccaagccaagcgccagcatcacaggcaccggcttctagtgcagcatcgtcagaagcaagccaagctccggtatcacaagcgcctgcttcaagctcagctgctgaaagtcaggctccagcagcatcacaggcaccagcctcaagttctgctgcaccggaatcaacggcaagtacaacgacgactcctgtagcttcttcatcgactgcccctcaaaccgagcagttaagtgcaacgcagtcgacgaataataacaacaataccaatacagcgactgtatcggcaactcagactcaaacgtctaccgacacctctcgtcaggctaaggttcaagcggttatcgccgttgctgaacagcaaatcggtaagccatatatctggggcggcaaaggccctacaggctttgattgctccggcttaatgtactatgcattcctgcatggtgcaggtgttaacatcggcggttggaccgtaccacaagaatcttcaggtacgcaagtttctctggacgcgcttcaaccaggtgatctcctcttctggggcaaccatggttcaacaacccacgtagcgctttacatcggtggcggcaccatgattcaggcaccgcaaccgggtgaaaacgttaagtacaccgcattggcatacttccagcctgactttgcggttcgtccggatctataaacttaaattgaataatctttttcaaagaagaacgtcttttagcgaggcgttctttttttgggggtgattcttttcaatattcgccagataaagacgactggactggtgcgccttgctgtctttacgtttgttcttttttgtttatttgaacagcctggaaatccctatatataggcgttgtcggcccaacaaaatcaaaaaatgaaaaaagttgtttattaagcgtttacattaaaacggttacatgttatagtcaatttgttgaatacaggaacacatgtggatcgttactattcaattaggcgtaaccacggcagtcgaagatagcttgatatcttcgaccgaccgtggtttttctattgccattttttgtttagcagtttatagcattgacccggatcgcgaccggcgaaggcatattaatttttcacctagaaagaaggctaactcatgcaagtcattgtgaaacgacttgagaagcatcaggctttatttgaaaagatctcgcgaaacatttacttgatggccattaaagatggtttcctggcagcaatgccgatcattctgttttccagtatttttattcttttgtcgaatattccgccattaattgggatcaagatccccactgatttgaacgcatggtttaataagatttacaactataccatgggctttgttggattttacgttgccggaacgacggcgaaggcgttgaccggctccatgaaccagcgcatcaaaggtggacggttcatcaacaatacatcaacgatgatggccgcaatggtcgggttcatgttactggcgatcggaacaaccggtaaaggcaacttcttgccgacattctttggtacccaaggcattttgtcagcattcgttgcggcgtttgtgactgtatgggtttacaagttctgtgttgaacgcgatttaaccatcaaaatgccaaaagaagtaccgggcgccatttcccaaaatttccgcgatattatcccattcggtgcagcaacgattgtcttctcactgattgatgtcgcagcccgagcagcttttaaagtaccgttcagtgccattctggccaccgttttggccccggtcttcaaaggcgcagaaacttatccgggcatgatgctgatttggttcctgattccaatgttttggttccttggtgttcatgggccatcggttgttaaaccggcacttgaatctgcattgtttgggaatacgacggcaaacttagcacttttcaaagctggccacttcccataccatgccttgaccgaaaacttcggtaactttgttggcgaactcggtggtaccggtgcaacatttatcgtgccatttttgttcatgttctttatgaagtcaaaacagctaaaagctattggcaaagcttccttcataccagttatgtttgcggttaacgaaccgctgctgtttggggccccgattattttgaatccatacttcctggtgccatttgtgttggcaccggttgtcaacgttgtgatcggtaaagcatttattgacctgcacatcatgcatgggttcatgtacttcatgtcttgggcattgccggggccgattggtgcactgattgataccggcttccagtggacctcgctagtgctcatggcgattttgctagtcgtggacgcgcttatctacatgccgttcatcagagcatatgatgcggaacttcttcaagaagaagctgcagttgatgccgccgatgctggcgccgtcgcaactgcaacagcagctggggcaggagaagttgctgctgaagccgatgctgcaactgctcaggaatttccggaaccagcggatgtcaaagcagccaaagccgaaaacgcctcgactgatgatgggcaaactgcgaaaggtccccgcaagcttgatcacgaattgaaagttttggttttgtgtgctggcggtgggacgagtgagcagctagccaacgcgctgactgatggcgccaaaacgtatcatgaaccgatcgttgccagtgctggtgcctacggatcacatcatgatattttaccgaactatgatatggtggttttggcaccgcaagtccggacttattatagcgatttgaagcatgatacagatcgattaggcatcaagcttgtggcaaccaaaggccagcaatatattgctttgacccgcgatcctgagaaggcgctggactttgttgtcaatcactacaaagaaagcgatacgaaagagacgcctgcgacagaataacgttgtgtcgaatcaaactgaatactgataaaaagaaagataaggcggtgtaccaatgttgctaagggtcaagcaagtgtataacaacaatgctgtacttgtagacgttggcaacggtaaggaggcaattcttcaaggcagaggtattggttttagcaaacgcaaagacgatcaaatcgatcccaaaaagagttcggagatactgtatctcaatgatgcacaagtgaagaaccactttacgtcattgcttaaggatgtgccaattgacatcgttgtcgccacgttcggtgtgattggcatggcgaagaagacgtatcattacccagttttgaattatatttatgtcacgctgaccgatcacgttttccaaatgtataaacgtctgaccgctggcaaataccaagcgagcccggctccggatattcgcgatcgttatccgttggcttatcagattgcgacagaggcagtcaaacgccttaaccatgatctgggcgtccattttcccgatgccgaagtgaaaaatatcgcgttgcattttattaatgctaaaggtgtggatggtgacttggatccgaccgtgacgctcacggcgcgcgttaatacaatcgtgacgcaggtttttgctaaatatggtctgaaacggagcttaacgaatcaaaactattttgatcgattgatgatccatctccagtatctggtcgagcgattaaacactgatgaacaagatgaagctgatcttgatccaaaaatcgggcaagactttaagcggctttatccgaaatcatttgccattgccatggagatttgcacggagcttgagaaggctttgcagattaagcttaacgaaaatgaacatgtctatttcatcatccatattcagcggctcattcaagaaccgcaaacacctgcacctcaagattcataaccaaggaggaaattttgatggcaactaaagaagaaatttcaatgaccggttttgcaatcgttgcatacgctggcgatgcgaaaactgatttgattgaagcgctgaatgaagcgcgcaaagggaactttaaacatgcgcggtcattggttgaagaggcgcgccaaagcattaacgaagcacataatgaacaaaccaagctgcttagcaaagaagcaggtggcgacaatatggatgtcacttttatcatggtgcatgggcaggataccttgatgaccaccatgatgttgttggacacgattagcttcacgatcgacgagtatgagcggctggctgcgattgaaaaacagctgggcatcgcgctgccaacaaacgacatccattagtaagaccaaaggaaggagcatcatcgtgacgagcttattaaaacgcgtccaatcattacccaaaggctttgtctggggcggcgcaaccgctgcgtatcaggtggaaggtgccacaaaagtagatggcaaaggcaaaacgatgtgggatgactatctcaaagcacaaggccgcttttcacctgatcctgccagtgacttttaccatctgtatccggaagacattgagcttgccaaactatatggtttaaatgcgattcgggtatcgattgcgtggacacggatttttcccaagggatatggcgaacccaatcctgccggcgtagcatactatcatcgcttgtttaagtgttgcctggacaacggcattaccccatatgtttccttgcatcacttcgattcaccaaagaccttatttgatgatggcgactggttgaatcgcaagaacattgattattttgtcgactatgctgacttctgtttcaaagagttttccgaagtcaaaaattggttcacgatcaatgagctgatttcgctagccttttcccaatatattcaaggcaattttccgccaaatcatcattttgatgtgacaagtgggatccaggcccaacataacgaattgttggcacatgcgcgggcggtcaatctgttcaaagagaaaggttatcaagggcgcattggattgattcatgtgttgcagccggtttatccgtatccggacacgccggccaatgagcatgcggcagcacttgaagatgcttttatgaaccgcttcttgctggatggcacgtttaagggtgaatatacaccggaaacgatggcgctgattaacgaattgctggaagccaatgatgccaagctgaagatcgaaccgggcgatatggacattctgaaaaaggcctccacgcaaaatgattattttggtatgaattattaccagccgtcttttgtcgctgcctatgaaggtgaaagtaccaattcgttcaatggcacaggagaaaagggaaccagttccttcaagttccagggtgtcggccaacatgttaagaaacctgacgtgccaacgaccgactgggattggaacatttatcccgcgggcatgtacgatatgctcaaacgcgtcgcgatggaatacccgaatagcaaaacgatttatatcaccgaaaacggtcttggctataaggacaagtatgaaggcattggtcagcttattgacgatgaaaagcgcatcgactttattgaccagcacgttgaggcactgctgaaggcgcgcagtgaaggcgttgacgtacaaggttactttgtctggtcattgcaggatcagttttcctgggccaatggttacaataaacgctatggtttgttttacgtgaattttgaaacacaggcacgggaaatcaaaaaaagtgcgctgtggttcaaggagctagggcagacactaaaggattaatgggatcacaaaaagcagacaggtcatcagcaagtatcggctgatgactgtctgcttttttgaatataatacaattttggttcattaggaacgcgctacaggtaaacaggttgagatgatttaagccaccggttctttatccgccgcgttagccttttcaaccgccgccattgccacagcgttgacccagttgatcggctgatcgaagtttggctggaacagcatatcgaccatagcgagggtttcgatggtcatgtgggtttggatggccaaggagatgacattggcgctttggctgatgtcgtgtttggagaagaatgcgccacctttaacttcgtgcgtctgcggatcccaggtcaggctgcacaggaccggtgtggtggtgagcatgaagtccgggcgatagtcttgctcaatggtgacactatcaagtttaagtccgcgagccttcgcgccttcggttgtgagcccagatgcggcaatggcatgatcaaaaagttcaactgccgaactggcttgcgtgccgaggtacttctcggtcggggccacaatgtttttaccaactagaatgccttgacgaacagcattggttgccaatggaatatagtcgtgcttgcccgttggattataatgcacagccgcggtgtcaccggcggcaaaaatagctggatcgctggtttgcatgtaggcatcagtgatgatggcgccatttggcatggtatcaagatgatccttaagcaagtcggtgtttggccggaagccggtgcacaaaatcgcaatgtcggcagtataggtacccttgtcggttgtgactacagtctcaccttgatcatttttcgcaaagctggtgaccatttcgccgagtgctaagtgaacgccatgatcggtgtaaagtttttcaacgcgatcggtgatggtggcgtcaaagttctttgccaacacccgcggcaggccgtcgattaatgtgacctgcttatcggtgacggcatattgttcggcaagttcagcaccgatatagccggcgccgatgacaatcgcacttttaatggttggcgccagatcttttaaggttttggcatcttgccagttcttgcacaggtggacgtccgtatcatgaatgcccgggatatttggaacgatcggagtagaaccggtggtgtaaaccagtttgtcataagtatcagtggtgatctcgccagtgtttagatccttgacttcaacggttttggcgtcggggtcaacgctgaggacgtcatgctccatctgcatattggcgccaagcttggcaagcgcttcgggactggaatagaacatcttgttaggatcgctgacatgatcaccgacccacaaggcgatgccacaggagagaaatgacaggttgttgttgcgctcgtaaacggtgacatttgcgtctgggtggtcggttagaatctgttgggtcgcaaacgtaccagcatgggtggcaccgataacaataattttcatagatagaacgctcctttgtatttttgataatgatttcacaaagaaagtgtaacacaattaattgtgtgcggctatattgtccggggtcttttttgtgaaaaaatagttaagaagcgttttcaccatgtcctgttaatcttgcagccagcggccgatcatttctaaatggtgcatcaactggaacttccggacaacgccaaggccgggaaaatggtgatcggcagcggccttcatgagcgccgtcactccggccgtttgtgcttggggatgatagggcagccaggcggcaagttgtgtgaggatttcgaaaaatttggcttgtgggttggtgaagtcttcattattgacggagacaaaatgatgcagccgtaaggagccgtcagttgccgggtagactaagtggatcgccaaggcgcgctgagggaagccgtgctcaaagtagtctgaggtggcgagcggatagtcagcaaagccaacgccgggcaacatgtcaagcgagtactgataaaactcgtcttgcagcaggccgtacgccgatgtatgcgaatagacggtgaaatggtcattgagatacacagcatgccgcaaacctaaccgccgaacccgtgcctcgtccggtactaaagcgagttggcggcgcgccagcagtttggcttgggcagcggtggtggcaatgatcaatggtgctggctgggcatcaaaaatccgcgcgacttgcactgatggactaagcatcggcaggtggcgcggtgttgccaacagtcggtaactgccgacttgcggattctgaatcacgtaggccgcgtgggcagttttcgttagtgcctgcgtggtcttggtcaagccggggatgtctttgacaggttcaagcaccggaatgacggtcgcaggtagtcgctggctgtttgccaaggtggtgatcgctgccaagtcgtataattttccgcgaatgatagggaaatagttcatgataagcgatccattttcaatgttgccacttccgcattgagggcgtcgacttcttcttgaagcgcagtgatggtcgtgttgttgaggtcatcgacaaactggtcataaagatttttatcgggatgataaatatcatagtcagcggttcgttttcgcagttcggtaaacaattccgcagtggaaaattgtccgagtcctttggcgacttgcttggctttgacgacttcacgattcagactggcgatgaaatgatcggttaattgttcttccgcgacctgtaagctctgacgtcgcgccggtttcgcgattgtcagcgtgccaggcgtgctcactggaacggcactggcagcaatggccgccttggagaacgggtggtagacgaagacgccgatgccggctggaatttcggcgacgaccgcttgataaagccgctgtggcaacacaaagtaattataatggccaacaaaacttaagcgggcctgactgtggaagtccgctttcgttacttttagctcaaaacagcgccaaatcgtttcattttcctgcttttgccgtaccaaggtgtccacaatgccgaaatcatcgggcatcgtgacttcttcaacagcagtggccccttgttcttcccaataggcatacaacgtcttttctagatcacgcgtgagctgggtcttcatgatgtgcctcccaaaagtgagtgagtaactgagcgagttgcgccggattgcgactaacctgagcgtgcgtccagtggtccggaaacaggcgcgcgtaccgtggcgtcacaaaccgctcatcgatgagcaaaataaccccgacatccttagcaccacgaatcactcggccccccgcctgcaaaacattgttaaagccaggcagttgatacgcataggcaaatccctgacctgaattttggtcaaaataatcccgcagctgatcggtttccgcattgagtcccggtaagccaaccgaaacaatggcaacgccgattagctgggtaccgcgcagatcaatgccttctgcaaaaattccgccaagaacggcaaagccaatcactggctcatggtcggctttgaaatgatcaagaaaagcttgacgatccgcttcggtcatggcattttcctggacgcaagttttaagcgcgggattggcagcggtaaacgcggcataagcgatttttaaataagcgtacgacgggaagaagaaaaggtaatggccttttttggcgctgactaaggttgtgagactcgcaatcagttgcggcaggtcctgctcgcgccggcgatacgtggtgttgacgcttgtatcaacgatgacggcctgattctgcgggtcaaacggcgacggtaaggcgtaagtcagactgttgtcaacgccgcccagtaacttttgaaaataaggcatcggcgataaggtggcggaaaacaacacggcaccgcggccctttttcagtgattcatcgacaaaatgcgatggatccaggcacaattctttgactgtgacaacgccatgatccttagtaatctcggttttgaacgtctcatcgtaaaaatcgccaatgcgcaaatattgatttgccaggaagaaaaccggtaacacgagatcaacggcgggctgcaaggcgggcgttggcggttcggctaaccaatcgtggactgtttcggtgaacttggcgagggcattggtaaggtcatcaagcggggcttcttcaaaaacaggcgattgtttcattaatcgctgatcggtgatggctgacagggtgtttacgatccgagtgatggcgcgccgcagcttggtgagtgccgcacctttgtatggggacagtgctttcttgaggttggcaaagtcctgatcggtgatgctggcggtatacatgtcccgcgcccgactcacgagattatgagcctcatcaactaagaaaaactgactgtcgtcggcatcgctaaagaaccgctgcaaaaagactaacggatcaaacaaataattgtagtcgcaaataataacgtcacaaaacaggctggcgtctagcgaaaattcaaatggatcgaccgtgtgttttcgcgcataagtctcgatgacggatcgggtgatttggtcttcatgtgctaggaggtcatgcaacgctgactttaagcggtcgtaatagcccagcatgtaaggattttgactgggatcgtctggctcatcggcaaaagtgatcgtgtctttagccgtcagcgtgatacttttcgccttaagccccgagcctgccatcaacgccatcgcttgctcggctacacgtcgcgtactttgcttggcggttaaataaaacgctcgctgaatcaagccgctgcccatagctttgacggtcggaaaaagcgtcgaaatagttttaccggtaccggtgggcgcttggacgaaaaggcgcgcgctgctgtaaatggctttgtaaaccgcggcggcgaattcgtgctggccggcacgatactcgggaaaaggaaaatcaagcgcatcaatcgactcattgcggcgcttgatgatgtcgctgcgtagcttgagccaatcggtgaattctgtcagtaaatccgtgaaatcatcagccagttcggcagccgttttggtttcagtgaagcgagtgacggtgtcagtgctggtttgcacatacaccaaggtgatggtcgcgtggtcaaggtgacgttgttgacaaagtaagtgaccataaatacgtgcttgagcccaatagcgatccttggtattttgggtgcactcttcccatggtcgggcgctggttttgatttcttcgacggttaatgtcttgttgtcatcggtccagatcccatcggcacggccttcgagttggtaatcttcatcttcgacggtaaccgtggtttttaaatagacttctttttcgtaatcaggctcatggtgagcggcctgcaacttgcggtggatctggctgccgatgatggcggtattatttgaattgctggtaatcgggttgagatcgccggtacgaacggttaactcaacaaattcccgaataccaatacgattatgcgccatcaccgggtccccctttaatgtagttgaaaatataactagccttcagtatagaacatacattctgtttgggaaaatggctcacccatgatttttaaggaattccgggtgttccttggtttttattttaaatagaggcataataaggggtgtcaagacatatgacaaatacggcggcttgcaaacactgtcgatcggtaagccgcgacatcaaatgagggacataagatgaagaagactagtttctggcgtttgttaggttttttgggtgcgattttggtcttgttgaccgcttgcggtaagcaaagttcagcagccaaatcgtcgtcatccagtgcaccagtgaaaattacatactggcaccggatgacaggttcttatgacaaagcattgaacaagctcattacgaagttcaatcaaagtcaaaagaaatataaagtggttgcgacgtcacagggatcttacaatgcgctgcagcaaaagattatggctgcaggcaaatccaagaccttgccgacgatggcccagtcaccttataccaatattggtgactatgtgaagaatcaactgttgttaccgtttgactccgaaatgttgaacggctcggataagttgagcagtagccaacttaaggatatttacccaagctttttggccgccgggaagtataaaggtaaatactacggtctgccattctcggtttcgacttcggtgcttttttataacaagcgtctgatgtcacaatataatatcagcatgccaaagacatgggcagattttgcggctgatcaggataagttaaaagggacggacattaacgctgtcgagctggatcaaagttacgatgttccgttagaagggatggcttacggtgcaggtagtcaactgattaccccaaagctaaaagctaacctgaatgcacctaagacgttggccgccgtcaaccagattcttgatctgcgcaagagcggcgcattgaagacggcgggtgaagatcagtacttcagcgtcccgtttgcaaatggtaaagccgtctttggaattggctcatcagccaccgtgccggtcttattgcaacaggcaccaaagaatctcgaatggggaaccgctgtgattcctgaatatgaaggcaagcgcagcaatccattaaacggaaactacaatgtcttgttcaaaggcgcatccaaggcgcaacaagccggcgcatgggcattccagaaattcctgttgaagtcggaaaatgcttcacagtgggcgatggattccggttatgtaccagtaaccaagagcgcatccaacagtacgacctttaagaattacctgaagaaacacgagcaatacaaagcagcggtttctgccgtgccgcaaagctttgcatcaaccgtctttgccggctacacagattaccgcaacgaccttatgagtacagttgacagtaccttgacgaaaaacgtcagtggcgaaaccgcatttgatcagctgcagaagcagactgagaaaattttgaaagaaaattagtaatggtgttccactaggttagtggtacctttcatagtctgaaaaatgaccgaactgccagattttttggcaagttcggtcatttgcttacagattcaaattttatttacgctcatacgtaagcacgaaccagccgtacacaagaaatatgatgccgagtgttgcgattcctaatgagttgattaaagtatctatcgtcagtccgtctttcgaggtgaaccaaatcagagcgctgacaaacatgatcgcccaactgattgagtaaatcaaacatgcctttttatgcgatttcatagcatcttaaaacctccatgctgagtaaattggtgacatgatatttggaaataatgtcattgtaccgttaaccgaaactaataatcaaataatgttatgattacaaaaagaactatctaattattagctaagaactttatttatataccaatgcttataaccccaaaactttataaaattacttaactacaaggaaatatgaaactcattttgccgatttttttgctggttcaattggcgaaataccgtaactgtggcgtattcaacgcagacacaattcccttatggcgtttgcgtcacccaacctcggtgggctatgatggtcggaggattgttaagtattaaaggagaccattatggaaatcaatgtacacaagtttcaggaagcagttttagcaggcactttcgagcatacagaagtgcatctgaccgcagccgcttttaagaaagacggcgttgatgccgcgatggagaaggtgtttgcggatgtccgcagcgcaatcgaaaagaaccagttgattcaggctgatttggtcatcgactttcctgagccgaccacaatcacagttgaaaccggcgtgatcaacctgccgtttgccaacgtcaacaaaattacgaacttccttgaaccggatgaaatcgtcccggtccgcgtttatttaatcgtgacttcgccgtttgtcaacgtttccggcttgcggattgacgaagctgcaacggccgctgattatctgcaggacttcgcaacgatcaatgaccagatgattgcctccgttcaggaaaaactggatcacattcaaaccgagatggctaagcctaaggaaatcgccaaagaagttccagccaataaacaaaaaccgacagccaaaaaaacaaccagacggactgccacgaagaaacgcaccacgacgcgaaaaaccaccaagaaaacggcaactgcaagtaaagcagcggcgaaaaccaccacagccaaaaagacaacgacacgaaaaaccgctaaaaagtaaacgagaaaatgttgttccgaatagccagtgatacttagttggatcgctggctattttcatgcacgcagaaatggacatctcaatgttcaaaaacgtaaacaacgatgcggtaacaattcatctgaggaaaacgtgagaatgatatgtgaaaacggtcgattgaattgaaatgaaaacgattgcatattattcttgtgatgttggcggaataggccaatttcgttttagacaccaaccataggggaggtcgaatttttgaaaaagcaggggatacacgtttggctcttggcacttgcggtactactgggtattgccgtgggtttgaagcagccgccgaagcaggtcgcagctgccgataatcgattgcaaagtgtcttttcgattgatgctgggcggaaatacttttcggttgatcagttggaaacgatcattgatcgggcgcacacggacggatacaccgatgtgcagattttattgggtaatgatgcgttacgcttcatgctggatgatatgagtctgaccgttgacgggaaaacatatgccagcgatgcggttaagcaagccgtacttgccgggaatcagacttactacaacgatccaaacggcaatgccttgacgcaagccgacatgaatgcggttttaaaatatgctgcagcgcgcgacattaacattattccgctgatcaatagtcccggccatatggatgcgattttgaccgcgatgacgaagcttgggatcaaaaatccggcgtttaatggctccaaacgaacagttgatttgaataacgacacagccattgcgttcaccaaggctttgttgcaaaagtacgttagctattttaaagaccacgccacgatttttaatttcggcagcaacgaatatgccaacgatgtcgataccggcggctgggccaagctgcaacaaaccggcacttatcgcaaatttgtggcgtatgtaaatgacttggctcagatggcggaaaattccggattgaagccaatggtgtttaatgatgggatttattacaacgatcgcacggatttcggtacgtttgaccagaatctcattgtgtcttattggacggcagggtggtttggctatgacgttgccaagccggaatttctggcgaataaaggcttaaagatcatgaataccaacgatggctggtactgggtgttagggcgcatgaccggcaatctgtatagttatgagactgcggttgccagcttaaagagcaaaaaatttacggatgtaccgggcgctagcagcacggttccgattatcggcagtgttcaggcagtttgggccgataacccgagcgcacagctggatatgcctgcactcctgaaactgatggatcaattttccaccacatatactgcctacatgccacggccggcggattacagcaaagttgacgctgcgattgccaccgtgccgcggcaactgagccagtatacggatgcttcgttagccaaattagaagcagcacttaatgcggtgatccgcggtaaaaaggccaatgagcaggcaatcgttgatggctatgcccaagcgattaccgctgccgttaagggcctgcagctgcgtggcgctgattacagccaagtcgatgccgcgaccgcaacggccaaaaagttagaccggcagcattaccaagactttgctgcagttgatgctgcgattgcggctgtgaaacgcggtttggacatcacccaacaaaataaggtcgacgctatggcgaatgcgattcaggcggcgatcaaaggactggcacttaaaccgacaccaccaaaagtgccaacgccgtcaacaccggaacccgcaccaaaaccgacagcggccgcgccagcaaaagagacaaacaagcaaccgccgctaccaggtacggcagaagcaacaacaccagcactaatgctcgcaggcgcttcgttgctcgccagcatgggcctgttatactggcgccgtcgtatgacagattagttatttttaaactgacaataacgcccgctgcgcttaattgcgcaacgggtttttggttgcccaaaaccggtcaagtggccggcaacgacccgtttaccagcgaaaggagccaacatgaaccacaatttctggaaacaatgtgcaacagcagtgcaaaaattgcgctttcataaatgcaaaagcaagcgtttgcaacagcttacaggcggtctagactttttaattggaaagggggaacggcaatttgaaagataaaaagctgttgattctggactttttactgaagcacggcacggttcattacgatcaaattgccgaagcgaccggactttccgagcggaccgttggcaattacttaaatcggctggacgcggacttatcgccatatgccgtcaaattggtgcgcaagcgcaatgtcggcgtctctttagacgggccggccgaccaaaaagcccatttgttgcgcagcattcatggtcaggaagggttcacctcgcaaacagcgcgtgagcattatctaatgatcaagttgctgctaaccaaccggccgtataccctcagcaagcttgctgacgacctatttgttagtcgccgaaccatcgacaacgactttaagtccgtcaagcgagtcttccgagaaaatcacgtaaccgtgcaaaccagtcgaaccggtattcaggtgaccgcctccgaatcacggcggcgccatatgttggcaaaattgcttcgcggttactggggtgaaagcctgtccgttgccaagcaaaaagacggcgaggtggtccagcagatccagttgccggcgtatctgaatcatttagtcaatccagcgaccaccaaggcggttatgcagagcttggctgaatttctgaaacagtcagacttgatcttttcagattatgcactgcaatcgttggccattcatctcattatcgcttgcgagcgccccaaaaaagccgcaccggcaccggttcacccagcgccactgctgccggaaaccaagcaattattaacccttgtgacgaagcatgtgcaccggacgctggacaatgccgacgcgcaacaaatcaatgctcacatagcggcgattctggatcggcaggtcagtgatgccccggccgcaagcattgaggagcaggcagcaccggtacttagacagcagattgccgggtggctaaccgggatatcgccggacacgcggttactggaagatttaagcgttcatctcagcggcgcactggcccggatttcccgggggatgacgattcccaatccctatacggaagagatcaaacgcaactttccaatggcgtttgatgcggctgctcagctaagtatggccgttgcaaaacactaccatgtcacctttaacgatgacgagtccggctttctcgccctacattttgaatccttcttcgaacggcaacatgccgcagaccgcatttcaacggtggtggtttgttccagcggtgtcgggaccagccgcttgctcgcccaacgcctggaagaacgcttccgtgaaaagttagtcatcactcggacaatcggcttggcagacctgatgcggcaaacgattcccgagacgttgattatcagcacggtgccgatccaagggatgcgccaaccagtggtgatcgtgaatccgttgttgttgcaacatgacatcgaaaaagtcgcgcagcaagctgatcgcctgcgttttggaacagatggcgatgcttttctcagcctgttagatccaaaactggttttgccgaatttgccgcagactgatcaacatgcggccatgcaggcaatgattcggcaactgacaaaaaacggtgtgtttgaagacgaaacgttgccgctgaaactggccgaagatcgcgaaaagctcgcgacaacggcgatgcgcctcgtcgcgattccccatatctcgccggaaatggttcagcggccggcaattgcgcttggactggcacccgaaggcatcgactggtccgggcagaaggtcaaagtggtctttttcctcgcactcaatgcggctgcacccagcgatcagcgccgcatctaccaagtcatgaatcgaatgattgatgatcgcctattttgcgaaaagctggcacaaagtccgaccccagccagcgcgttaagaatcttatctgaatatgttcataaaggagcgaacgaatttgaatgaagtcaatgtcaccactgatgtccacaccgatgttgccgtccctgccgataaacatgcggcacttgggaccattgcaacgattttaagcacgaaccgcccaatttcagctgatgagttgcgtgataacctcattgcacgcgaagacgaaagcagcacgggatttggtaacggcgtagctatcccacacgccaaggtcaacggattaactgaaccttttgttggcgtcgtgacgtttaaacagcctgttgcgtgggattctttggacggtcagcctgtctcgatcgccattgtcctggtaatgccagatcaaaacggtgcggacaggctgcatttgaaaatgttgtcgaaactggcgcgtaagttaatggacgatgattttatcaaagccttgaaggacgcgcagcacgatggttcacaaatgaccaaagtactggatcaagttttgtaaaagggggaatttttgatggcaagttttgttggtgttaccaaatgtccggttggcattgcccacacctatatggcagccgaaaagctgcaaaaaaccgggcaggctgacggctataaagttaaagttgaaacgcaaggtgcgtcaggcactgaagataacttaaccgctgatgagattaaagctgctgattttgttgttttggccattgatgtagccattgatggcatggagcggtttgtcggcaagcgcgttgtcttttcaacgacggcggaggcgattaaggatccgcaaaagctggttgatgaaggtaagcatgccgatgtttatactggtgaaaaacagcacactgctgaaaatgaagccgatgctgaatccgaagacacggcccatgagcagagtcccgtgattaaacagttgctaaacggggtttcccacatgattccgtttgtcgtaattggcgggttattcattgccttgtccatcgcattgggtggccatgcgaccgctaaagggatggttgtagcgcctaatacgatttggtcaacgatgaatcaaattgggacgattggctttagtttgatgattccgatcttggccggctttattgcgtacgcgattgccggccgcgcagccttggctccggcgatggtcggcgctatggtttctaacacgccagctattttaggtaccaaagcagggaccggttttctgggtgccattctagttggttatgctgctggttatttaaccaagtggatgaactcctggccgattcctaagagtctgcgggccgtgatgccgattttcgtcattccgctgctcggcactgcaattatcagtgcagcctttgtctatctgctgggtagtccgatttcctggttgatgacggcactgcaaaacctgttgacgttcttgtccaagagtccgtccacgagcgttgtcttagggcttgttttaggtgcgatggtttcaattgatatgggtggtccgatcaataaggttgcctttcttttcggggtcgcgtccattactgcaggcacgcctgaaattatgggtgccgttgcctgcgcgattgccgtaccgccgttgtcatccgggattgcgacgttgttcaagtcggaattgaccagtgatgaagaaaagacggctggcgtatcggccattttgatggggctgattggtattaccgaaggcgcgattccgttagcaaccgcacatcctaaacaagttttcccgggcattattatcggttccggggtggccagtgctgtggggatggtcttccacattaccgatgccgtgccgcatggtggcccgattgtcggcgtactgggtgcgacgaacaacttaggcttattcttcctgtcaattttaattggggtcatcgtctcgaccgccattatcgtattcctcaagcagcgcgctgttgcccatcaaaagagcatggcatctgctgaatgacgcaaatcagcccgctgcgcatctcttgcgtagcgggctgtcagtgttttccaacaccaaggatcatcatagtggttaattgtgatgaaacgttgaatcaattaacgagtttggttaactttaaaaattcataatgcggtattttgatgaaggggagcatccgatatcgggtgattggcctagagcaatcgtgtataatgggagtcgatagcaggaaaaagcagtcatgacacagccaactgctggtcaacgcgactaaaaggaagtggatcttttgacagaaccattatttttgaaaccatacttcaatcccaaaatttggggcggacgtaaacttaaaacagaatacgggtttgatattcctgacggtaaaatcggtgaagcctggatcatctcagggcatccgcatggaccggcaacgattgaaaatgggccgctcaaaggcaagacgttgcgtgaagcctggcatgaagacccggcttatttcgggccgcagcatagccaggaatttccgcttttggtgaaaattttggatgccgaagcgagcctgagtgtacaggtgcatccggatgacgcatacgcagctgctcatgaggccaagggcgagctgggtaaaaccgaatgctggtatattttgcaagctgatccgggatcatacttgatttacggtcatcatgccaagacgcgtgaacaactgaaggacatgatcgaggccggcgactgggagcatctgttgcgcaaatatccggtgaaaaccggtgactttgtttatgtgccaagcgggacgattcatgcacttaacaaggggattgtcgctttggaaacccaacagagttcggatacgacatatcggctgtatgattacgaccgaaccgacgatcaaggccataaacgcgagctgcatatcaagcaaagccttgacgtgaccaccgtaccgttccaggatccgaagctggacattaccaagcagcaagtaccaggcggccagatcacgacctttgtcaagccaccgttgtcgccacattttgccgtttatcgtttggatattgacggcacgatgccgtttacccagcaagcaccttataccaatgtcaccgttctcgaaggcgaaggcaccttcacggcagacggtcaggattatccgattaaaaccggtgacagcttcctgattcctaaccaaatcaaggcatggcagttcaccggcaaacttgccattgtcacatcgacaccgggtgtggatgcataattggaaagtggcgagccaatcaatctcatgccgtgccaaactccgcaatctccggccagctggggtggcgacgcgaagctagagcggagggcacggctgatccccatctggcccccgattgctccgccttggcactaggatctagtaataccaacaaactacccatgaagaaattaacaacgaacttacctctcatcaacattttgaggtaggttcgttttttactgtcgcgaattgtctgacagtcgctttcctataagcatttgaaagcttcattagcacccgaaaaattagccaaaaatgagaacgctttcgtattgatatttttatatcaagcagttggttaagcgagagaaaatctgaatatttgcgtctgtggtatcttttcgtgacaacatcgtgcgactggtatggaccacggcaaatcaaaagggcagattcgccagattagaattagatcgtttccgttgacaatcagaagtgcaagcgcatacactactaagtggttggtaccacgtggaggtgaggatatggaaaaggttccgttgactaaacagctggtagatcagctggagacatttatcaaggaaaaacttcagcccaatgacaagttgccgtccgagcgggatcttagcgaactgtaccatgtcagccgaaatacggttcggtcagcgctggacgaattgttcctgcgcggcttcatttatcgcagtaccggaaaaggcacgtttgttgcggaacgatttgacgaacgaaccgatgtcagcggctcgtacagttttaccaaacagatgctagccatgaatcgccaacccgtgaccaagattcagcggctggaaaaaatcgcggtaccggcaaatattgccaagcggatgcgcatcgatccagggacgccggtttatgtattggatcgactccggattgcggacaaactaccgatgatgatcgaacgcagttacttaccggcgttaaccgtgccggatcttgaaaaagacgctttggaaaagtcaccgttgtatgactggctggaagagcactacggcatccatattgcgtcggttgacgaagcgttcttcgccggcttggtttcaccggaagacgccaagctgctcagggtcgcgccggcatcggcatgcttgaacattcggcggacgacttttgcagacactggcgagatcgttgagtataccttgagcgtggcgcgggccgatcaatttgtttatcacgttcatcatgttaatcactaggaggatggataatttgtttgaaaagacaactgaagaattaaccaaattaggggcacagattacgaccgctgagatcaaacagcagccggagttgtggcaagaagcgtttgacaattacacccgtgacaaagaaaagattactgcttttttgaaacaggtcacggatgccgctaacggtaagcaggttcgggttattttcaccggtgccgggagctcccagtatgtcggcgacacggtaaccccgtacttgcgggcacatggcgatcgcagcaagtttgtgtttgaatcaatcggttcgaccgacatcgtgtcagcaccttacgattttctagaagctgacacaccaacgattctggtttcctttgctcgtagcgggaactcgccagaaagcttgaagacggttgaactagcggaacaagtggtgcataacctctatcaaatcagcattacctgtgcgcctgaaggtcagttggctaagaaatccgccagcgaaggcaagacgttactgctgttgcaaccggctggctctaacgacaaaggctttgcgatgaccggcagcttctcctgcatgacattgagtgcactgctggtatttgataccgctagtgacgcggacaaacaacagtgggtcaaggcgatcgctacgatgggtcaagaagtcgttgatcgcgaagctgaagttcaaaacgtcatcaatcgcgatttcgaacgcatcgtttatctgggctccggcagtctcggtggattaactcgggaaacgcggctgaaggttttggaactgacagctggccaatacgccacgatgtttgacacgtcaatgggcttccgtcatggtcctaagagctttgtgaatgacaagaccttgctgttcgactttgtcagcaacaatgcctacacccgtcaatatgacattgacgtgcttgaagaagtcaaaggcgacaagattgctccttcagtgatggcagttggcaccaagcaagaccagaacttctcaggcgacggtttctattttgaaaatggcctaaaagatcttcctgagggttatcaggctttgccggacgtgatgtttgcccagaccttggcacttttggcttccatcaaggttggcaacttacctgacactccatcaccgaccggaaccgttaatcgggtggtcaaaggggttatcctccacgactattcaggtcaggaataaggttggcgttgtcatggtgcaagccggcaagaaaatcgcgtcgggttgcatcgcttaaactgggaggcaaatgttcatgagttattacattcacgccgcaaagtttttccttaaacatgcgactgaaatcggcggctatctggaaattaccgatgacggagaattcggcgagtatctaccggaaaatgccaagccggatggcgacatcgtggaacaacccggtaagttgatcgcgccgggcttggttgacactcacattcacggccttttgggtcatgatgtgatggacaacagttgggacggcattgagacaatgagccagaacttggtaaaagccggcgtcaccagctggctgccgaccactttgaccggttcatttgatcagctgaacgacgtctgcaaaaccatcgccgcacatgctggagaagaaaccggcgctaagatccaaggcatctattttgaaggcccgtacttcaccgcgaaacacaagggcgcgcagaatccgaagtacttcaaaaacccgagtgaaaaagaatacgatgcttggcaaacgtctgccaatggcctcttgaaaaagattgccattgcgcctgagcgtgacggtgccgttgcctttacgcggtatgcgactgccgacggaactgtggtcgcacttggccacagcgatgccacgtttgaacaggcaaaggcatgcgttgatgctggtgcgaccgtcttcacccacacgttcaatggcatgagtccgttgaatcatcgggaacccggcatggtcggggccgcgatgtacctgcaaggcgttgacgacgagttgatctgcgacggccaccatgtacggcctgaagttgccaccacgttaattcggctaaaaggtgcggaacatatcgcgctgatcaccgattgtatgcgggccggtatgatgccggatggcgattatgttttgggcgaattcccggtttatgtcaaagacggcatggcgcggttgaaagatggcgatagtttagccggttccgtgttggaattaaaagatgcgttgacaaatttgctgacatggaatgcggcgacaccggaagcgatcattcggatggcgacccaaacgccagctgtttcgtgcaacattgatggtcagtgcggcagcattttaccaggacgagctgctgattatctggtgctggataccgatttgacgcttcaggcaacgtatttagacggcaaaatggtttatcaagccgaagcatgagagcttatgtgacacaaaacctgtgaaaatcgggactaatgtgtgaaactaaatggtgttagcaggacagctgttatgaatgaaagggggccaggccttcatgacgactttttcgatcgagcatgattttatgttggatggcaagccgttcaagatcttatctggcgcaattcattattttcgggttcatccagacgattggtatcatagtttgtataacctgaaagcactgggctttaacacggttgaaacgtatgtgccgtggaacttacatgagtatcgcgaaggcgagtttgatttcagcggcatcctcgatattgaacattttctggatgtggctgaagatcttggcctgtacgcgattgtgcgtccgtcaccgtatatttgtgccgaatgggaattcggtgggttcccggcatggctgttgaccaagtccatgcggttgcgcaccgatgatccaaattatctgcaagcgattgatcgttattatgcagcgttaatgccgcatctggttaatcatcaagtcacccatggcggcaacgtcctgatgatgcaggtggaaaatgagtacggctcatacggtgaagaccacgattacctagcggcgcttgccgaattgatgaagaaacatggtgtggatgtaccattgttcacctcagacggaccgtggtcagcaacgttaaatgccggcagtatgatcaacgatggtattctggcaaccggcaacttcggctcggcagccgataagaactttgatcgattggcagcatttcatcaggcgcatggtcaggattggccgctcatgtgcatggaattttgggatggctggttcaatcgctggggtgagccgatcattcgccgcgatcctgacgaaacggccgaggatttgcgagcggttattgagcgcggcagtgtcaatctctacatgtttcatggtggcaccaatttcgggttcatgaatggcacgtccgcacgtaaggatcacgatttgcctcaggtgacctcctacgattatgacgccccgctcaatgaacaaggcaatcctaccccgaagtattttgccattcaaaaaatgcttcatgaggtcttaccggacattcagcaagccgagccgctggttaaaccgattatggcgccggctgaacacccgctgacggccaaggtttcgttgtttgcggtgcttgatcagcttgctaagccggtcgcagccgcctatccgcaaactcaagagtttttgggccagtacacgggttataccttgtaccgcgcgcagccgttgattagtggcactgacaaagggacgccggccaaattgcgggtgattgatgcccgcgatcgggttcaagcttatttggatcggcactggttggcgacccaatatcaggaagccataggcgatgacattttattgccacaggttgaaggccatcaccagcttgatttgttggtcgaagatatgagccgggttaactacggtgccaaaattgaagcgattacccagtttaagggcattcgaaccggtgtgatggttgacctgcattttatcaaaggttatcagcagtacccgctggacttgaatcaggcgccagaactggacttttcaaaagattggcagcctgaaacgccggcgttttacaaatacacgtttgatctgacagagccgcacgatacttatctggattgtcgcggattcggtaaaggagtgatgctggttaatggtgtcaatgtcggcaggttctgggagaagggacccacgttgtcactgtatgtgccagcgggactcctgcatgccgggcaaaatgaggtcatcgtgtttgaaaccgaaggccgctatgccgaaagcttgaaaatggctgaccacccgatatttgtagaaccttaacgcgttcgccagcgcagaaacctgcgtgtaaggaccttggtcgcaatggcctaagttcgggccatcacgcccaaggccacttacaccccggtttctaaccgcgccggttcacgctcacgcatgatgaggaggagtagaaaatggctattattgcagcacgtattgatggtcgcctggtccatggccaggttgccaacctttggaccaccaaactgggtgcgacccgaattatcgttgtcgatgaggcagcatccaagagtgacatcgataaaagtgggttgcggatggcgaccccggaaacagttcggttgtcagttcttgacgttaagaccgctgctaaccacattttgaaccacaaatatgattctcagcgggttttcattgtcgcaaaacggccggaaacatttttggccttagtcgaagctggcgtgccgattaaggaattgaacgtcggcaatatgtcccagacagatcagactcggtccattaccaagtcaatcaatgtggttgatgatgacgttgagaccttcaagaagctggatgccgctggtgttcacttgattgcacaaatggttccgggggatcccgcagcagatttcatgacgctgctcaaaaaaggatagggggagtcaacaatgattgcatggtggcaaatagcacttttaacattatatgcaggttatcaaatccttgatgaactgcaaatttattcagccatgagttcaccggtttttgccgggttagtatcaggtttagtcatgggcgacatgaaagccggtttgatgatcggtgcgtccgttcagttgatggttttaggggtcggcacattcggtggggcatctaaaatcgatgcgaactccgggacgatcctggcaacggctttctccgttagttcagggatgaagccggctgcagcggttgctgcgattgcggttccagttgcaagtatcatgattcagaccgatatcttagcacgttttgccaacaccttctttgcacatcggattgataagatggttgacgaatataactacaaaggtatcgaacgttacttccttgccggtgcacttccatgggcactgtcacggatgattccggttggtttggcgctttcctttggtggcggctttgttaccaacgtggcacatgtcttgaacacaagttggaaatggttaggcgacgggctcacgactgccggggcagttctaccggctgtcgggtttgcgatcctgcttcactacctgccagttaagaagcactttgcttatctattccttggtttcaccttcacgatgcttttcacaacgctgtttggcagtgtccagatgttgggtacggcgatgactgaagttaccaagaaattcacggcaaacttcaatggcctgtccatgttagcgatggcattcattgcctttgcctttgctgcgattgcttaccagcagtcaacagcactgcacgatagcactggtggcggtagcggtgaaagcggttctgcaccgaagaagaataccaatgaagagggggaaatcaccgatgatgaactctaataaacccacttacaaattaacggataaagatttccggcagattaatcggcgtagcttgttcggcttccagttgggttggaactacgaacgaatgcaggcatcaggttacttgtacacgatcctgccacaactgcggaagatttatggtgatggcacacctgaactgaagaaaatgatgaagacgcacacccagttcttcaacacgtctaacttcttcaacaccatcatcaccgggattgacttgtcagtcgaagaaaaagaaggtatcgccggcgaagaaaccgtcgttggtatgaaaaccgggttaatgggttccttcgcttccattggggattcaatcttcgctgctttgattcctgccattttcggagccattgcggctaacatggcgcaagaaggtaacccagttggggtgttcatctggatcgccgcccaagttgccatcatggtcttccggtggaaacagttacggattgcgtataacgaaggggtttccttagttaccaccatgtcgcatcgtttggctgctctgaccaatgccgcaacgatcatgggggtcttcatggttggcgcgttggttgcaaccatgattaacgttaagttcgcctttgcaccaaagatcggcaatgtgccattggacttccagaagtattcggatatgattattcctaagctgttaccagctttgatcgtgggtgccatctactggctgcttggccgtaagcacatgacctcgactcgggcaatcttcatcgtcttgttcgtatccattgcactgtccgccttgggtgtcattgcaaaaggctaatcaagtacgttaaagttttagttgtaagcatgagctgctccagccatatctgattgcaggtatcattaaacagtcatgcgattttaaatcatcatgaaccgcggtcggttggaccggcgcatgttaaaggagttttacgagatgagcaaattagttttaatcagtcatggtcagttatgcgaggaactcaaaaagagtgccgaaatgatcatgggaccacaagatgatatcgcgacagttgcgttgctgccgaacgaaggacctgaagattttcaagccaagttcaaagccgcaatcgaaggggccgatgatgttaccgtgctagccgatctcaaaggcggcacccccaacaacgtcgctgcccgggtgttggcagaaggcggcaacttcgacctttatgccggcatgaacctgccaatggtcatcagctacttgaatgcccaaatgctggacatgaagcctgatctgctaggcgacggtaaagctggcgtagtttatatcaacgatatcgtgaaacactagtcagttttgaatgactgaggaaagcctgtgtccggttggatgcgggcttttttcgtatctgaacaggggaggcgcggctgtctatttgtcctgaaataactcgtcgatttttcatttatttgtcaatatggctcgatggtaacctgatcgaagtaaggttgaaattgcgttggatcaacaaagcccgtttttgcctgcatcgtattcagcatccccgttgtcatggctgttttcaaaatggcttcgtcggactgattgtcgtggatactgattgccagtccagcgagtgttgcatcaccaaaaccaacaggatttaccacgttaattttggggataacggcgtggtagaatttatcaccatgcttggcaaaagcaccccgggcacccaacgagacgacgacccattcaacgtcactgaagatcggttcctgcaagtcctgcttgagtgcattaaagtcggttttatcaacatgatgtctgagtaacccgcctaattcttcatcattaggcttaatcagcttcggtttaagcggagcttcgagtgcatggcgaagggtagcaccagatgtatcgagcagaacagggacgttttggtgctgggcatgtgcaatcagcaacgtataataagtttccggcaatccttgtggtagcgaaccagagatcgtgactaagtctgcctgggtcaacaactggtcaaaatgcatcagaaacttctcagcgtccggtttggtaatgaatggaccagcttcaagaatttcagtttgatttccttgatcatgtaaaatcgcaatcgaacttcgagtctctgcgtgaatcgataaaaattcgtgctgaatcccttctgtatcaagttgatgttgtagccactggccgaagtaaccaccaatgaaaccagtagcgaggatgtcatgatgaagttggtgaatgacgcgtgaaacattaagccccttgccgcccgcagttttacggacgttcttaacacgattaacggtatcgatggctaagtgttctaagggataagcgacatcgatcgatggatttaaagtgactgtcaaaatcatattaattgcctccataacaaaagccgatgctacaaagaatcggctttttattgatcacggtttctcagctaaacgcgattatccacgcgatttaccaccggaaacattgacagtttgacctgtcatataactcgaacggtcggagaggaaataagtgaccaaatcggcaacttcggataacttaccgctgcggcccaatggaatagttgatgtttttgcgtaacctgcccgcaactgttcaacagtttcatggcgtgagtaggctagtccttcctcataggaaagtgtccgtaaacctgtggcctccagaacaccaggagcaacgccgatcatacgaacgttatattgtcccagttctttagcccatgcacgggtaaagccattgatagcaccttttgtaccggaataaattcctgcaccttgcgaaccttccaatccagattcggatgacatattaacaatgacccctttatgttgcttgaccaactctttgacgatgatggaagagcaaagccagacacttttgacgttaatggtaaacatcttgtcaaaattagcttcatcaatcacatatttgccatccggatcggttggatcagtcagaattcgcggaatattaataccggcattattaactaagccgtcaatctggccgaacttttctttagcaactttgaccatatgctctacctgatcccgcttggtgacatctgtctgaacaaacagcaggttatcatccttaaagctgccttccttaagatcggcgttgatgactttagcgtgattgctgagcagatctttaacaatcgcatcgccaattcctgatgaaccacccgttacaacaaatacccgaccatcaatattcaaccaatcagtagccataatttaattcctcctaaataagtgtgagcgtgaatcagcgcggatacgcagaagcttattcgccgatgaacactctaaaatatttctcaacgaacccaaaatcgaaagttatttttccttatcatcagttacataaagccgctgacgcttgtaggcgatgtacgtgtatgcgaatgcaccgatgaaaagaatagcgatcacgataaacccaatgccgacctgtccagtgaagcctttggttaacaaataagtgatcggcgatccggcttggtcaagcgaggagacttgcttgccttttgccagtaagtttgttgcgtgaccaagcgcaatttctaatggatacatctgatttgaaatccagatagtgatgaacatgatcaccgagccagagatcaaggtgcggaaaatatttcctttgtgaactcctgtcgcaatagcgatgaaaaagccgattgttgctaagtcgccaaagggcaggacgcgatttccgggaacaagaacggcaatcaacaaggtaatcggaacgaacaaaagtccggctgcaataacgtctgaattaccaagcaacaaagccggatccatcccgattgtgaacgaaccgcctttaaaatgcttgtccatgatgactttggcaccttgtgaaatcgggataaggccttccatgatgaatttaacgacaacgggcatcaataccatgactgccgccatctggattcccaactgcaatgatttaccgattgggaacttagccaataacccgataatgacacctagaatcgcaccgataatggagggttggcctaaaacgccaaatcgctcttcgacagttttagaagtaatcgtaatcttatttaaacccgggatagcttcgatcaaatcatcaattggtttggcaaaaatgcccatatacgcagaagtcccgtgtggaatagagattccttccagtccgaaaaagttatctgtgaccggcttgaaaatgtcacctaatttataggcaattgctgcatgaatgcagatagcaacgatcccccaagtaaaactgccagtagccagttggacaatggcgcccgtaaatgccatatgccaaatgttccatatatcaacgtttaccaccttggtcatgcgtgtgagcagcatgaccacgttgacggcgatggcaactggaatggcaatcaaccccatggctgatgcccatgccattggcgaggtcccgggccagccgatatcaacaacgcttagccctaaattaaagtttttcgccattgcttcagcggctttgccaagattatcggtcaaaagcgaaatgaccaaattaatcccgacaaagccaatcccaattgagatcccggcgcgtagtgatttgccaatgccctggcgcaaggaaatgcccagtatgaaaatgatgatcggaatcatgacgcttggtcccaaatcaacaatgtattggatgacttgcatggtgctacctcctaaaagttaaaattcccaacctaaaagacagagattataacgattgtccattaaaagaagaccagaccgtgaccgtcatgaattttccgccgattagtgaaagcccttacacgaatgatgataaacacttctgggaaaaatgcaagctatttgttcgaatatttcggtatatacccaaggaaaagcgcttaaataatttaaaagttagtgaatttaatattagggtaagcgcttgcattaatctggattagcgactatgatggctctataaaccgattaaagggatggagcgtgatcaagatggcattgttaaacaagaatctgattcatcggaatgcaacgtttctagacgctgacgatgcattgaagtcaatggcagcggcaatggttaaaaatcagtatgttaaatcttcatttgttgatgcggtggtgaaccgcgaacaccaatttcccactggtttgcctacgggtggcattatggttgccattccacatgctgattggaccaatgttaatcgcggaacgatttctgtcgcaacgttgaaggagcctattgtttttaaaaatatgggcgatccggaagaagatctggcagtgcggttaattttcatgttagcggtcaatgagccacatgctgaagtgacattgttgaaggatttgatgggcatcgttcagaatcaggcgacattgcaaggactacttgatgcaaagagtgatgacgaattatttaaccggcttgaagacatgtttcgtgatgtcaccgttgatacaggagaaaaggagcaattaaaatgaagaaaattatcgtagcgtgtggatcaggaattgcgacgtcaactgttgctcggaatgccttagaggaaaagcttaaggcaaaaggcattgatgctgcccaggtatcaatggatcaaacctcaatcccccagctgcgttccaaggctgatcagtttgatctagctatcacgactggaaaattcacagaggacattggcgtgccagttttaaacgggctaccatttttaaccggtgtgggtgaagatgagctcgttcaaaaagtcattgatgcgcttgatttgaaacctaaggcttagcggattggattctcatggctaactgataacaagcgagttcagtatcttgaattgccactcaaacatggtatgatcgtactgtgttgttttgctaaatgaacatgaggatgaagcatgttggttatgcttttaatgatctgaaactttcagaaattaaaaagagggatagccctcttttttttattgaaaaaagggaactgtgatcgtttacttaaagtgggaggtgtttatgtttgaaatattttggtgtgacgcttgcatccgctgaagctacgcatatcacccgtgataacttttttgaaccgctcgacttaacgatcagaaaacgattattatttaattatgctttgaaaaatcgtcgatggattaaagtcaatggctttttgcggcgtccgggggactggattaatgagaaagaagcctttgaagtgactaatctgacttcgcgtttgccactagagcaacttcaacgtcgttatccggactattatccactcatcaacaaatcccaatggcttcagcatcgcgatgaagctcagcagcttttcgatactttcattccaaaagtgaaacggcggaagcgtgcacggtatgaagacgaaatcatggaattttgtcaggataatggctttcaacaaattgattccctccgaacacatactgccagaagtgcgggtgcatatgtgatcgtcttggatgattatttgtcgatctatttcagcgtggtgcccaatattgcgaccgctattaccgctcattgggatgccttgcttgatttggatgctatcacggcacttgacgccttgcccatcgatgcgtttaagccgctggatacaacccgcattttcgtgaggaccacggaaaaaagaaatcttgaaaagctcaaaaacgaattaacggatctcgtgccgtatcgatatacccttaatcaatcttctccggggctgccagggatgggtagttcacaagaaaccaatctggccctctttcctaagggggttgaagttcacgatgccatgggcggctacgaactattcgaatatgatcttgcccacgagctgaatatccatccccgaaaagacgataaaaagtagtgcacgttcaacacccgcataccacgatgcagaattggcggtatgcgggtgctgtttttgcgagtatgatggacgaaatgacacgatagcgttgctcttattggatacatcacatttttttgaaaaatttaaggtagaatgcttttgtaatcttttcaataacagtacaatggagaaagtcacttttaaaatgaaagcaggtatctgaatggatgacaaactaaagatcattgaattgctcaagcaccaagtgacagctaaaacggctgaattaacgaccgagaatattcagaaaacaactcaagacattcaagatttgctcaaaatcctcaatgatgtcgctgcaatcgatttcgttgcaacgccgtctgagacacctactaagcaagaactggcaacaacttctgaagaaacaaccattgaatctcccgctccaaaaccgatcgtcaccacgcaagtagaaaaacacgagcaggtgccgcaacagcctaaagtcagcagcgagcctgaagtgccgttgttgtcagaacactggctgaataatcacaagtcgtatattggccggttccatttggatttgaatggtggccatgtcgggtccattaaagtctctgaaagtaagctacataaaatgtcgaacccaccggaaaacggcgactgggtgagagcagatgagtataaagatggcgattcaatgaattataaaatgacgacactgaagcgcgatccgttgccgaccgatattgtgcggctgaagtttctacctgccgtcttccgccaagatgtgaagcgctggtacattgaatttaaatcaccggaacatgaaaccacacagcaattgcttttgggcgattatgatgtgatgctatttaagctgaagccgggcgactacatcgactatgcctatcgccgcggtcaggaaattgatggcaaaatcatttggcgctacacgaattcggccgcagtggccacccgcatgaagcaaaagtttgccaaagcgagcgatacggagtctaatcacgagacggctgcgagtcgtcaaacgcaatacaaagctacggtcaataaaccggccaaacggaagcaacgcgcactacaacaggtatttgccaacaagcaactgttgttagtctgcatcgaaaattctggcatgccgcgtaaagttaagcgcaacgtggaagaacgcggcggcaagctgattttatcgccgcgctcagactccaacgccatgttaaagaaaaaagtgcaaaaagccgatgtggtcattgtaccgactgattttgtcgaccatggccagatgtttgcggccaaagatgaggcgaaacgcatcggcaagccgatctggatggccaagaacaccaatgagcgcaacatgcttcaatggtacaagcgtcattttcctaatgaagctaagacgccagcgatggattatgaagcatagttagctttgttttctgaatgatggcgagtgctcagcatcattaatcataagtgtaaaaaatggatcctagcgagacgtaatttagtctgctaggatccattttttgtcattattctgtgtttcgggcaattttacaggagtcttcttccattgctggccattcagcatagttagcgatgatgcgatccagcgcttccttgagcaaggggcgcggcatgccgatgttgaggcggacaaagccttcgccatcagccacaaaatagctgccgacaacgcaggataagtcagctgcggtgaagaactgtttcatgctggtctcgtcagggaaaagccgatgcgtgtcaatccaagctagaaaaccagattcggctggcattaccttcatctcggaaatcgcggcgaggcgcgtttttaaatagtcaaaattggcagcgacataagcgaccatctcatctaaccaagcatcgcagtctgtgtacgcggcgataagcgctggaacggcaaaactgttgggtgaggtgatcgagttggcgctgaattgttggctgagccgcgcccgaattgcgggatcgggaatgaccacataggatgtcttcagaccacctaaattaaaggctttgttgggtgacaaacagagaatgcattgcgactgaatagctgggtcggcttgccaaatgctggtaaagttgacgccgggataaacaatatcgcggtgaatttcatcgctgatcagtaaaacatgatgttgtcggcagagctcagctactttcgccagttccgccgccgtccagacccgaccggagggattttgggggctgcagagaatgaataacttgacatcagggcgttgcattttggtcgtcatgtcggcgaaatcaaagaagtagcggccttccttaatcgccaatgggctggtcacgagctggcggtgattgttctgaaccgcttcggcgaaaggatcgtaggcaggggtgttgattaaaaccgcctcaccgggtgccgtaaaggcttggacaagatagtgtagtgtcgggacggtgccatagctcagcttgatccagtctttttcaagcttcagcccgaatcgacgggcattccaggcgatgacggcggtgtaaaaagcttcaggaatataggtatagctatagtctggcactgccgcccgcgccatcatagcttggtgaatcggcggagcaactggaaagtctaaatcggccagatccatgggaatcgcatctggcgttaggccgaatttttcagcgagcacctgatcagcccacttgcgcgcattgccggctttgcggtcgaaaagggtgtcaaactggctcattttccacaacctccagttggattaaatggcgcggtgtttgattcaaaacgcgggcaccggttgcggtgatcaccacgtcatcttcgattcgcaccccgccaatgccaggcaaataggcgcctggttcgaccgtcacgatcatgccaggctgtaagatcgtctggctgcgcgggttgagaatcggctgatcgccgcctagccccagcccgtggccgagaccatgggtgaagcagtcgccataaccagcggcggtcaaaacgccccgcgcgattgcgtcaacttcacggccttgcatccccggcttgatggcggcaatcgcggtttgctgggcggtgagaacggcttcgtgcaccgccgccagttcgggagcaggcgagccgatggcaagtgtccgtgtcatatctgattggtagtcatcgaaaaccactccgaagtcaaccgtgatcagctcgccttcctccaaacgccgagcagtcggccggccgtgcggaaacgctcctcgtgggccgctggcgacgatcgggtcaaacgccatcgcagacgcccctgcttccaacgtgtaaaaatgcagccaggcactaagcgtttgttcgctgacccccggccgaatatgcgggaggagttgggcaaaaatggtgtctgtaactgcgcaagcagccgttaccgcagcaatttccgcttcatctttaaccgtccgttgccgcgccacgagatcatcggcaagggtgagggcccatgcctgggacgctaatgcttgatactccgcgattgaaaagccgctgctgactagaccgatgcgctggctaccttgcgtttttaagcagtcgatcaattgtggcaaataactgccttgagggacttcgacattcgtaaatccttgggtatcggcggcttcagcacggtaacgaccgtcgtgaagctgcagtgcctgcgttggcgtgacgatcacatacacgccactgcccggtaatgcaccgacatagcgtttgcttggccgatcatgcagcagcaaagcgtctaatgcttcggcttccagagcttcttgtaacttggttaagtggctcattcttttcctctcattccatacatacctttggaaaaagggtgcacatcaatcaggcggcacccttagcaacatctattttccgcaaactcggctgattaaaagtcgagatccaatccagccaaggtatcttcgtcttcttttgaaaagattgacttttgggcagcttttttggcttcatcgcgtaattcaacgcgttccatcaccttaaagaatggccagtaaagtgcgaccgccaaaaccagttgcaaggcgttggctaaaatcgtgcggtagtcgccgttggttaagaaaccttccaggaaaacgccgacatacggtgggttgaagatcggtttggcaatccagccccaatgcatgaagaacatcggcaacgtcccaatgatggcgccaccgaaaacgtgcgggatgaacataatcggattcaggataatcggcgcgccgaaaaggatcggttcgttgatcccgaacaaagccgggaatagggagattttaccgattttacgataccgtttactcttggataacatgcaggcaaccacgcagccgatcgagatgccgcagccggtaaaaccgaagaagctggaaaccgcgccggctgtgtaaaaatggggaatggcttcgccggcattcatcgcggcaatattttcggcgatgaaggtcaccataatcggactggtgattggtgagaaaaccgatgagtggataccgaagaaaaagacggtacagatcgcaaagttcagggctaagacggcccatggattgtccatactgccgaccagtggcgccaagaagcgggtcaaaatgcttggcggcaactcgccagctatgtttaagaaagcaaaccggccggcaataaatgcgccaccggtaatgagggtgaccggaatcagctcaaatgaacgggacacgaaatccggtaccccttcaggcattttgatcgtcaggtggtgtgttttgcaccagtgatacagttccaccgtcagcaaagcgaccagcatcccggtgaacagtccgcgagcgccaaggttggcgacatctaattggccggctttgttgaaggtagcgaccatcatcaaaaaggcaaagccagacaaggtgacgcatccaggaatatagagcttgtaatgattaccgaggttgtaggcaatggataaacaggcatatagcccgatcatgccaatagacaacttgaccggtaaatcaaacagtgcggcgttgctagtaatgaactgcgaaacagcatttttaggtccgagcatattcggcaacgccggaatgatggtgaaaatactaccgagaatggtaaaaggcgtcatcgccaccattccagccttaatcgcgcttaagtggcgttgattatccaccttgtgcgcaatcggcatgaaaaaacgattcataaacgcttcaaacttgttaaacatcgcaggttttactcctctccttcgccaggggcgcgctatcgtaagtcttaaccagcgtgcttcttctggtatttggcatgtgtcaccagcgccagcttcatcacagtcgcaccatccatctgaccgtaaacgtccttgtcgatcacggcataaggaatgtgccgcggttcgcagatttcgctaatgtagccggttttgtgaccgatttgcggcccgaccaaaacgatgtcatagttatcgatttcgtcctccagaccatcgacgggaatggcattgaagtgaaaatcagcttcattcagcttgcggctgtctttcacaaccttggccatattttgcatcaacatattggtggaaaagccaccagcacaacataaaagaatacgcatttggaagttcctcctatttttgagtgttgggaattggcatagcaatttttttaaccgcgtctgctcacgctctgctttcaaaaatatcaatcattgtctcaatcaagtccctcgccaactggctagtcatgtagtggtcttgggcgtggaccatgagcaagttgacgggttcgggggtatgatcagggtcaaattctcgactgatcatggcggtttgggcgttgtgagcggcgacatcaatttctttagactccgccaacaaattgcgcgcgcggtcaaagtcgcgtgttttcaccgctgccaacgcctcgaatgctttggttttactttcgccggcgttcgcaatgagttgcatgatttcaagttcttgggtggttgccataaaacgctcctttaaaatgccagcagtggtaacgcggctggctggattttttcatcagggattaggacgactggaagccgccatcaatggtgctaaaaagtgtgggcagcttcgaccagttgcaacgacatttgccggcacatggcagcatataaggcgaccatgtgatcaacatcggctgcttgggcgagcgattgggcacagtggccatagcgacacggcaaaaaagtcacgaccgtcggaatgccagcgccgactttatgcgcctcaccgccatcggtaccaccgccattaaacatgtccagttgcaatggcagggaagccgcagctgcggtctctttgacgaattgctgcagttgacgattcggcgccaacgtgcgatcaaagtgcgtaaggatcggccccttaccgacctgacgctggttcacttcgctgcgctcgcggggatgttgaaaagtcgcgacatccacaatgaaagccagatccggttgaattagttgggtggcggttttggcaccgcgaatgccgacttcttcgctgctagtcgcggcaaaatgcagcgtgaacggcaactctttatcggcaagctctgtcaaaagccgcgcaccgacatagcagccgaggcgatcatctaatgctttaccgccaaaaacgcctttcgtagcatattcgctgaattcggtcgcaaaggtgaccatgtcgccgatgttaatgcccaacgcggatacttcatcagccgaattggcaccgacatcgcacaacacttgatcaaaggcaggcagcgattcatcgcgaatgactattcccggtagcttttctccggcaaccgttgtgacccgaacgctttgccagtggctagcagcaggtttaaccccgccgacaaccatcaagcgtaagaggccttcgggtgtgatcgtccggaccatatagccgacttcatccatgtggccataaatcatgattgaaaactgcggcttggcagctcttttggtaaaaatcagactaccaaggccatccgtctgggtagcaaagccacacggtgctaaataatggcgtaaaatgttgcgcacttcgccttcgttggcggcgattgcgtcggcattgcttaacgcagccattagttgtaaatccatgttgattccgctccttccagcgctgtgcgcaagatttggtgaaatgacgaaaattcggtttgctgaactagtttgttgatggcgtccggcttttgcattaaggccgccagttgcatggttaacgtacggtgcaagggaagctgatcctgtttcaaggcgatcagccagacaaggtgcaccggccgggttgtgttggtggcgctgtttggcaaaagaatgacggcgactgcatttttcttggcgttgaatgacaagggatgcggaatcgcgatgccattgtcatagatggtcggcagaaaatcttcccgctgaagcaccgaagccgcatagtccgcctgcccgcagtaatcggccattgtcgcggtgacggtggtcagcaggctgcgatagtcagttggcgtcgattgctggaaaaatagcgatggaaccaacaaatcggccagtgacgctgtcgcattgtggcgagaggcgaccgataattcgtgacgcaaatgcgcaaagtccagatccgaagcaacttcgtcaatccggatcaccggacagtcaaacgattcgtttaaggtagttaccgtaaacaacaagtccggtgatagctcgtgaatcgcagttaactcgttaagcccgaatgtctgaatcatggcttcaggaaaaattcgccgtaagcgtaagcacaaaagcgtcgcaatcccgccgccggtaccgcacacgaccgcaattcggtagccgccgcggctccatttttcatgggcctgctctagcggtaccaacaggtgggttgtgaggtagccgatttcggttttgggcacatcaatttgatattcctggctcagccactgcgcgaattggaccgcccagttaaatgcgatcgggtaatcccgtgccaatggttccagattcaagcccgccaaactttggtgttcctgcagccgaccaatcaaggccaagacgtggaagtacatgagtgacaggaattccggatgcgtggcgaagttcgtttcgtggcgctcatctaatgccgtgaagtaagcttgaagtttagctttcagtcgatcatgatccagccgggtcgtcagttgtttgcgttttgccgcaaaactgacgattaaaaattcccaggcttccgtccccaaacggatgtcggtcaccacgtctgcaaatggtgcatcgtcaggcgcaggttgtggttgctgaccggtgacggccaacgaccagccaatttcactggcaaactgggccgttaccggcggatccagtcctagtggttgcacttgttgcgtgagtgttgagtggcggggtggcaacccatattgttgcaaggcaagaatccgactttgccagtggcagcacacccgcaccccataatgtgctttgcgttctaaggtcagcggcgtgccaacaagtaacttatccagctcccgtaaatcacgttgcaactgcttaggactgatttgctgggtttccgccagcgtggcgaccgtgagatattgcgtcgttgtcaacaagagacgtaacaactccgggattcttttagcaggcatctgtggttgtgcttgctgcttcatggcggctaaataatccgccagaagttgcgagtctgttacctggagttgataaccgcgaccacgttgaaagcaaatctgaaaaccggtcgcatcacgattcaataaccgtaaatcattttgcaatgttcgccgcgaaaccccaatcgcctcggccaaagccgctgcggacatcgcaccgtttgcctgtagtgcttgaataatcatgtgttcacgcaagtaagttcccccaatccgtaagcgctttcaacgatgatgttattatgccggaaataagcgcctgccaaaagccccacttttgcagcttggcatggcaaaaatggcggggttgtggcagtcgcttagaaagtgagcgaaagttttgctcacttgtagacgctcagtgctttttagttgatttgtccttatatacgtcatataatcattttgacgtatataaggacaaaaaggcggatgaacatgaatgacattaaagggcttgacgcgctgttgaaaaagtatcacacctttgtcagtggtacggcacgccgttatggtatttcctcatcaatgcttaaaagtgctgtcaatatcggccgtatctcgcgtgaagagcgtggcgtttacgtcgaagatggttatacatgggatgactttgcggttctgtctcaacgatatactaaaggcatcttcgcgttggatacggccttatttttgcatggcctaacggatcagctccctgaccgatttatcatggcttttccgcatggataccggaatcctcgtttagcggaatatggggttgtgccaatttattatgtctctgaccggtattttccagggattacaactgtcgaaactcctaacatgggaatcgtgccagtttactcggtagaaagaacaattcttgaattttgggagcgcgcagatgtagcgccatatatgcgcaaagaagccattaacaattatatgtatgaatatggcaacagtgttgagtcgtatcgtaaactcaaggaacttaaggaacaactatatcccaggagtgatatttttaagttgttggaggttcttaactgatggacccttacgcaaatctgtcccctcagaagattgccaatacattggtgagcatgttaaatcaagcttaatctgatgaaactgtgctagattagtggactttattgaaaattagattagattgaatcaaaaacattatttccaaagtaaagacgaccagcttctcacagaactgcatgtgcttgcagtccgaggaaagttggtcgtcttcgtttcgattaaaacatatgattttaagacggaaaccagcgtcaccagccgtaagatcattgcgaaaccagtcatcaacactgtatggctctttaaaccaccgtgccgtcagcgttcagctgtgccatatgaattaaagtttcggcaattttacccatggcctctgtggagacaacctcataaggaccgtggaaattaatgccgccgttgaacaggttaggtgtcgggataccttgataagtaatttttgaaccgtctgtcccaccgcggaacggaacggttttaggtgtgagtccggccgccttgatcccagcttcagctaagcggagcgggtaaggatccttgttgatgatgtcggccatgttgtagtactggtcgtacatggacactttcaaacgtgggtggtcaaattgcgcattgagttcgtcaataacttttttaaagtaggctttgcgggcctcgaattgttggtgatcgaagtcgcgaataatgtaagttagttgggcttcgctgatttcgccatgaaacttcaagagcaagaagtagccttcatgaccggcactgaattccggacggtcaaaagcgggcaaggcagcgtcgagctggcgcccaagcgtgttggcattcaccatcagtcccttggcttcccccggatgaactgaggtgccttcaattgtcaccgtggcttgcgcagcattgaaggtttcatattcaatttgccccggatcgccgttatccagtgtgtaggcaaaatcagtcgcaaaacccttggcgtcaaatttatcggcgccgacaccgatctcctcgtccggtccaaaaccaaacttgatgaggccatgtttaatttccggatgagccagcaaataccgcgccgtcgccactgcaccggcgattccggctttgtcgtcaacacccagtaaagtggtgccatcgccagtaataagtgtttgaccaaaatactgcttcaaagccggaaactgctcaacggtcaaccgcaacccgttagcaaattcaatcgggctgccatcgtaatgcggatgaacttgtggctgcacgttttcggcattgtaatccgccgtgtccaaatgagcgatgatgccaaaacttttgaccggcttgtcggtgttagccggcaatgtggccgttacgaaaccgttttttgcatttaagccgacatcctgtagccctaagtcttgcaactgctggaccagtaacttggccaattctgtttggcccggcgtcgagggggtcgtgtcgcgtcccggataagagcgggtgttgatttttgcataacggataaagtctgcctgtatttgcgctaaatcaaggtcaatcgtcaatgagaatccctgccttttcgatgagaaaaatattaacattacattgcaataagtttgaatctggcttagtattttgtcaatagcgcaatttgagaattattggagggatacatatgtttaggtcaaaaaaatggcttttggcgttaccatcagccgcactcgtccttttggccgccggttgctcatcaagcagtagcggtcaaagtgggcaatcaagtaccaatcaaacgctcaattggtcagaaacatcagcaattgtgacgaacgatccttcgcaatcaacggataccgtttcttttcaggtcctaaataatactcaagaagggatttaccggttaaccgacaaggggcaaaagccgcagttggcactggctaaaaaggtgacgaccagtaaagatggcatgacttaccacgtcaccttgcgcaatgccaaatggagcaatggcgatccaattagggcgcaggacttcgtgtatagttggcagcgcaccgtcgatcctaagaccaaagccaccgatgcgttctactttgcgcccgtgaaaaatgccacggccatcaccaaaggcaccaagccagcatccgatctgggcatcaaagccactgacagccatcatttgaccatcacgctggaaaatccgaccgcttacttcaagaagctgttggcgttccctctgtattatccgcagaatcaaaaagtggttgaaaaatatggtaaaaagtatgggacttccgcaaccacacaggtatacagtggcctgttcaagttgacgaagtggaatggtaccggtgatagctggacacttgccaaaaacccgcagtactgggataaaaaacacgtcaaactggctaaggttaatgaaacggtcatcaaggatgtccaaaccgggatgaacctttatcaaaccaagaagttggattcaatcgttttgactggtgagcaagcagctgcccatcttaatgacaaagatgcggttaagcgattgtcttccaatatgacgcgggtcgatctgaatcaaaaacaggttccagcattcaagaatctcaaagtgcgccaagctttttccatgatgattaaccgcaccgcgctgaccaagaatgttttgaaagatggctctaagccagcgctgggcttcattccagtcgggctgcacaccaatcaaaaaaccggcgcagattttgccaagacaacgcaggtgaaaagtgcggtggcgtatgacaaaaccaaggccaagaagttgtttgaagaaggcatgaaagaatcgggccagagtcagctgaacttaacactgctagccgatgatacggatgtttccaagcaggttgccgaatacctacaaggtgcgtttgaaaacctgccgcatgtcaaagtgacgatcaaaagcattccgaaggcacaacggctgcaagccatgaacgccggcaactatgacatggtggtgacggtgtggcagtcgattttcgctgacgcctacaacttcctggacgtctggatcagcgactccagttacaattcatcaggctacaaagatgccaagttggatcagttgctaagcgaaaccgaaaccaagtacggcaacgatccgcaaaagcgctggaccatgttgcaagacgccgaaaagatcttgatgaaggatcaaggcactttgccgctatatcaagctgataacctgcagttgttacggtcaaacgtgaagggattgtcattcaatcctaacgggacaccgtatgacttcaagacggcttatctgaagtgatcattaagtgaaaataaacagcccatcatgctatgcacatagaaacggtgcagcatgatgggctgtttgcatgctatgaaaccagcagctacattcttcgaaagaaggtaatgactttggttttagaactatagtacgtcacaatcctaaagaaaggagtagtttcttatcttgtgaaagatgcacctgactgaatgtttcagtttgtcttgccctgctgacattagtcattgtgctgattgaccgaaataacacaaaatagccgttccgcacagccagtgaattaacggctactttgtggccttaaatgagttgctgttaaatatcattttaaaagagctggtgttgacgcaccgaactcttttgtatggatataaaagcatgcaactaaagaagcatcaatagtgatatgacgttcctgaagccgcttaacaaacgtttaataataacgaatgctattctaaaaagtggtttctattctaatcagcctcatgttacaataaattcagaatgctacgcgacggcagctacgaacttcgaaagagggtgatagctatggttttaggactgtagtgcatcgcaaatctgtagaaaggagtagcatttttgtccgtaaaggatgcacttgagctgatgctccagtttggcagtttcattcttgccttactggcattagtcatcgtgctaaccgaacgggaccgcaaaaaatagccgtcacgcctggcaagcgaattgacgactattttttgctagtctaatatgagctgccgttaaatggcattccaaggggcttggtgtttacgcaccgagccctttgtacgtttttattatatcatgcagattccaaatgcgctacagcagtgctttaaacttttataaatattcgacaagaatcaaataataacaattagtattttaaaaggcattaacaacgtcaactaagcacatgttacaataaattcaggatgctacgcgacggcagctacgaacttcgaaagaaggtgatagctatggttttagtactgtagtgcatcgcaaatctttggaaaggagcagtattgtgccagtcaaagacgcacttgacttgatgcttcagttcggcagtttcattcttgccctactggcgttagtcattgtgctaattgacaggaataacacaaaatagccgtcccgcacagctagcgagttgacggctattttgtagctttaaacgagctgctgttaaatatcattccagagaacttggtgttcccgcaccaagctctttgtacgttttattatatcatgcagatttcgaatctgctacggtaacgtatcaaaaacatactcacgagcttaaagcttgcgtgtaaggattcatgactaactcgacctgctcaggttcttcgatgctaagacacatccacgcacgcacgactttcctgtagcgcttccaaataaaaagtgatatactgccgttacaatcgaatagaaacatttggggtgctgtaaaagctgagatgatacccatggaacctgatgcagttagtactgtcgcagggaaatgtcgttaagatcaatcgtttttaatgatgcttatttgtgatttcatggaccccgccgatgatttggtgacgggtccttttttgttgagcgcgaacaggagcgcttagaaatcggagtgtaagtggccttgaagtccaaatggctgggctttggccatttggacttcaaggtccttacacgtagatttctgcgactgtgagcgcgttatagaacgcggcagttagactccgcatgtgcccaaaatataacaaattccccgcgtaaaaatcgcaccattacgtctgggctttggccatttaggcttgaggtccttacacgcagatttctgcgactgcgaacgcgttatagagcgcggacgccggtctttacccaattgcggtctgaagtccttacacgcagacttctacactggcgatcgcgttatggtgagccaccgcgctttttgatttggcgggtgagccaacatgagacacaggtaagcttcaaaatgatgaattgatcgtgcttggcccccgtttgtctttatttgaagaaatgggggttatttttatggataaatggtcgttgcgcgatgttgtgttgctggcatttctggcctttctgtttggtggtgtctttatgggtgccgatgcgatttacgcgttgttggcagcggcattgacgccaatcggttatgcgccgtttgccaacgaaattctgtttggtatgtgggtaatggcagcaccgatgaccgccatgttgctgaaaaagaaaggcagttcgattttaggtgaatgtttggcggcgctgtcggagatgctctatggatcctactttggcccggctgtgttgctgtccggttttgttcaaggcttgggtagtgaagcgggattcatcgtgacccgttatcggcgctatgacacagtgagtctacttttggccgcagttgggacgacggttttcagttttacctatgagtacttcaaattggggtacggcgcatacagtctgggtatgattctggcgctggtgacagttcgcttgctgtcggttattttcttcggcgttgttttggttcaactcgtaatgaaactttatgaacaagccgctggtgtcaagcgactggctggcaggtcgtaaatgatgggaattgaactacgaaaattgcgatttcagcgggatggcccattgtttgacggtctcgatttcgaatttacgacgggcgcaatgaccgttctgaccggcgacagtggcagtggtaagtcgaccttgctcaacttgattgccggatttgcgccactgacttatgaaggcacgattttggtggatggacaggataatcgcaacgcgtctatgcaaacgaaagcaagccgagtgggaatgctgtttcagaatcctgatcagcaatttaccatgcgaaccttacgcggtgaactcaactttgctctggaaaatctcgacttgccggctgatgtgatggcgaaacaaatccggcaggcggtggcgctaggtgaaaccgatgactttttggatcgggacttacagacactttccggtggtgaaaagcagcgcgcggcgttaacggttttgctggcgatggatgcaccggttttgttgctagatgagccgtttgccagcattgatccggctagtcggcagcaactcattaccaagttgggtaaattacgcgatgcggggaaaaccattgtcattgccgaccatgacttaagcgattatgccggcgttgccgatgaacttgtgtccttgaaaaagggacagctgatccgcttgccattagcaacactcaccacaattccgacccattttcatttaacgcaaaccgatgcggccacgacgcccttgtttcatcttgatcaggtggtttgtgcccagaatcgccgggtgttgattcgcgcggctgactggcattttaataccggcatcacgaccctgactggcgctaatggcagcggtaagtcgacgttgttgcgggccatggtgcaactgcatccttatcaaggtcgcatgtttctcggtgaacggcgcttgtggcgcagacagcgattgttccagacgatgacgctggcggtgcaagatgccaccaagcagtttgtgacgctgacgcctgcggatgaattaaagttcggtgccccgctcacggcggaagttcgcgaacgccaacaagcggccctcgactatctgggattgacggagaagcaaaccggcagcttgtatcacttgagcgacgggcaaaagaaaatgattcaactaattgccatgttgagcctggaccggtcctttttactgctagacgagccgtttagcgggctggatgagcgtgcgtgtgcatttttcaccgcatggattaaggaaaaagcagctgaggaagccttcttgattgtgacccatcggcttgctccgttggccggtgtgagtcaacagcatgttcggttggctgatcaacacttggcggtgcttggggagtgagaagatgttgccaaaaaagaccaatgcgctgaatctgagtttgctgatactgcttttgacgcttgaaatatcgttcagtcattcggtgaaacttgacttggcgttgattggtttagctactggttttctgctgtggcggcgtgcatttaaaagtctagttgttttagcgttgctcccaatgataccggcggcgagcacatactgggcgatcaccttacacggtacggatacgtcctacgcgttgttactgtttgtgcggacttatgccttcgccgcgctgggcttggtgtttctgatcggtgtcgatctagaggcgttgctgctgtggctggaacaacataagctgtcgcctaattttgtctacggcttgctggttgtcattcatgccttgccgcaaatcatgcatgaggttgcagcgattcgcgaagccagtctattgcgcgggcaaaagctgcatccgtggtcacccatgatttacgtcaaagtgatttttgtcgccatgtcgtggcaagacgagtacgtcaaagccatgtacgcccatggttatacagaaggcgccaaacgaaacgtgcgccgcgcgatcattagctcacgccgcggcttggttgcggcagcggcactatttctgcttttgaatgtgttggttcgatagctgttgtcatggccatgaggcgaaaaacctgtgatacggacgagaacattgattaacgagaggatgaaaaatgaaattttcagaacttgcacggcaacaggtcgtgccttattgggaagggagtctgtcgcatccgtttctgactgagttacaggatggaacgcttgattcgacgattttccggttttacctgattcaggatgcgtattatttgaaacactttagccatctgtacgcattgattgccaagcaggcgcaagagcctgaattgaaaacttacgcggaacagtctgcggctggcttggcggcaggcgagttggctgtacggcaggatttttttgaaaccttggcgattactgatgacgaagtagcggcgacggcgattgccccgacagcgtaccattacgtttcgcacatgtaccgccagttagtcgaaggcacgccgcatgttgcgattgcggggatgctgccgtgtccatggctttatcaggaagtcgggcaatatttggcgcagcgccagtcaccagtgccgatttaccagcgctggatcgaaacctatagcagcgatgaaaatgctgatgaccagcaggcagcagtcgcactggttgatcggctttacgagcacagcacaccagccgaacaacaacagatgattgccgcttttaagatcagttcacagatggaatacagtttttgggagatggcctatcgcttggaagcatggccaaaagggaggatcgccgatggggcaaaaccgcgttaaacggctggccatgttagccatgatgattgcattggatgttgtgttgtcgccgttgtttcggattgaagggatggcgccgatgtcaagcgtggtcaacgtggtcgctgccgttgtgatgggaccgctatacgccacggtgatggcctttgcctgcgccattttacggatgacgctactgggcattccgccactcgccttaaccggtgcggttttcggagcatttttagccggcatcggttatcgcttgggccggaaaaattggtgggccgctgctggcgagattctgggcaccggtttgatcggttcgctgctgtcgtatccggtgatggtttggttcaccggcagcagtcagtccctttactggtttgtatacacgccacggttcttcggcggatccatttccggctcgctcatcgcactatttgttttatatgagttagatcacaacggcatcacgcgccgattgcaaaaaattttttgagtgtgagccggcgcgagtgagcgcattatcgtcaaccaaaataggaggagcaaaacccatgacacaatcaattaccgaagtattcgcagatgcatttaaaaccacttttcccttgaagtcgtcgccgctggtagactgcatcaccaatcccgtgacgatcgaatcgatggccaatgcgcttttatatatcgatgccaagccggtgatggctgatctcccggaagagttcccgaaacttttcacccaaattgacgcactattgctgaatttaggccacatttcgcctgaacgtaaagatagtctgttggcggcgggacgttatgctgcagaaacgcataagccggctgtggtggatcttgtcggggtggcagcaacgcaattgcgctacgacatcggccagcagctattgcaaaatcacccgaacgtggtcaaaggcaacatttccgagatgcgccgttttgccgggttgaaaagtaccggccgcggcgttgatggcagtcagctggatcaaagtgcgacggcgcttgccgaattaacgaaggccttgcaggaactgaccgagcgattcccgaacacgacatttttggcaacgggggagacggatttagttgtcagtgcaaaaggtcaatggcgcttggaaaatggggtgccacaactcgatcggtttaccggtaccggcgatattgttggcgccttgactgcagccttgctgagcatcggcctgtcgaacgatgaggcggttgttttaactgtgagctatttcaactgctgcgctgaggtggccgcggcccaaaatacggcaggcggcatcgcttcattccgggagaagacgttggatcaattgtcgttgttggctgatcaagcagattgggtgcaaatggtgaaaggagaagctttatgaaaccagaagacctgaagctttatttagtgacacaccgctatgacgagtcgcaggcagcgtttttagccaagattaccgcggcgtgtgaaaatggcgtcaccatggttcagctgcgggagaagcagttgaaaacccgtgattattacgcgttggccgagaaagttaagacgatcactgaccactaccacattccgctgatgattgatgatcgcgtggacattgccttggcggttgatgcagcaggggtacacattggcgatgacgaattgccggtggcagtgacccgcaagctgatcggaccggataaaattctgggagtttcgaccaagacgctggccacggccacggctgctgcggcggcaggcgcggattatctcggtgtcggggcgattttcccaacgccaaccaagccggactcgccggtacttagcatcgagacgctcaagaccatcacggcatccgtgccgattccggtagtagcgattggcggcattaaagaaagtaacctcgacactttcaaaaacacaggcattgccggcgtggcgattgtcagtgaaattatgcaggcatcggacacggcccagaaagttcgcgcaatcaaccagaaattgaaagaggtgttgtgacatgggtagcgtcaatcgcacccctcaagtcgtgaccattgccgggtcggactccggcggcggtgccggcatgcaggccgatctgaagacgtttcaggcccgccatgtctttgggatgaacattgtggtggcactcacggcgcaaaatacgtacggcgttcaggctagcttgccgattcctacttactttattgatgcgcagtttcagtcattagctgctgattttgccatcaaggccgccaaaacggggatgttggctgatagtgaacacgtggaggcggtcgttcgcaatctgcagcaagtcgacttcggaccgctaatcgtcgatcccgtcatggttgccaagggtggggcgacgctgcttgaaccggaggccgttgcaacgatcaaaagtaagctactaccactagccgatgtggtgacgcctaatttgccggaagctgagatcatcgtggggaaaccgattaaaacgaatgccgacacggtcgcagcggcgcagaccattcagcagctcggcgtcaaaaatgtcatcatcaaaggtggccatcgcagcgaagatgagcaggcggccgactatattttgcttgaggatggcagcagtttttggctgagcgcgccacgaatcgccacagccaatacccacggcaccggcgatacattctcggcatgcattgccgcggaattagccaagggtcagccattaaaaagtgctatcgtaacggctaaagccttccttcaaggcgccatcagccaaggcattttcgtcggccatggccacggaccgaccaatcactgggcgaagttaagcgataaagtgcgcatgagtgagactaggtaatttttagtatcaacgatgaaccatcatccaggaagataagggtgatggttcattttttatgtcgtcaaaatttttggtatagggaaaaagtttcacacacatgacttaaaaatcacgaactttggacgttggctgttatgtaacagtttgtgcttactaacgagacactgggttaattaagatgattaaactggctattttgcaccgctaacgacatggatacacttttaactttcaggtgtagcagaagaacacgtcaataaagttaaccatgatcacattctcctattttgtttcataaaaatcgaattcttttaattgacagcgcttccataatcgcgttaagcttgattcgcaaagttaagtaaaacgttttacccaaagatgcaggcagggtcgtggatgttatgaagaaaaaagtctcaattactgatgtcgccaaagaaaccgggctttcggtgacaactgtttcgcaaattttgaatggcaaaggtgcgcggttcagcgaagcgtcacgaaaacgggtactggcagctaaggaggcactgggctatgaaccggatttatttgctcgtggtttggtcggcaagcgcggcaactcaattggcgtggtaatcccggacatgatgaaccccttcttcgccagctttgtggtcagtgttgaaaaggcggcaatcccacgtggcttgttcccacagatcttttccatcaacgggtttcatgaaaatgttgactattttattcgtcagtttcttggcgggacgcagcggggattgattttggccgcaccagaggcttcgcaggaaattgttcaaaaagtgggccatcaactcagcctgccgatggtgtttacggatcaggcgaccacgttgatgaccggcgatagcattcgaattgacgagcgccatgcaggttttttggttgcggatcatttgctgcagctggggcatcggcggattgcactggtgttgccagaactgctgaccatcaacttgcaggatcgcctcgccggataccagcaagcctttgcgacccatggcgttacttttgatcaagcgctggttttccgtagcagcttcgatccagaaggcggacggcaggcagtcgcgcaaattgtcaaatccgacgccacggcaattattgcgattaatgatgatgttgccagtggtgtttaccgcggtttgtacgagcagcacaaacggattccggaagattacgcggttgtcggattcgatgatgtcacgcaagctcggttcatgaccccaggcttaaccaccctggcgcaaccggttgaccaacttggccagcaagcagttgagctgctggtggcgcagatgagtggcgaacataatacgcgcaatgccgttgaactgccggtgaagctggtaaagcgcggatcgacgcgctatgttacactttagagaaattttggaggaagaaaaacgatgcctaatcatgttgttgttatcggcagtatcaatgtcgatgctattttgcacattcagcggctgccaaagcctggcgaaactatggaaatggacgccttttcgcaggcggccggggggaaaggagctaatcaggccgttgcggcggcgcgatctggcgccaaaaccagcttcatcggtcgggtcggcgatgatgccaatgcggcctttatgcgtggtgaattggttaaaaataaaatcgacacgcaatacgtgagtacaacgagcggcgagcaaaccggacaagcttatattttgctgcaagcgtccggacaaaattccattatcattcagcatggggctaattttgatctgacgccaaacgatgtgcaaaaagcggcaacctttattcaaaccgccgattttgtggtggccgagttggagaccccggtagacgcaacgacggaagcctttaagatcgctaaagcagccgggaaggtgaccattttaaatccagcgccggcgcaaaaagacttaccgctaacactgctgaaaaatgtggatctcatcacaccgaatgaaaccgaaagtgaattgatcacgggcatcccggtgacagacgaaaccagcatgcgagcctcggcgacgtattatcacgaattgggcattcgcggcgtgatcatcacgttgggctcgaaagggtcgttcatttcgcttgatggtcaagcaaccattgtgccagcctttaaggtgaaggcagttgataccacggcggcaggtgacacgtttatcggcgctttggccagcgtcctgcagatcgatctcaaaaatattgtcgaagccgccacctatgccagtatggccagttcctttacggttcagaagttgggggcgttcccatcgattccgctgggggatgatgttaaggcggcattgaacgagcataaataatttattaagggcaaatcatggaacgagaaaaatcgcgccgatctctcaatagtggagaaatcggcgcgatttttaagtgggtgaaacagacattcaattaatacagactggcaacatatggtttcatgacagtcacaacttcgccgctgccagtgccttcgattagtgcaacggtcagatagctgttcttgtcggcatccatagcaactaggaagccattttctttgccatcagtgtcttgcttttgcttgagttcggcggtgccggttttggcggcgatggtgtggccgtcgatggcaagatcatgcgccgtgccggttgggtcggaaacgacatgggttaacgctgttttgacggtattagccgcgttggcctgcaagacgctggtacgtttacctttggtgtcttggatgagggtcggttgctgcatggtgccgccgttcgcgattgcactgtacatggccgcctgctcgatcggcgataggagcaattgtccttggccgtaagccgtatcagctaaaagcgtttcggaagcgagcttgccggagttagagatctgggcttttttcatcgtcagcggtaagtcggcttgagttttgaaaagtggtgcgaggcctttgagataagccgaagcgcccattttcaaagcgacttgggcgaaccagatgttgtcggagttgaccaaggcttgggtcatattctccggcgaagcattgacggtccgggtcaccttgtagtcaccccaagaggcgtccttctgccatttgaggccggaaattgacttggttgtgtctggcgtaatcgtcttgttttgcaaggcgatggccgctgtcaacatcttgaatgttgagccgggagcgtaacgctgggcgaagcgactgaggaatggcaaggattgattgttggcgtacttatcgtaatcggtctggctgatcccgttgacgaacgcgttcgggtcatagctaggcgcactggccagcgtcagcaattcgccatttttcgggttcatggtcaccacgctgccggatttgccagcaagttgggcataagccgttttctgctggtcggcatcaatggtcagcttcagattcttaccgttcacggcttttttgcttaaaagtgggtgaacgttgctgccgttttgaatcgaaatggtgccgccatcggttccgcgcagttgcttatcataaagttgttccaaaccggttttgccgattttgctgttggcagtcagggtcggatctttgcggatatcctctgcggttgccgtgccgacatagccgatcagctgtgcagcggcttcgcccaatggataagtgcgggagccgattgtctgataggcagcaccggttaatgtcggtgagtcggtgacgactttgaccgggacaaacgtgtcatcggtgacccaggattgcttgagtaacgtttcgaggctggtcaccttcacgttccacgctgcggcaattttctcgaggttggctgtgcgctcgtcgccgctgcctagcttacccggaacaagtccagcctgcgtcacatccccgttcttagcgagcggttggtcgttgcgatcgagaatctgaccgcgcgtggcggcagtgacatcaagttgcaccgtgtccttgccatacatagaagggaaaagcagactcggatcccagcgtatcagccacttgttgccggatttgacaatagacgcatcataatgctgggtgttcagtttgccaactttggtattcatggtggcatcaaacgtcattttgtaactcttggcatcctgcttcttggtggtcactttactgattttaatgttgctggcaccaacccgatcgaaaacggcctgattgcgggcaaccaatgttttcggcgtataatcccagcccggtccggaaaggtgcttggtatccacttgcttgacggccttggtatattggcgcttggcaaatgcttgcgtatacgcttgggccgtggcctgaaccgcatcagcttcggacttggcttgataccagtgataaaagccaaagccgccgccgataatgaccacggcggcaatgacaccgccaatcacggtgagggtcgtttttttcatttttaattctccattctgagagttcgccgactcttgcgccggcgaacgcgttgcacatgtcctaaaatcccaacaaggtcattctacgcttcgaactgtgcggaggaaacttggggaaactaaaaaatgccttagaaaaaacgaatgttatctctaagacttgtctattgacgggcattgacggcaatagaaattctcacaattaatgatgatcggcatgtaagtcttttcgaaaaattttcaatgagttgaatgttttcatctacccagcttgaatcttcagcttcatcagttgctcaatttttataaaactatcttcaaaataaagtattgacgaatttataaacttaggttagcctaactttagtacgtaaccattacgaataaggagggatcgccatattaaaagtcaaccatatcaccgtcagttatcagcggaatctcaatgttgtcgaagatgttagttttgaagtgaaggaaggcgaaatcgttggcattattgggccaaacggtgcgggtaagtctacattaatcaaagctatgatggatcttattccgcatcaaggcaatgcggcgatggacgggcagccgttagcgaaacaggcccagaagatcgcgtacgttcagcaaaaaagcaatattgacctaacgtttcccatcactgtgcgcgaatgtgtggcactgggtctgcaggcgcatgccaatatgttcggctacactggaaaaaacgaaggtagagcgatcgcgcaggcactggaaatggtgggcatgacggattttgccaaacgtcaaatcgggcggttatcgggtggtcaattgcagcgcgttttgattgccaggtgtctggttcaggaagccgacctgattattttggatgaaccgtttgccggcattgataaccgcagcgagtcagccatcatgatcgttctgcgtaagttgcgggcggaaggaaagaccattttaatggtgcatcatgatttaaaaaccgttcgctcatactttgacagtgtcgtgatgatgaatgtccacatgatcggtgcgggtccggttgcgacaacctttacggacacgaatcttgagcaggcgtatggattacccatgcatgtcaatcaaggaggacagtcatgaaactcatttttctgcacgatttagctgaatttcattttttgcagaatgccctgctgacctccatcacagttggcattgttgccggagttatcggaagctttgtgatcttacgcgggatgtccttgatgggcgatgccatttcacatgcggtccttcctggcgtcgcggtttctttcatggtcggtgtgcccacagtagtaggcgctgcaacttttggcattgcggctgcgatattaattaccttgattcgccaacacagcttgattaaaagcgacaccgccattggcattattttcagctcgtttttggcgctcggggttattctgatcgcactggttcacacaaccaccaatctgtttcatattttgtttgggaacgttttggccgttcaagacaaagacatgtatttgaccatcgggattgcgatcgtcgtcatcactttggttgtgctattctttcgccgacttcgattgacatcctttgatccagtgatggcgcaggcgatggggattcataccaacgcttatcattacctgttgatggtgatgctgacgctggttgccgttgtgtcgatgcaaagtgtcggcacgattttgattgtggctttattgatcaccccggcggcaacgatttatctttttgccaatcggttacgcaccatggtcatcgcttccggcgcactgggcggcctgatttcttttgtcggattggtgattggctattcgtttaacatcgcagtcggttcctgcatcgtgcttctcggtacatttgttttcatcgtatgttttccattttccaaaaagcagaacttaatcaaactacctattggaggaagatcatgaaaaataagaaccgtaaaagagtcctcgtacaagcagcgatcgttgtgacggcacttatcgggctgacggcttgcggctccaaaaacaaaagttcggacaaagcggctcagtcggggtcaaaaatttcgatcgttgccacggatacgattattggtgacattgctaaaaacgtggccaaggataaagccaagattcacgtgatcgttccggtgggccaggatccccatgagtatgatccgttgcctgcggatgtgtcagcgaccgggaaggcagatgcaattttttacaatgggatcaatctcgaaaatgcgcccggcgcgtggtttaccaaaatgatgaacaacgaaggcagcaaagcaaaggctaaggcggtggcggtgagtgatggcgtggacgtgattcacctgcaaggtaaaggcgagtcttcgaaacaggatccgcatgcctggctgagtcttgccaacgggatgatttatacgcgcaatattgcgaagaaacttgaaaaagtcgatccgaaaaacgcggctttctataagcgtaatgcggccacctatgaagccaagctgaacaagctgcaccaatcagctaaaaacaagtttgacaaaattccggctgagaagaagctgattgtcactagcgaaggctgtttcaagtatttcagcaaggcctatcaaattccatctgcgtatatctgggagatcaacactgaagaagaaggcacgccggaacagatttcgacgctggttcgtaaattaaaggagacgaaaacgccatcgctgttcgttgaaagtagtgtcaatccgaaaccgatgcaaaccgtctcgaaggataccgggattccgatttatgccacgctattcaccgattctattgctgctccgggtaaaactggcgacagttactatgggatgatgaagtggaatttggaaaagattgcggccggactcgaaaaatagtgtttgaaaaagcgaaacattgcacatatatgagtcatcagaattaactgaaaatccacacaagaagctcaatgagacaatgatcccgttgagctttcttgcatgataggtagcagtttttatattcggcagggcaaaaaacaaggcaaagtttttaaatttgcttgcgcaagcaaataaacatctctataatgacaacaggaggtgaggccgtgattaaacgctggctgattctcatcacccttggtttgttcttctttatggtcatcattgacgggacgattgttgtcgttgccgtgccgaccatcgccaaggatttggcggtaagtccgagccaagtgaacttattgttgacggtttatctcacaacgatcagtgtttgtctgttgtttttcgggcaactggctgatcaatatggacgatcgcgtctattcatttggggcacgtatctctttctgattggttccgggttagccggatttggtagtcactttcaactggttttggcagctcgcgttgtacaggcggtcggggccagtatgacgatggcaacgagttatgcgattgttgccgatgttttcccccctgcgcttttggggcgtgcgttgggaatcgagtcgattttcatttcggcaggggcactggccggtccgggtctcggcggcttaatcttaagtcggttgccctggggctacattttctgggtgaacttacccatcggtttgctttgtttgttaattgaatgggccgtttttccgagagtgacggcagcttcagggaaaaggagggtcgatcaccatggatttctgcagctcattgttattggcgggttgttgctgctgcttcaaataaaccacgtcccgatgctgacagttgggttactagtgctgatcggcggtgtcacctacctgttttggcggcatgagcggcaagcgccggacgcgatgctggatacgcggctgttcaggaaccagcgcttttcgcggaatctggcggcttcgtttttgaattatgttgcggcgtattttttcaccttgctcgcgccgatttatctgcaactcatcctgcgcgtgccggttgccgtgtctgggtatctgctgatgctgacgccgttgaccgcattggtggccaatccacttgctggattcctcactgatcgctgcgatcggcgccggctcatggtgatcggcctgctgctgctcgttgtcacgaacgccgcctttgcactggttcccaatcaaaaagtgctctggccgtttgtcatcgtgtcggttgtctttgcattaggaacggcactgttcacgaacccgaatagtgttgtgctgattcagagtgtcgatgcaagtatgcggggacaggttggtgccgccacctcactggcacgtcagctagggatgagcattggcagtgcggttgctggcctggtcttttaccaaacgctcggcctgatccgccccaatgtcaccgcggctaacgcaggagcaccggcgttactcacggcgcaatgcgtcagtttcttgcttgcggctgggctatttttaattgcagccgtgattttgggaaagaaggttaaagatgcaaaaagaaccggatgagttaattgctaaggtcaatattttggcacgtaatattcagcacgacttggacgaagcactggcgccgaccggactcaatgccagtaactattactttattttaaaacttggcaccgcagatgaaatgagccaagaagctttgttcaagatgattcaccttgatcctagcaatgtgacgcgcagattggcacaattggttacctttgggttagtggtcaagcggcgctccgataaggacaagcgcgcatgggtcattagcctaacgccaaaaggtcgtaaactagtgccacgcgtggcgcaaattgttgcaggatatgaagaaatgctcactgagaagatgcatatcgataataagaccaagtttggacacatgttggatcagcttattgaaacggaaaaggagttggaattttgaaaaacgaattcatgaacttactgcctattccccaagactttcacgtggtcgaaaccaatgtccgcaaacgcaacagggcaagcgtcacggtcgaacgattccaagacactgatgacatcacgcctaataacaaacatctgaccgtggtcaccgaccaaaaaggccacttgatcagcttcaactcaagtgctttcaaaaacggtgggcatttaccagctgcggacaaggccttggagcaggccatcaccttgttcaatcaactcgatcccgactatgctgccggcttgagttacatgcgcaccgagcgccaagaacggcattatgaagacaacggtgtacatgtttcggcaccggtctattggatcaagtttgcccaccggaacggttcctacaactgggtcaccatcgggccagacaaccaagtgatcgaagtcgaacgtgaatcgttgtgggactattttggcaatcggcgcgcgacggagatgtggaacaacgataactgggtcttggctagagaaggcaaggcgccgcagttgtcagcaccggatgcgttagcgtaacgaggtgaccggatggctaaaccggattttgacacactgatcaggcgactgggcgatttgcaagaagaggcccgccgtctggaagaagaggactatatcagtgcacggtacaaagggtatagttccgaaggcctcactttggaagaggtgatggcgcggttgaaaaaggtcgaacgcgagattgctaaattggaagagcggttgacgcgtttggatgatgaggtgtagcgcgttgtgatcatggtttaagctgatcaagttagcttgataccttgggaaatgttagtcaacagaaacgcgagaagatcgggtttaacggcatgacttgtcgttgaacccgatctttttgatacggttttaactggtcagcgatgactgccaaaagttgttttgggtcggtccagccagcaatagaatgacccgtttgcatatacatcgttgtaccaaacgttttcaaagttgctgtgattgtttcgatgtcaaaggtacaacgtttcgtctgggataggtgaattgacaaacgtgctgatggtgtcctggatgctgttgagttctgtctgcgacattggttttgcctttctgttgtgatggctgcgtttcacgaccgctgcgattgggttcgtatgtcgttatcataagcgagttggggtagtgaaacaaggtttatagattaagcgtcaaatattgcggagtgccttagtggtatgtattcaatgtacatatttcccaaaaataaatattcgtatggattgacgaaaacgaaatatacgctataatttaaatacgatgaataatccaaaattcgaatcttataaacgacccaatggacacgatgaattcaaggaatggctttacgcacttccagagaaagatgctgcaaaacttctgcgagtgattgaagaaaccgaaaaaaacggaatgcttgtcgcacagcgtttaaaatgggttaagaaaattagctcaaatttgtatgaaattagaagcaacgtagcatccaacattcaacgggccctttattttcacgtcacagataatcgctacattattacgcatggcttcactaagaagacaaaccagactcctgcagcagaaaagaaacatgctgaagagctgaggaaggaatggtacgctcatgaaaattgatgacatgattaaggaaaaacgtaaaaacccagagttcaacaaggcatacgaagcggagggagaaaagcttgccactgcggtcgcactttatcatgcaagagaggctgctggtttgactcaagccgagttagctgagagagccgacacgacacaagcgactattgcaaaaattgagcggggagataacgtctcatttgagaagcttcagtctcttgcccatgctctgggtaaaaagcttatcgtcaaatttggctaacagaatcaagatcctaccaaatgctagtactcgacagatcacccaccctatcaacacactggatgggtgatttttgtcaaaagcagaaacgaatccatcatgatcattgctagaaccgtgtatggttaccgaacgcatcgtacaatattgtctgttagagctttaaccatattaaaatagttttgacaaggaaggagatggacattgtgctcgaagcacgtactgttcagcttgataattcgttagcattaattctaccaaaaggcaaagggttcgctgagaaacaaatttggcttcttgtaccattagatgatggtgaacctggctatacactgacccctaagcttaaggatccatatgtaggtaaaaagaagggatcaatgtatgttcccgaagaatggccagactttggctatcgcaatgtggagtagtatgacgaaataagaatttttttcggaaaaattacgtttgttttagttgaccaaaactaggtctaacgatattgtttaatcagggtagagtactgaatgtcattcgaagatcaccgcggcttagtcaaccgcatattgatagatcgttcgaatgcgtaaacgccttacagcgtatttgtaagcatacttggctaccgccataactattgcggcagtaatggtggcggcttcctgacaatggaagccgtttttttttgcaaaaaaggtccagtgtaatcagcgctaaacatctgcatgacttaccgcatcgaccacaatctgcaatatctaacccaacttttgcaaaagttgagaaaagcccacaactttgttaacctattcacgtataatagtaagcgcattcgcggaggagggcttattttgaaaaagtgggttaaagttacgggaatactagtgctgttgggcgctattttggttggctgtagcagttcggcaagttcaaaatccagttcatcaagctcaaaatcgagcaagacgaccagcactaaggtgacaagtggcgcttcgcaacagacttatacagatcccaagatgatgaagggaaagtatgacattgtgatcatcggtgccggtggtgcggggatgacggctgcgattgaagccaagcagcaaggtatgaatccggtcatttttgaaaagatgccggttgttggcggcaatacgctgaaagcttcgagtggcatgaacgctagccagacaaaagttgaagctgcccaaagcgttaaggatagcaatgacctcttctatgaggaaacgttaaaaggcggcggtggcactaacgataaggtgctgctacgctattttgtcgataactctgctagcgccattgattggctcgattctattggcatcaagctagacaagctgacgatttccggtggaatgtccgtcaaacgcacccatcggccgcatgatggctcggcggtaggtggttatctggttgatggacttgtcaaagaagtcaagaaagagaagattccactgttcgttaacactgacgttaccaagttaaatgaaacgaacggtaaaatcagcggcgtgactgtgaagatcaaccaggataaaaccaagaaaattgcggccaaggctgtgatcgtcacgactggcggttttggcgcaagtaagaagatgatcaagaagtaccgtccggatctcgccaattacgtcacaaccaatcaagccggtgcaaccggcgacggcatcaaaatgattgaaaaagtcggtggttacgcgattgatatgaacaagattcagattcacccaaccgttaaccaaagcaaacacatccttattggcgaagcaacccgtggtgaaggcggtattttggtcaaccaaagtgggaaacgcttctataacgaaatgaacacgcgtgacaaggtctccgctgccatcaacaagcaaaaaggtaaatatgcatgggttgtcatcgactcaggtgtgcggcagcgctcaagtgccattgacttctatattaaagacaagcttgatgtgaaaggcaacacgctggcggaactcgccaagaaaatgaaggttccagctgcaacgttagccaagactgttgcgacttggaacaaggctgtctccagcaaaaacgacactgagtttgggcgcacgaccgggatggatcacggcctcaccactggcccgtactatgccttcaaaatcgcgccaggcattcactacacgatgggcggcgtaaaaatcaacacgaagactgaggtactgaccaagcaacaacaaccgattccagcgttatacgcagctggcgaagtcaccggcggcctgcatggcaataaccgaatcggcggtaattccgtcgctgacatcgtgatcttcggtcggcaggcagggacacaggcggcggcttatgtgaagtcgcaggagtgatttgaatggattaagggcgcttctcttgatgaggggcgtttttttatgccattcgtgcttttttaatcggtcactcaaggtttttccggaggtaggaaaaaagtctgtaagcgcagccaaaaatagaagttaggataagattgtaaacaaataaagcagcgaggtggaacaaaatgaaaaaagtattgttaatctgtggttcgggcgcctcttcaggtttcatggcagcggctggacgaaaagcagcaaagaaagccaaagttgacctcgaattcaaagcgcgatccgattcggaattggatgattacttgaaagggaacgacctattgttaattgcgccgcatctcaaatacatgttagccgatgcgaccaaagaggctgctccgtttggcgtaaaagtcgcgattattccacaaaaggtctacggatccctcgatggggccggcttggtcaagtttgcagaagaagaactcagtaagtaaagaaggggagaataacatgggagaaaaggtgaatgaagaacaggaaacatttgatcgggatgacttgaatgaaatatctatgcaagtgatcctgcacgctggtaatgctcgcgatcaactgctaaatattttagacaagctagctgatcccacgattgacgaagcggtgatcgaagaagacttcgccaatgccaaaaaagaattgaatgaagctcattcgaaacagacaacgatgattcaaaaggaagcagaaggtgaatttattccgtattctgttctattcgttcactcgcaagacacactaatgaccgttcaaagtgaacttctgatgaccgaaaaaatgatcaagatcgtccgatcattgcgggatagttgattaaaaggagggagtaacttatgcaacactttatggattggaggaccgattcgtttgccccaaaggtgaataagctcgcgaagaatccgtggattgcagcggtgcaagatgggattcttgctgcaatgccaatgatcttcatcggttcctttgccactatcattggtattctgagaaactactggccagcaattccagatattagctatatcagcacattcagttttggacttttttccttatttctgtcgtatctggttccagaagctatcatgaaccgtaagaagcacaaagatgtgtcgcggcaagcgggtcttgctgggattgcatttttccttttactgatttatccatcgatcagtgccaaggggattatttcgtttgatgtcaacagtcttgggactggtggcatgattgccgctttggtggctggcattttcgttggctttgttatgaacatttttgccaaaatgcagatttttggggaagattcagccttaccggactttgtggcgatgtggtttaatacgctgattccgattatcgtcattttatttgttggttggttattcaccttccaactacactttaacctttacacagggatcaatgatctattcaaacctttactggcacttggcggcggcttctggggctttgtgatcattaactttatcggcttcagcttcctgtacacttttggtatttctacctgggttatttatccgattcagtctgcgattgctttgccggctattgcggaaaatgcgaagaactttgcagctggtgccgctgtaaccaatatttatacgaatgaagcagtcgatctttacatcattggtggcggtgggtctacgttggcgctttgtatcatgatggccttcatggcaagatcagcgcgtctgaaggtggtcggtcgtgcagggttgatcccatctatctttaacatcaatgaaccgatcattttcggagctccagttgcattcaacccattgctgatggttccgatgtggattatgggtttgatcggcccgattgtaacttggttcgcactttcatggagactggttcctatcccacattcagtcttccagctatggtatgcgccattcccaatactcggttatattgtcactgactcaatcgccggggttatcttcacgacaatcatgttcgctatttcttggctcgtctactacccattctttaaagcctatgaccggcaagaggttaaaaatgaggcgagtgacgatgaggatgaagaaaaaagtgacgaaagtgaagtgagtggcacagggcctgacgatggtgttgaagctatcgtcaatgttgaagtggcaacaggcgctaattagactcagatgagaaggtgggtacacattgaaggtcaacgatacggatatagttgaattcctgcgtaagcgatcaggctgggtcactgcggaaacaattgctcgtcaatttggtgtgtcgccaagaactataaggaatcatattcaatctattaataccgctgaccttgccgtgctttccggtccgttgggttacaaagcaaaaatgttacttcacggttggaaagaaaaagttgatgatcaggagagcgatatagggcagaaactgttatatgaactgttagatagtcacggaagtagcgtctccttagacgagtttctagcaaatcattatctatctgaatcgagtgctcgtgatattatccgcgattttaacagggaccactcagcagataatgttcaggttgtggagaaaaagcgtcaattaagattaatcggagatgaaagtgataaaagaagactgttcaagtcgttcttgcactcaaacagatccgcatccgttccggaagtcaatattcagagaatccaaaggttaattccggatatcccactgctagatatggaaaagatagtcaatgaaacggttaaccaggattcactcacgatcaaccaataccagctgtttgatctattgatgcactacgcgatttcagttaatagaatccaaaatgggaaagcgatgcatcggctttcagcgacacatgaagagttaactggacgcaatgaatataagttgacgttacgaataaccgctcagctggagaaaagatattatatcaagttttccaaggctgaaatcgatggtttaacactggcacttatcggtaaaaccatcatcaagaacttttcgtcaatgcatcttgggaacctaagccgctttgttccagagcgagttattgaggagacccaacgagcactggaaaaggcagatgaagagtatggatttaacttacagaatccgagctttagcgttaagttcatcattcatgttaataatgcccgtgatcgagcgacataccatgacctggatcaacaagacgtgaaccaattcagccttttaaagcaagaatatcctttgtactatgacctggctttatacattggtaaacaactgcaaaatagcctgcatctgacgatgaattctcaagaactaacctatatcatcctgcatttaggagcgtatctgaacaccgatgatattgaccgcatcaacactgtgctgatatcgccttcttattatgatattggtaacgaattaaaaaccaatatttctagagagttcagacaggacattcagatttctgcagtctacaatgcactgcaagtcgaagaactgaagaagttgcgttcaaaactggtcgttgccacgattgacacaagtattccgtttgataagtctaattatgttgtcaggattcatccattcatgacctctcaggatcatgaaaaaattgaacggacaatcagcgttatccgccgggcaaatcgggtggatgaaatcgttggatactttaagcagtatacgtcagcggataattttctgattgatcctcaaatcagtaaaagggacgctcttttcagccgtgtgaccaaattgctgactgagcggggatttgtttcaccgcaatattatgatgagctgagtgaacgggaacaactttcaccgaccagttttgggaacatcgcaatcccacacccgctcaacatgaaggctaacaagacagggatctttgttgtcatcgatcatgatggcatccagtggcattcatccacaaaggtcaacattgcttgtttcattgcgacaagtaaagcaaatcaaaaggtgtttagcatcgtccttcagaatctgatcaatattttgtcggtcaaggagaacgttgaccaaattctgaaagttgataattacgaagactttcttagcgtattaattcaaatactgaaaggtggatatgatacaaatgtctaaactaaagtacacagataagttccccaaggattttctatggggtggggctattgcagccaaccaagctgagggagcttgggacgttgatggccgtggaccaagtcaagctgacaccatgttgttgccggataagtattcaagaaccgtctcactcggtactgatatgcataaatcggatatagaagcggctttaacggataccaaaggaaactatccacggcgtcgcggcattgatttctaccatacttacccagaagatttagaattaatgcacgaaatgggcttcaagtgtttccgcacctctttcagctggagccgaatttttccaaatggagacgaagagaagccgaatgaagagggattgaagttctatgatcggttgatagacaaaatgctggagctcggcatggagccggtcatgaccatttcacattatgaaatgccggtcactttgataacgaagtacggcggatggactaacctgaaactcattgactttttcgttcgtttttcaaaagtgttgattgatcgctatagtaagaaggtcaagtactggatcattttcaaccagatcaacgatgtcagtgactggggcgaatacgcaggtttaggtattttgaaaggcgaatacccggatcaactaacagctcgttaccaaggtgttcaccatcaattcgttgccaacgccaaggtggttaagtacgctcacgaggttaatgccaatcttcaaatgggcgtcatgttggggttaacgcctgtctatccggcgaccagcaagcctgaagacaccatgacggcttataacctctggcggcgagaagacttattcttctcagatgtcctggtcgaaggcgaatatccgggttatatgattagatatttccatgatcataacattgatgtggacgttaaaccagacgagctgaagttgatcaaagataacccggtcgattatgtttcgtttagctattattacagcaccattgcaagcgctgaccaaccggacaaacgacagcttaacccaaacatcgaaaagtcaatttgggactggtcgattgacccgactggctttagatatggattcgactttttgtgggatcggtatcatttaccattgttcgttgcggaaaatgggttaggtgcactggacaaagtcgaagacggaaaagtgcatgatcaatatcgtatcgattatctccgtgctcatgttgaacagatgcgtgaggcgatcaaagatggtgtcaatatcttcggctatgcgtcatggggtccaatcgacattgtgagctactcgcaggcggaaatgagcaaacgttacggatatgtctacgtagatttagatgacaaaggcaatggtagtgggaaacgaattcgtaaagatagtttctactggtatcaaaaggttgttgaaagtaatggcgaggatttgtaatagccagggctatgaaagtcggtcaaactctttttatagaaaagtgctggcgatttaaagcggatcgttcacgcgaaggcggtttccttgatggggagccgtttttttgcgtctaatcaagggtatcgctcacgaggtgtactttgtttcccaagtaaaagaaaaaggttctacttttcggaatgtaagcgcttgcctagtatagaagctgtaagggggtaagacaatgcgagaaagattgacgaatcttctgcgaacattgttggacagttcagagaactcgttatcggatttaagtaaacaattcaacgtcacgaccaaaaccattcggaatgagattcaggttttaaatgaagttttggcggagaaagggttgcctttattcgatatcaaaagaggtgttgcttataatcacatttcaacgcaacagctgcattcgctgtctgatgtacttgactttaacagtattagtcaaggcgcgttaacccctgaacaacgaaaagtttatctgttgctggatttacttcaggcaaggcatcccgtttatcttgtcgatgaacagggagcgatgcagattagcaaaagtacgatggatgccgatttgcgcaacttgcgggctgatttagcgaaatataacttaacgctcacaaccagcccaaagttaggtgcgcagatcgaaggtaatgaacgatccattcgtaccatgtttggggatgtcttaacccgccagcacgcgttagtcactttaatcggtcaacagctgatcgccagtggcatgtatgtcgacaaaatgaaggaagtctttaaccaacaagatgtgacttacatcagcgatctcttgctaaggtgttttccaaatggtgccttggcagcgaacgacatgtatcgccagcaagtgacagtattgctcatcatttggctacaccgagtgcgtagcggacattatgttaaagacgatgagacagcggttgacctcaataagggaaacacgcgcttcctcaatgagttgatccagcactatgacttaacgattgatatcagcagtgagctgggttacgtcggctttttgattaacagttttaatcgtcgcggggcgattgatctggatgactgggttaaggcccagattttcagtgttgcgctgatggattatatggaaacagaaattggctttcctttttccaaaaatgaaaagctttttgaagagctatacaaccacatgactgctttgttcaaacgcctgtcgcggaatatgaaagtggttaatccgctgaaaaagaccattcagcaaggatatagtccaatctatgatgccattaatcgattctttacggctggcccttatcagttaacgatgtccgatgatgagacagcctttcttgccatgtatttttcagcaacacaggctgaagatcggcagcgtcaagattatcagtatcaagccgcagttgtctgcaacttcggaacagcgactggtcgggttttggccgcaaaacttgaagaacgcttcaacattgatgttcttgcagttctcagcacgtcagaagtggggattctccgtaaattgccagtcagtttggttttcaagacggtcgacatgcctattgaggagatccccagtctgaaggtaaacccgattccgtcagaagttgatttgaatcgcatcgcagcctttttaaagaaatatgcagcgctgacaaaatatgaaggccggactttagatccaactagattatttcaaagcattctggacgcgctcaaggcacaccaagtctcggttgataaggggttgctggctgatttgcaggcagcgtttaaggataaccatgtcgaaatcaatgaaagggaggttcagcctatgttgaaagacttaatcaacgaccagcagatcctacttcaacagaaagctgatgattgggaaaatgcgatccgtctttcggcaaaaccattgcttgatgaggattacattaccgagcattacgtacaagcgatgattgattcagtaaagaaattcggtccgtatattgtcattggaccttccatcgcgctagcccatgcgcgcccggaagatggggcaaagaagctgggcgtcaccatcacgacgttagcaaagccaatcaactttggcaatcccgacaatgatcctgtgaaaatcatcttctgtcttgcggcaattgacaattattcgcatctcaacatcatgaaagctattgttcaactcattaatgatcagcaaaaggttgatcaactggctcaacaaacggatatccagcaattcaaaacgattttgtttaacgaaaaaacctcaaaggagacgatttaaatgagtagaaaattaacgatttactttatttgcggggccgggttagggtcttccttagcttgccaaatgacagcagaagacgttttaaatcgcctgggtttggatgaaaatctcgaacacgaagctatttcatcaacgccaggattacgaacggacatcattgtatcggcagaaaattttgcttcacaattcaaacaatatgatcttgatccagctatcaagtttgtctttttgcacaacattgttgatcctgctgagattgaggccaagcttgtgccagtcattaaggaactatccgcaaaagccagctgattcagcacaaacgcgttaggaggaatgaatcatggttgtggttaactttattattcaaaatatcctgacccaagctgccatcaccattgcattaatcgcgatgttgggtttgctcttacagcgtaaatcctttggtgcagttttaaccgggacgttcaagacactattaggcttccaagtgctttccgcgggatccgccattattgtcacggcattgacttatttcggcaagattttccaacatggctttcacttgcaaggcgttgttcccagtattgaggcgattaacggtcaagcgatgaatacgctgggcttagggaatgaaattgccttgaccttcttaggcatctttattgttaacatcctgattgcccgattttcaccgtggaaatatatctttttgaccggacaggcacttttgtggatgtcaacgatgacggttgtcggtgggaaaatggccgggctcaattctgtgctgaccattgttgttggcagtatcattggcgggatctttgccgtcgcaatgcccgccattgctcaaccgtttgttcgtaagattacgaaaggcgatgctattgcgctaggccacttttgtacgatcggctacatggtagaagccggcgctgcgtgggtgtttggtgaacgaggcgaaaagaaacattcgattgaagacattaaattaccgaagtatatggaatttctgcaagacacgtatctgtcggttgcggttgtgatggtgccgttgttcatgattacggcggcttttgcaggccctaaatatgccggaaatggtacgagtctgaactatatcatgaatgcgtttatgatgggcattcaatttgtggtcggcgtctacgttctgctcgctggcgttcggctcttacttggtgaaatcgttccggctttccgtggcattgcgatgaagctggtacctaatgccaagccggcacttgactgcccggtactgtttcctttttcacctaatgcggtcattctgggctttattaccaccacgatcggcactgtcatcggcatgttcttgatgcctgttttcggtctggcggttattctgccggggatgctgacgaacttctttgccggagggactgccggtatcttcggtaatgttgtcggtggtcggcgcggcgccattatcggcggtatcattcacggcttattcatcacgttattgccggcgctactagtaacggccttgacctcgtttggcttcgtgaatgcgtcagcaacggactcggacaccattgttgccatgctgatgtacgcgtggatcctgacgccgattcttaaagcagtttaaagaaaggggcatggatatgtttggcggtttatttaaaaagaaagatgctcagagaccctcatctgcggtgtcaaaacaacgtgatcaaccaatttcgtcaaccgatgctgcggatctgaaggaaaaagttgccagtttaacggaacaaatcaagcgaacaacggacgataaagaaaagcggcatcttttatataaccaactaggcgctgtacaagcaaaattagggaacgatttggcggccattgctgcgtatgaagcgagcatcaaagacaaagaggaattcggggatgcttataatgctttgctgaatctgtatgaggtacagcggaaacaagcggcaaaagcaaagaacgatgacgatattcagaaatgggttagcaaaacagattcgttgcttgatatgtcgaaacgcgtcatgcggtctggttttggctattaatctaggaggcaatcatatgtacaagaatttaaagcaattaatggatgaagcacaagcactcgattacacggtcggcgcctttaacgcgcacaatttagagatggtgccaccaatgatcatggcggccaaggacgcaggctctcctattatcatacaaaccagtgtggcaacggctcaatatgtcggcatgaagaactttgttgctgtttgcaagtcgatggcgcaagacttattagttgatgtggacctgcatcttgatcatgccaagtcgtttgatgccatcaaagaagcgatcgatgccggttattcctcggtcatgtttgatggctcggccctgccaaataaagaaaacatggaacgtgcacgacgggtggccgactatgcccacgaacatggcgtctctgttgaatgtgagattggaacaatcggcggaactgaagaaggcgtaacagttaaggaaggacgttacacagatccgcagcaagcaattacgttcctgaatcatgtagatgttgaagctctggcagtcggcgttggtacgcatcacggccaatttaaatcaaaaaccaaattgaactggcctttaattgaagaattgcatcaagaaatcagtacgccaatggtcattcatggtggcactggcgttaatgaagccgattatcatcgattaactgagaacggattccgaaaattcaacgttgggacagagttgttagttggttggacccgcaaagcaaaagagatgtttggccagacagaagtcaataactctctgcgcaacaacatcgagccatgtaaccaagtcgtttatgatatcgtcaaacacaaaatagggctgttcttaaataaggacgcagaagttccagtgaacgcataaagcgataggaggagacgacacgatggctgttgatacacaagctttggttctgttagcaggcgcgcctggtactggcaaaacgtatgcggcaaacaaaatcatgcaggcaatcagcgggttcgtgtcgctgccgctcgatctttttaaagagcacctctacgatgagctgggtttcgacaatcttcaggaaaagcaaacgcttgatgccgaggcaaggacacgttactaccgtggcattgatattctgatgagcgaacacaaaatgattctaggcgattacccgtttagccgtctgcaaaaaccagcactcgaaaagttggccgcaaagtatcattacccagtcatcacaatccgtttagaagcagacatcaaagtactttataatcgccagcgtcagcgcgatctgtctgatccccgccaccttggccatctcatgaatcattaccatcgtggtgatacccttgaaagtattaacgaaaaacccgatggcatgccttcgtttgaagtgttcagcaaccgagtgtgtgatcgcggctatcagaattttcagattggcaggctgatcagggtggacgtgaatgattatgcgaaggtggattatcagacgctggtggcacgattgaaggagtttttgaaggcatcggctgtcggacaaataggttgaagatatgagactactttgttgacgagtctgtaaaacctatcgtaagacttggaggttgagaagagatcatcgagataaactctcgatgatctcaaccgcgagttagggagctagccttgcatggctggctttttttgttagtgacaaggattacattctgcaaggacgaatatgagccttgacacatactgaagcggacaaaaacatactgaagcgggaaaatagcacaaaaagtttactggtgcagacaaatagttgactaatctgtcatttctaacgtataatttaggagttgagaaaaggccaccggggtgcgacccgatgacctcgaacgcggttcagatgactttggggtaagctaactttgacggttagcttttttgattatcgcatacgctttagcgctactggtaatcagtatgcttagcgcgataataatcgacgccacatccaaaaagtggcaaccccctttgtctcctgagtctggcatggccatcacctccacggttcaaaaaatgttgagtggtgtgtgccatccaatccgctagactaagaagtgagggtaattagtcctctttctctgtcatgattcaagtctataggttgttgcgtatccagtcaataagaacacgttgcaagctttaaacgctttatgtagagatatcacttgtggtcgacatgtttgatttttcaacttaactaattagtaagttgacgaatcagccatttctaacgtataattcagatattgaaaagaggccaccgggatgggaccccgatgacctcgacgcgagttagaaggacgttggagaagctagccgaaacggttagcttcttttaatatcttggttgccagagcgtagatgtaatacgccttggcaatgatcaagatagacaacgctatttctagcgtagccaagtcctccgatccttccgtttagcagggtttcacctccgagagctagaatattgaggggtgttccttgctaattcgctaacctaagtgaagagggtaattgctcctctttcttagccatgcatttagtgtgtagagtatactatatgtcgtcaataagaacggaattatgagataaattggctgacataataaagcttgtttatgttgacgagtcagccatgtttatcgtatagttttggtatccaagtggcgatttttttcgttttacaaatttggcatggctgccacctccacggtttaaagtattgagggtgtgtgccattactatagctctgtctggtaaacttaccgggcagagctatttttttaatcaaatatgtacacgaatacacaagaactgttttcaagatttcactataagcgcttatttacaggcagtgtgagtcgaaagcctaaaaattactgatgagcagccttgactagtgaataaattcacttacagtagttattagaaggttaggacgatagtgtcatttacaaccgaaaccacttgtttgttttcattgcgcaagaatacgtcattcacgacgcttataatctgagaacgcttagaatttttgacacgggtaccatgaaagcattcaatccagtctctgaaggtgtcagggacatttacatgttggatcggaagggaaagaacgcgcatgattaagattttactgggtttaattgtacttattaacttaggtttccttttctattttgtacgtgatttgctacggcaccgctcggaagtcatgacggaaccggcaacaacttgggccttaccattcagctcattcctgatttttcttctttcgacgtttggcatttccgatttcgccattagcaccgcactgtatcctaaggtcaaatgggtatcgatcaaaaaacttcctggtaccttgaatacgcaatgtgttattccggtggctgccatggcgctttcatacattactgccattacggttgatattaaaacgttggcgatttgcatcattgcggcggtgatcggtgcctatatcgggccacagtttgtggttaagcttcccggtgacaccattaaaaagtttgtcacggctggcttgctgattgcggcattgatgattttggcaggcaagttcaactggattcccgctaatggaacggccacgagtttatctggttggaagctgatattgacggctgttttattgttcgtgtacggcgcgttgaacaacattggcattggctcgtatgccctgacgatggcgactgtgtatgccatgggactcaacccgtcagcagcttttccaatcatgatgggtgccgcaactttttctgtttcgacgagttccattcaattcgtcaagttggcagattatagtcggaaaatcactttattcacgtcgacttttggcgttttgggtgttttagttgccgttttctttgtgaaaagtctggacaccagcatgctccaatggctggtgatcgtggtgttgctatattccgtcatcagcatggcattgtcgctgcggcaaaaagaagaagcataacttgttgactaaattttggatgatggaggttatatgatgcggattttgacgaaaaaagatgtgcaagcagtttatacgatgaaagatgcgattgctgacgataaagttgcgctggcggcttattctaagggcgatgcgactgtgccgttgcgggccaacattgatgttcaggcgtaacacggtcagagcctctacatgccgggttatgctgcaggtgagcaacccgcgctcggcgttaaaatcgtctccgtttatcctgataacatcgacaagggcttgccgagtgtcccagcgactatggtcagcctggatcccaagaccggcattgtgtcggcgatcattgacggaacctacctgacgcagctacgaaccggtgcgcttcaaggggcggcgaccgatctactggctaatcctgacgctaaagtggccacgttaatcgggacgggtggtcaggctccaacacagctggaagcgatgctcaatgttcgtcagttaacccgcgtctatgtttctgatatcgaccatgagcgtgcagcaaagtttgcccaagacatgactgctcgttttggtaagcagttcaatgccgacattctgccagtcaacgatctttctaaggcgattcgggcatcggatatcattacatcagttacgacttcaaagcaggcaacctttgatgcagctgatgtacaacccggcacccacgttaacggcattggcgcctatacaccagaaatgcatgagattccggccgagcttgttcaacgggcggacagcgtcattttcgataccatggacggcgttttggcggaagccggcgatatgatcacgccgttgaaagaagggttggtcaccaaagcgcattatgacggcgaactcgggcagttgattaatggcaaaatcaagggtcggcagcagcatgatcaagtgacgctgtttaaagccgttggtacggccgtgttggatgtggttgtggctgagaagattttgcaggcggcggataagcagcatgtggggacgagtgtggatctttagtgctgaattgttgaaaagtggcagttgtgacgtgaagatgtcgcaactgccacttttgcttaccaaaaattcggaagtggaagtatgatcaaaaaaacgagtaatacaacgttgtatttttagatacaacgttgtataatttgaagcgaaatgaaagcgcattcaattcacgaggaggaaagactatgtcaacaaccagtcctgcaccaacgatcatcagcaccgatcctggcattgatgacgcagtagcgattgccattgcgttaggcagtccaatgctagatgtacaactcatttgtcccattgcagggaatgtaagcgtggagaagacaacacttaatacccggcgtttgcttacttttttgaataaagcaccgcgagttgttcagggcagtagtaaaccacttttgcggccgcttaaagatgcaagtggtgttcacggcaagacggggatggatgggtatcccttcccagagcctgctatggaagttgatacgtcgattcctgcggcggttgccatgcatgaaaccgtgatggctaattccagaccagtaacgcttatcggtatcgggccgttaacggatattgctctctttattcatcaatatcccgacgatctaaagaagatcaaagaacttgttttaatgggcggggcacttggacgcggcaaccttggcgttttatccgagtttaattttggaactgatcctgaagccgcaaagattgtgtttaatagtggtctgccaattcgagttgcaccgatggaaattgggcgacaagcaaaaattctacctgaaacatcggaaaagattaagcagttaggcaaggttggcgacatgttttatgcgctgttttccaaatatcgcggtggaagtttcaaaactggtttgaacatgtatgatgcgcttgctgtagcgatgattcttgagccgtcttacttcaatgaagtaacaacccacgtggagattgaaacgcgtggcgaatttacagcgggggcttcactaatcgatctaaaagggtacttaggaaaacctgataatgcaagtgttgctactaacgttgattcagaaaaatttgaaagttggtttgttgatgcgattgctgcaactgccagtttgtaggtgactgacagtaactaatgatcgcgtgaggtaaaaagaaagacagtaggtgccattctcttatgaaaacacgagggtggcgatgtttttcatgagggggatgacataatgaatgcaattcttgtctcggttatcggtattctagccgttgccatcttagtttacatgctgttgaagaagaacgacatcaagatgacattattggttcttggtattacgttaatgtatcttgctatctttctagggaataaaatcaaagtctctgcatcgactgggaccgtgtggcttgatccttttcaggcagtggtagatcagtttactaatacgcttgtcggtcctggctttgtcattctgattttaggcggatacagcgcctatatgagtcacatcggcgctaatcacgtcacaattcaggcgttaaccaagccaattgccaagattcgatcggtttatatcctaataccgattgtcttcttgatcggtaacttgctatcactcgtcattcctagtgcgtctaatttggccatcattttgttggcgactttataccctgttttgcgggcagcaggtatgagtcgattgtcagcagcggccattattggcacatcggcgaccattgttccaacgcccttaggttcagataatgttgcggttgcggcccaattgcatatggccgtgacagactatgtttttaaaagccatgcgctggtttcaattccgacattgttagcgattgcggtggttcattatttctggcaaaagcatgaagataaggttgatccagagacactgacctacgataaagaagttgcagagaaccacgatgacggcattgactcaaaggaaaatgttaattcctaccacggtttaactgcgtttgtttatgggttattaccattgctacccattgttttgctattggcgattttctttacaaacatagtggctggcacaaagttaaatattaacgttcaattggtaacgttgatcagttttgttgtggcagtgatcgttgaattgcttgccaaacgaaaagttcaaaacgtgcttaaaggcactaattcctttttcactggaatgggcgatgtaatgagcattgttgccttgctggtggccgcccaaacttttgtgcaagggttaacttccttgggtatcattgagctaattcagaattcgatgacgcatatgagtgggtcgggcatcgttctgcccattgttatggttctgttcaccgcggtcattgttctattaagcggcagtggcacagcgttggtttttgcgatgattccactgatcattccactatccaaggctgcggggattgatccagtcgcgttgtcaattccgcttcagcttgccggtaacttgctacgcgcggtttcaccagttgctgcggtggtgttgattgtggcaggaacaaccaagttatcacctattcaaatcgttaaaagaacgtcggtgccgatggtcttcggtgtcgtgatgatgcttgttatgtccctgatacttttctaggcctgacaattaagttcaattattccggtttggtagatggtaaaatggtgatgctgctttcatggtagaatgaattaagtcataattcagcctgaaagtggagaaagacaatgcatcgttcaccgaagtatgttcaaatttacaaccagattttgaagatgatcaaacaaggccaactagcgccaggttctaaactcccttctgaggaggtactcaccaatgagtttgaggttagtcgcgtgacgctacgtacggctttgtcgttgcttaaagaagacggtttaattcgcagtattcacggacaagggcattttgtcgaggccggggaaaaaaagacgagtggtatcgaaacgctaggcaatccgatactaaaagggcttgtgccgacaattgagcggcgggaggcttactatcacgaaaaccaaccgagtgagttcacagaccagctgtttgacagtcacgacgagccgtatgacacacttaatatctggtatcagaataatggcgagaatattgggaacacgttggctattctgttgccagaaacagtgaccatgtttcgcattaacttgaaccagccagatagtatcattaactttttggagaaatccgtttatcaaaaagcttcaagatcatcggtatcgattacgttgtctgatcgccagcagaaatcgtttcgccgcacctttagtgacacaagcccgttaattttgatgacagaagacatctttggcctgaatggcgaaaggctcttgcaaaacaaacactatattcctgctaatttatttagagtgaacgttgttagaattcagcatgatttacaaagtcaaattagtccggtggattgacgcaatcaattctaattagccaactaccacttgaaaaagttccataccacaaaaaagccgccccgattttccttttcgaaaatcagggcggctttctcatgagctaaaggaggaaaataatgaactgctaatcttaatcaacaaccactgactaactaaaacccgccttcactattctcggcatcacgtacggacaatcctgcttccttcaagaaatcagcgaacggccgcaaatcttgcgcttcgtaacgtttgacgaatgcgtcgatttcttcttgggagaatttggctgggtcgagttgcagtttttctactggcattggccgatcgccggaaatcactgcgtcaattaaaaccggttctgttttggcgatctcttttgccttggcgaaggttggagctaggtcttcgattttggtgacccggaagcctttcatgttgacggctttggcaactaggctgaagtcaatgtcatcaaattcgacaccaatgaagtcatttttgttagtgtcttcttgttcatctttaatgaaggcatattgcttattggtgaagatcacgttaatggctggcagatggtattgaacctgcgtgaccagatcctgcatggtcatcgctgcgccgccgtctccggacaggttgaagatttgccgatccgggaagtccagtttggccgcgatggcaccagggatgccgacgcccatcgttgcgaataagttggatgtgaagtgacgatttttcggcgttaaattcagattccggttagcgtttaagttgatgtcgccaacgtcaatcgagaaaatagcatcttcatccgcaatatcattaactgccttcagaacctgataggcttgaagctcgccgaattgcttgttttccagtttgcttagatagtcacgccagttctgtcggttggcaagattggctttccaccatggcgtttcctcgcgttcgctgacttgttcaagcacttgttgcaaggttgctttggcatcagctaaaatggcaacttctgcctggtggcgtttacccaatttagccggatcaacgtcaatctgtaagaaatgctgcgtgttcttgaacgcattcgagacttcagcaaaaggatagttattaccgataaatagcaccgtgtctgcttgggctaaggcttcatttgctggcttttgggcgacgcggttggcggaacctaagtatgctgggtaactgtcaggaacaatgcctttagccggataagtactcataagtggaatcttcagcaattcactaagttgttgcagctccttgccggcggtgtatgcgccgatgccatagtagatgactgggcgtttggcgtcgactaattgttgcgtcagctttttcaccaagtcagggtcaggaaccgggagcagcggcttttggtgattgatggctgaagcataccagctatcttggggaatttcctgccatggcaggtccaccggaatttgcaccaccgacacgccttggttggcataagcgcggcggatggcttcatcaatcacgtgcggcagggttctggcgctaacggcggtcacgttataagcggcaacgtcagcataaatcggattttcattcatttcctgaaaagtatccatattcataccggtcgtgccgaactgaccgatcaatgctagcaccggcacatggtcttcgcgcgcatcgtacaacccgttcatcaagtgcgtgccacccggtccagctgagccaaagcagacgccgattttgccagtcaactttgcatcagccgccgcggccatcgccccgacttcttcatgccgaacctgaatataatggatgttttccctttcggcagataaagcatccatgattgaattaaacgagccacccggaatcccgtataaatgatccacctgccatgcttccaaaaccttcaccactgcaagaccagcggcaatggttgaacgatcattggtcatcttcaacatctctcctcgttgttggaatactttgcactattaaattttacacaatctaacggctttaatatagcatgacttcaaattaagggcaagcgcttacacgttgagaggcggtgtggcgctgtttttttagtgttttttgggaaaatgggagtcttgtttatcgttgatgagatcttttgagttggcttggatgcagaggcaaaacatcgtcttagtattttgaaagtttgaatgctttcaatgatagggttggccaccgtatagttgacatgttggatttggtttagaaaggtaacttttgtgtcccctccaaaggacagaattctgtaagcgctttctaatcaacttgcgataatgatgatggaaggagatgagaccagatgaccaccgatcttgcgcagtcagtgattcatctacttcaagaccaacaaggtttcatgacttctaatgagctggccggaaagcttcaggtttcttacaagacgattcagcgggttgtgagccgcatcaatcgtgcttatggcaataacgtgattacatctgagaagggtcgtggttacaaactagactatgaacgttttttgttaagtagactgagtggcaaatcgccgcgagatctctcgctgccagcagaaaggcaaaaggaactgttgaagcgattattgttagcaacaccttccaaattaaaagttgccgacttagcagcggatttctttgttagtgaatctgtcattcaaagcgatgtcagctctttagaaccttggttgaaaaagtatgatttgaccgttacgcgcgttaaccgaacactcagcattcgaggtgaggaaaaagacattcgcgatgctttgatggaggtgattcttggcttgagcaaagacacaaccgtgaactttgaagcggtgaaacaaggattggcggaacatgatgcaacctttgcacttaaacaagtggatgttgtcgagcaatttttaaaagcggatctgccatacccttacgatgtgaacttattctcgcatatctatgtgttgatcagtagaattcgtaaatttgtcaagcttccgattgaggatcgcgatattacccgattaaaagataaggtgcataactatccagatctcttcagcgtcagcgagattgtcaaacacaacttggagaactatcttggcgcaccgatatcggagaatgaagtttattacttgtttcagtatttaatttcggcgcgatttaccggaacggacttcaaaacaaaagcggggacatcagcttatacgttttccgacgctctgataacgttggtttctcaagatgttcaattgcccgatgacgcgccggcgatgatcgatgaactcgtttcacatgtcgcaccgatgttgaatcgtttggagaataatatccgccttcccaatgccttactgaaggaaattcaagacgaatatcctaaagtctatcaatcagtgcttcatgccgcgggaaagctaaccaagaagtttgatttacctgaaatttctgccgatgaagtcggttttctttcgctttacattgccaaatacgtggaaagttcaaagaaaccaaagaaggcaatcgtgatttgtacgactggtcttggatcgtctgaactcattagcgccaaaattcgtaaagatttgcccgaactggaaatcctggatgtgatctcgaatctgaatctaggaaagtcgttagctaaacatccagacgtagatatccttatcagcacgattaatcttcccgaacaaaaacacattccgcaagttttagtaagcgctatgtttacagcgaaagataaagaaaaggttgaagaagcattgagggggcggcgagatggttaaaccagtgatacttcgctttgaacctatttcggagggagagataaaaaggcctgtcgataaacaagctgtcctaagggcgatttctgatgcattggcaaaagtttctggacaagaggttgcccagatccaatcggcttttttagaacgagaacgtatcggcaacacttctttaacgtcaggaatcgtcatcccccacgccgtcttaaatggccgccaatcgcctatccttggcattttcaactatccccaaggtattcagggctgggaagatttagacggccatcctatcacgcatgttttggccattttaatgggtaaggcgggcattacagaacaagaagcagatgatatcaagcatttctttatggcattagctttaccgaactttttacaaaaaatatcagacacgaagcaatcgcaagccacgattgccgtcattaaacaacaattggaggaaaaataacatgttagtatctggagatcgtttattgcaagtcgctaaggaacatcactttgccattccggcattcaatgcaggctcaggacaattatttacggcaaccttggaaaaggctgaggaattgcaagcaccgtttattatggcgattcacccaaccgagcttgattttctacgagacagttttgtcgctcaggtcattgatgccgctaatcatacagatttgccgattgcgttgcatcttgatcacggggcttcgtatgagcaggtgattcacgctatccaccttggattcaccagcgtgatgattgacgcttcgttgacggattatgaacacaatgttgcgttgacccaaaaagttgttgaagcagcgcatgcaaccggcgtatcagtggaggctgaattaggtaccatcgctgacacagggaatgatgttgaaggtcatttaaccgacaacgtgcaatacaccgatccggaaactgctaaggaatttgttgaagcaactggtgtggactcgttggcgattgcgattggcacagcccatggtctgtatccaaaagatgtgaagccgaagctgaagccggaaatcgttaaggctgtcgcagcagccgttgatgtcccgctcgttttacacggtgcttcagacaatccggatgacaaaattgcggaagcgattgaatacggtattaataagatcaacatttctagtgacattaagattgcctttgccaaagacttacggacggtgcttaatgaaaacgacccagacgaaattcgggaacctaaagtcctgttcccatcaccaatgattgcgacccaaaaagttgtcgcacagaagatcaaattattcggtgatgttgatcggaccaagctgtattaccaaaatgagccggttaacgaaattccttatgacgttaaaaacttccaagttgaacatttcagcgcctgatgtatctgaaagggagtctgattttatggaacaaattgaagacgtgcttgatccaaggttgatcaagcttaatttagaggcggcgtcaaagcgggatgccatcacccaactgtcagaaacactgaaagcggctgattatatcaatgatgttccttcttttgttcaagacatttatctaagagaacaggaaggcatgacaggcattggggacggaattgcgattccgcatgggaaaagtgattatgtgaccaaagttggggtggccattggcattttcaaccacgcgatcgaatgggaaaccttagacggaaaaggcgtgtcgattgtcattttgttcgccgtcagcaatgacacggcgtctgctcgtaatcagttaaagttactttcgttatttgccgcgagactgggacatgaagaggtcattgcgaagcttaaaaaagctaccagtccggcagaagtcattgcggctttcactgagaaagaaggtctggaacaatgaaaattgttggtatttccgcatgcgcagcgggaattgcgcatacttatattgctaaggaaaagattcttcaggctgccaaagatgccggggacaccgcacacgttgaaacacagggcaccattggcacggaagatgcattaacgcctgaagagattagccaagctgatattgttttgctggctattgacgtcaaaatttcaggcagagaacgtttcgctggtaaaaaggttgttgaggtgccaactgatgttgcgattaaaagtcccaagaagctcattgccaaacttcatgagctgactgggcagcccagttaaacgaggtgaggactgatgaaaaagattcagattaagcaacctgcgctcactgcgatttcatatttaattccggtcgtggttgcaggtggtttcttacttgcggttgggaacattatgggtggtaagaacttagaagccgtcaaagaaatggccaatatttgggatgctttctcgactatgggcggtttaattctcggtatgttgccgatcgtcgtttcaacaggggtggcatttgcaatcgccgataaaccgggaattgcgccaggactacttgtggggctcatttccagagtgatcggggcagggttccttggtggtttgatcggtggctatgttgccggttgggcagcgcttatcgtgatcgcttatgttaaggtgccgaagtgggcagcaggcttaatgccaacgttaatcattccctttttggcatcactcatcgccggactattcatgttttatgttctaggtgggccgattgcagccgggacggtatggctcacaggttatatgaagacattggatacaagtcagaagttcctttatgggatgatcatcggcgtcttggcctcgattgattacggtggtgcgatcaacaaaaccgtatttgcctttgtcttggcactacaggctgaaggcattaatcaaccgattaccgttttgattctggcttcgatggtgacgccgatgggctataccttggcttacttcttaggcaaggcagttcacaaaaatatctatacgccactcgaagtcgaaaccttgaaaactgcttttccgatgggattggtcgaaatcacggaaggtagtttgccgattgtcttaaatgatttatggcgaagtattgtggcgaccggtattggtggggctgtcggcggagggttctccatgttatggggagccgactcaaagattcccgccagtgggctgttcgcggtgccgaccatgtcccggccatgggcatttatcattgcattgatcatcggcagtgttgtcacggcacttgtctatctcattttaaagaagccggtttctactgaagatatacaggaagaaaaagaagaagaggacttgaatctcaaagatcttaaaatttcggattaagccaatctaaggagctaccacatgacaagtgaggcatttataggtaatgaagcgcaaacttctggtgcccagttagtccagtttcttgagggtaaggcgactggtttgaaagctattcggatgtacaaccaggctggcttgagtttactggtgacgccagacagagggatggatattccggagttaaaagtccatggcatcaatatttcatttatgtcgtcgactggtttagtgaatagcacctattttgttgagaatggcagtcagggatttatgcgaaatttcaatgtcggctttttgacaaccggtggcttgagttatatgggtgcttctgacgacccgcaactgggcttacacggaacgattagtaatacaccagccgaaaatttcgggcatcagacaacctcgtcagtcgtaaaagtatccggtgctgtgcgtgaaacatcgatgttcggcgtgaatttattgttgaagcgcgaagtcgtcatacccaaaacggagacaaaaataagaattcatgatgttgtgacgaatgaaggcatgcagacgtcaccgttaatgatgctgtatcacatgaactttgggtatcctttctttagtcctgatacccgattaatgatgaatacagtcaacccaaccgatcgcgacgggaagttggcgattgactggaaccagttcgatcagccccagcctggcacgacagaaaaagtttactttcatgatttctcggatcaaagtgacaaagattttcaatatcgacttttgagtccaacaactgggttgcaggcaacggtgacaatttcaccttcgatgctgtcgatcttgaatgaatggaagctgactcaaaccaaaaactatgtactcggattagaacctgccaccaataatgttaatggactcgaagcggcaaaacgcgatggaacattacaaacgattgaacctaatgaggcagtgacatttgacttagaggttgagttttcaaaaatggaggtgtcggactaaatgaaacgctctgaaatcaatcatattttgaaggattcagaaacttttctcaaagaacatcaggtgtttttaccgccttttgggcgctggtcgccagaacaatggcaaaatctcgatgagtcttatcaagagatcacggataacatgctcggatgggacgtgaccgactttggctcagggaattttcaggaatatgggttagtggcgtttacgtttcggaatggcaattacagggaaccgaagaagtaccccaaaccatattgtgagaaagtgctacttttaaaagaaggacaagagttgccttatcatttccaccggttaaaagaagaagataccattaaccgcggtggcgggaatcttcaaatcacggtttggaatgctacggaagatgaagcgctggataaagaaagcccagtgcatattgtcaaagatgggcatcaattggtgctggttcctggaacggtggtcacgcttcatccaggagaaagtctcacgacgacgacccggatttaccataaatggaacgttgagactaactctggcgacgtcatggtttgggaagtttcatcgacaaacgatgacaatattgataatcgttttctgaaagatataccacgtgtgccggatattgatgaagacgaggcaccatatcgtctgttgttcggtgattacaagaaattggtataaaggtaggcctgaagacgttggtgcttcaggcttttttaaaacagcataaatgatcagttagtacgtgtgtgcactggggatgtgatatcgttgaacaatgttatccgtgatcgaggaggtagaaaatgacaaatgatgttgtcctggggattgatttaggaacgagctcagtgaaggtgatggcgttacaacgaagcggaaaattttatacgcatgctgaaccgctaactttgatccatccccaaaacggctataacgaacaacgccccgaggagtgggtcacgcaaacatttaaagccattcgcggcgttttgtctgctaaccagatttcaagggaagccgttaaagcgattggcttttcggggcagatgcatggtttagttgctttaagcgctgatcagcaaccgctaaggaatgccattttgtggaatgatacgcgctcttcattggaagttgaagcaattcaagcgcggatggggcaacgctatgtcgacattaccggaaatcgtgccgttgaaggatatgtattgcccaaactattgtggatgcaaaaacacgaaccagctatttggaatcaaatcgaaaaagtgctgctgccgaaagattatttgcggctaagtatgacgggtatactggggaccgactattcagatgcgacaggtacgggctatctcgacattgccaagggtacatggagtcagactgttcttgatcatttcgggatatcgcttagctggatgccagaattaatggattcaggaactgttgtcggtggtttgacgaaaaccgctgccgaagctagtggacttttgccaggaacgccggtgaccgttggcggtgctgataatgccatgggcgcgattggtgctggcgttgtcaaagaggaccagttaatgtccagcattggcacttccggagtggtgttgcatccagaaaagagcctgaatttaaaatatcagggaaggcttcaactggaaagacacgcccttaagtcacatttttattcgatgggcgttacattggctgctggtaattcgctgagctggtttcgcgatacttttggtggcgacaagccgtttgaaaccattgttcacgatgccgcatcctcgccaattggcgctaacggcgtcttatttgcaccatacttgtcaggagaacgcacgccttattttgatccccacgttcgcggtggctttattggtatttcaaacggaacgacttttaatgattttgctcggtccgttttggaaggtatcgtcttctcgcttaatgacgtcctcaatttatatcgccagttcggcgttttgcctactgaagtgattgcgatcggtggcggtgccaaaaatcgattttgggcacagatgcaagcagacatttttgacttaccgcttaaagtaccaatcgttgatgaaggcccaggatatggcgcagccctcgtcgcgtccgtggcggccggatggtacccagatgtcagttcggccattgatgcgttggtgcggtatggtgacacctatacgccgattgccagtaaccgtgatgcttatgagctgatctataaggagtatcaaaagttgtatcagcgacttgtataggatttaggaactcttgaataacgtccgagcgaatcgggcgttttttggtgtggaagtatttctgcatcttcataacagaagaaatttttgatgtcacacctgtgtgacaaaaaggtgattaagtttgtaagcggaatcatttagtattaggactgtaagatagaaaagagggacagacaaaatggcaatgttcacaaaagataatatgatcatggatcttcagggtacaactcaaaaagaaattctggaagatttggcgaaaaaagcttatgcaatgggcgctgttcaagatgctgctgctttggtttcggattatttagctcgagaggaagagtcaacaacaggatttggcaacggggtggccattcctcattcaaaatcggacaacaacctcaaagcaacgattattttcgggagaagccagcagccgattgaatggcaatcacttgatggccaaccagcgaacacattcatcagtttgattgtccctacagctgaagcgggcgttcatctgcaactactagcgaaactcagtcgtcaactcgttcatcctgattttgttaacgtactgaaaaacggcaatcaagatgaagtctatgaattgattgataagacaattcagtaatcgcagtgtgaaagacacctgctgctaaaaaaggaggagagaatcatggcaaacttgaaaattgttggtgtcaccaactgtcctgctgggattgcacacacgtacatggtggccgaggcaattgaacaaaaagctaagtccttgggatatgaagtacacgtcgaaactcaaggagctaacggaattgaaaataagctaacccctgcagaaattgccgcagctgactacgtgattttggcacttggcaagggcatgagttctgaagacaaagcgcgttttaatggcaagcaggtcattgagcttccggtttctgaagcattgaaaaagattaatgtcatttttgataatttgcacgacgaagcccatttatacacggcttcaaaagttcaattaggtgaccgtgaacaaactgatgggattatgagtcacttgatggccggcgtctcggccgcactgccatttgttattggcggtggcttgttgatggccttaggtagtctgatggtccaatttggtgcggccaatgttgcaccaaaggccgggcagatggcgtcgcttgcttgggtgctgaacactgtcggtggattgggctttacgatgatgatcccgatcatgggtgcttacattgcgtattcaatcggtgacaagcctgccttggcaccggctttcttggtaacgtatcttgccaatacgccagctatcttgggcacacaaggcggggctggcttccttggcgcgattgtcattggtttaagtgttggttattttgttaaagcgttccggaaggtgaagttaggcaagaccttccagtcaacgttagggttcctgattattccgtttgtcacactgttgctctttgggttggtgacctattacttgttaggaccagcgatggcttggctgatggcagcattgctgagcttcctacgaagcatcccaccagagatgaaaattgctggcggattcttggttggggccatgttagcctttgatatgggtggcccaatcaacaaaacagcttggttcttcggattctcactgcttagttcgcatgtttacacttggtacggaattgccggagtagtcaccgtcttaccgccaatggctgcagcaattgcgacatggcttaagccgggattatttaccaagcaagagcgtgaatcaagttggcctgctatgttagtcgggatgaccgtggcgactgagccagctattccgtatgcattagcagcacctgtaccgatgattaccgctaataccttggcagggggcattgctggtgctgtctcaatgggccttggggtcgaacgattggcaccaggactgggtgtgtttgatccattgatcggcttgtcccgtccggcatgggcctattatattgctttggcagttgggcttgtcttgaacgttttattcgtaattgtgttcaagtcagcatggctcaagcgccaagagcgtaaaaatggcattttacctttggatgatcaatcacaaagtacgatcatcgatagtggtacgactgtttctgcaagttcgtcgcaacatgctcagacagccaaaaccgtgtccccagaagctgcaaagaaatagttggtaagtgtgatggtgcaggggctgaggtctctgcacttttttagaagagcgtgaactggcgcggttagaagctggagtgtaagtggcctcgggcgtgatggcccgggcttaggccatcgcgacgaaggtccttacacgcaagcttctgcgccagtgaacgtgtttagaaagagatgatgcattttgacgaaatatgattttgatcacgtgattgatcgacatggcacttttagcacacagtgggactacattgcagatagatttggccgtaatgacattttacctttttccatttctgatacggacttcccagtgccggctgaagtgcaggaagcattagaggcccgatttgcgcaccctatctatggttatacccgttggaatcatgaggcatacaagaatagtatcgtgcactggtttgagaaagacggccacacaaagattgatcctgactggattgtttatagtccaagtgttgttttcacgattgccacgctgattaggatgaattcacagccgggtgatgctgtagcagtcttcacaccaatgtacgatgccttctatggtacgattgaaaagaatgatcgcatgctggtgccggttcgactgagagccgcagatgaaggatatcagattgattgggacagtctggaaacggtcttagctgaagaacaaacaaaaatattcctactgacaaatccgcataatccgactggtcgcattttttctaaagccgagctaagaagactgtacgagctttgccaatctaatcatgtcttcctgatttctgatgatattcatcgcgacatggtttatctgccacatgtttatgaaccgataacaaacattggtttaaaagatgttgctttgtgttgttcaggttcaaaaacatttaatacgccagggttgattgggtcgtacgttttcttgccagatccagatttgcgcacgcagtttttgatcgaactgaaacaaaagaatgcattgtcttcagttagcattttcggtatgttagcacaaatcgctgcttataacgggtcggcagactatgttgaacagctggttgcttatactaagaaaaatctggaaacagtggctgcttacttgcatgaaaacatgccagaattgaagttttcactgccagatgctacctatttagcttggattaatgtcagtggtctggggctgagttcggatgcgttacaacatcggttagttgatattggacacgtggggattatgtcggggaagacttacggcgatgcacgttatttgagaatgaacattgcgtgccctcaagaaaaattgttggatggactggcacgcttaaagaaaggaatcaaaggatagtatgctacccctcagagaagttaaaatcttacgccttttgtcccagcaagatttctctggggacgaactggcgaagcaattaaaagcatcgcgacgcacgattgttagagatatagctgccatcaatgatgaaattcagaaaaatcgaatcggcagtattacagcgcagaataaatatcatttgaccacactgaatccgggaaaattaaccacgctattaaatacgagccgggacgaagccaatgaaatcctgctgcgcttgtgcatgcaaaagaccattgcaatgggtgaccttacgtctgatatgtttttatctcgtgcccaggtgacagattatctcaccgacttaaatagtgattatcaggatcttttgcatatctccactcggccaggcaccggtgtaacgatcaacatgaaacgattaacgcgaatcgatcttgccgcagactgtctttttgaatttccgcaactactcgccaaagttgctccgggaattgaaaatacccagcgtattaacacttatttagcccaaaacgcttgtccttatatgacatgggtcatcgacagtcagtggcgagcccaggttatcagtgcttttatttgtcggagctcggcaaaaacgtatgactccgaaacagcggtgacagctggggtgaatcaatttgttcaaagtcgtgagaagctcttggctggtctgattgccaagcacacaagtcttatgaaaagtttttccaacatggcggacaagttccaactagaagcaatcggacaaaaaacgttagagtctctgttcacgcattttggtcgcgaatgtgcatttccgcggccactaagcaccttgagtaactatgatattacgcgattagccgcgcaaaatccggttgcatttgattttgcccaagcagtcactgatgaactgttaaaggctgacaagcaaatatggatggatgcaaacttcttggctctctatattgtccaagcaattaatcaacgagaggtcaaaccagtcaagattctctttttggcaccgcgcatgtcactagcgcagattaatgccaccattatccagcaaaagctacacaatattgtgcttgatacagttcacagcttgaccgaagcagaatcagcatatgcaaaagggcactttgatttggccatcgccaatgtcagaaatgatgtgatcgagcaatcctcaattaagtttgccttgaccttttccgccgttgcgtctgaggatgacatgacaacgcttgaacagttagttaatgggcaatattatcacgacaatattgccgctatgctagcgccaaatcactttacgaatgtcgctgtaacagacaaatttttgccagcgctaaagaaggggctacaaatcttttccgacgcggggctattggctgaagaggatttggtcaagatcgttgaacgtgaagaagccggcaatcaattagtcctaaatcatatttcgataccacacatcgtaacagcgagtgtctcagattaccggttatttgcaattaagccggaagaaaaagtgacggtcgagaatcaagaagtctatttaatggtcattgtgctagtgggtacatcgcaggcagagaagaacacgatttttagctacctgtatcaaacgctaagacagtattcgactgctaacattcggcaggttcaaagctatcagcaggttattgcgctgctcagagggatgggggaatttgagggttagagatgcatttaaaataaagcaagttctttaaagtgtcacgaggtaaacatggctataagttttatacgaacggcaaagaatttgataatgcggtctaaacctggcttttagcggatttgattgcaaaaacgctaaagcaacaaatagggatccttggtaattgctatatcaaagctttgtcgagaaaatatccgccactcatctttaatcgatgaatgacggatattttagtattggattgtgaaatttataacaagaatgggagggaggcgatccccgttcaccaaaaaatggccagtgcaatggccaaaagtttggtaagcgctttcaataaaaccggctattcttaaattacaggagaggctgactatgaacagaaaagataatcgtgaatataggcttcaacttttattggcacaaacgactaattttttaactgctgacgaactggctgcacgtttagacatttcaaagaagacagtttaccgcttaatcaagcaagtgaatgaaaccgcagacgatgggacagtcattgaatcagctaaagggagaggatataggctaaatcaagaaagatatattttgcaaaaaggaccgtctcgcgatgacattgaggatatatcaccagctgatcgccaagagagggttatggaggcgctactactggcctcgccaaaagcgttgaagattcgaaggctatacagcgacttttatgttggggactcaacgattacaaatgatgagaaggtcatatcgaagcgtttaaaaaaatatggactaaatttaacgcgaaaaaatagaaccctgcaaataacagggagtgagccgaatattcgtaaggcgattgttgaaataacgcaagcgttaaactttgttgatattgatgaccttaaaggaacaatgaaggctggatttaatcattacgacatgtcgcttgtcttagaacagatatctacaattgaaaaaattcttggagagaaagtcccttatccgtataatgtcaatcttttttcacatttgtacattctcatatcaagagttaagcaggggatgatcggttgtcaaaactcggtgttgacgcttgaagagaaggaaacaatggcaactgaaccaagaattgcgaaaattgccaggcagactattgacaacatcgggcgttatctccatcgacatctaccagatgttgaacagtattatttgtttcaatatttggtctcgtcccggctgccagatttatccgacaggccgtcaagcttttcaaaagttgtcatggatgtggcaaattattatttgcacgaggttggtcatcgactaaatttggagactagcggtaccgcgaattttcgggatttagcaagtcacgttaagccgatgttgaatcgcttgaagaacgacattcgagttaagaatgtcttgctcgatcaaataaagctttcttaccaaacaatctttgatgtagtaactgaggtttcagcagagctgagcgaaaagtaccatttgccacagattaacgctgatgaaaatggctttatcacactatacttcgcacgtatgagtgaagttcatcagctgccgatacaaacgttagtcatgtgtacaacgggtataggcacatcggagcttttaagagcaaaaattcagaagcattttcctgaactagatatcgtcgatgttgttaacactcgtgagtatcagcagtatttaagaaaatacccacagacaaaactgatcatcacgaccgtcgcactaagaaataagctgcctgtaaggtcattattagtcagcgcgatgctgaattcagacgaccaggcaagaattcaaaaagtaatcgaggaaattcgaaatgaaaaatgatcttatctctatattttcgaatttagctttaaaagaccgagctgatgcttatcagtttgctgctaatcagattttcccagacgatgttttgaaagcacacaggctagtaatcgacttactggatagggagaacttggggagtattcaagtggcagatcatgtcattcttccgcatgtagaaggagattttattcctaaaacaaaacttctaattattaagccgcaaactaacctgagaaaatggagccccagtattcatgatgtacaggttatggtgtttatatttttaaaaacagatgaaagtaaacgcaccaaattacaaatcattgacatcatgaggaagttaggcaaggaggaatttattcagctgttgttaagagaaaccgacgcgggcaccttatctgaactattttgggactcgactcaatcataaagacttagaagaaagccaagaacaaaaagacacttagtaggtggtaatgaagatggatgtagttgatattattgatccccgaattgtagatccaaatgtaaaagcaagaaacaaatctgagattgttaataaacttgccgaggatttgttcaattacggttatatcgatgatgtgcatgcctttgttgatgatgtttaccttcgtgaatctgaagggcaaacaggcattggtgattatgttgctattccccatagcaagagcaaacatgttcagaagataggtgttgctatcggaattagcagaaacgaaatcccatgggaaacacttgatggtaaaggcgtcaaggtggttattctcttcgccgttggtaatgatcagaaggcggccaagactcatttgaagcttttatcgctttttgccaagaagttggggaacgaaaaggttgttcataacctattgcgagccagagataaagatgatgttgtgaatgcatttaaatgaatgggaggaagcaaaatgaaaattgtcggcgttgccgcatgtactgttggcattgcgcatacctatatcgcacaagagaagttagagaacgcagggaaaaaggctggggccgaaattcacattgaaactcagggaacaatcggcgttgaaaatgaacttacggctaagcagatacaagatgcggatttagttattttagcaatagacgtcaaaatatctggggaggaacgttttaaaggcaaaagggtcattcaggttccaacagagattgccattaagtctcctaacaaattaatcgctaaagccaaagaaatcattgctacagcgtctcacgctcaggcataacaacatgaagatttggaggggtaaaaatgaaggcacttaaatcactcaacatcaagagtaacttattgacggccatctcttacttgataccgattgtgtgtggggccggttttatgatcgcaataggcatggcatttggcggtcatgctcaggatgcgcttattcagggaaaatttaatttctgggatgctttggcaacgattggtggcaaaggactaggcatgttgcctgttgtcatttcgactggcatcgcatttgctattgcggcaaagccaggtattgctccgggtttcatcattgggttaactgctaacgccattagtgccggctttatcggtggtatcttaggcgggtttcttgcagggtatctcgttttaggagttctcaagttcattaaagtcccagcttgggcaaaaggcttaatgccgacactactgataccattcattgcttccataatcggtggcctagtcatggtgtacatcatcggcgcgccgatagctgcacttacggcaatgttgacaggattcttaaagagccttaactcatcatcactactcgtttttggtgcagtgattggattgttaagtggtgtggattatggtggaccgattaataaaactgtttttgcttttgtgcttactctgcaggcagaggggttgaatggtcctattaccgccttgcaacttgttaatacagctactccgattggatttggcttggctttcttcgttgcaaagctgtttgggaaaaacatttacacgaaagtagaagtagaaacgttgaagtcggcagtaccaatgggagttatcaatatcgttgaaggtgttattccgctagttatgaatgatatcgttcgcggcgtgattgcgactgctattggcggtgcagcaggtggtgcagtgtcaatggtcatgggagctgacgccacggtaccttttggtggattcttgatgattccaacaatgtcacatccatgggctggggtagccggattattagtgaatattctggtgacagccgtcactttggcgcttattaagaagaatgttagcgaagaggatcttgagaagattaatgaagctgaagaagaagatattgacttgaatgatatcaaagtgatttaaagtgtgagctttgggaggagattgaaaatatgaagttctttcttgatacggcagatgtaaaagcaattaaacaaatcgaaaagttaggcttagttgacggcgttaccactaatccgaccattatttctcgtgaaggtcgagactttgaagaagttattcgagagatcggtcaaattgtcaatggtcccatttctgctgaagttactgctttagatccaaaaaatatggttgaggaagcagaaaaaatggctaagtggtccgataacgtggtgattaaactccctatgacagagtcaggacttctggcgacacattatctaagtcaggaaggcattaagacaaatgtgacacttgttttttcggtgacgcaaggtcttatggcagcaaagtcaggagcaacatttgtatcgccatttgttggcaggctagacgatattgctgttaatggaatggaactggtaagcaagctgcggcaaatatttgaccgatatgaatttacaactgaaattattgcagcaagtattcggaaccgtgagcacgttgaacaagccgccctgagtggcgcccacattgcaacgattccaccgcagttgtttaagagcctgtggtatcacccattgaccgaccaaggtgttgcacagtttacgaaggactgggaaaagtttaaacagaatagaggttgaaaagatgaatcaaattcagttctcaccatctctaatgacgatgaatcttgataaattcaaagaagagatttcttatttgaattcgaagattgattccttccatatagatattatggatgggcactacgtcaaaaacctcagcttatctccgtggtttattcaagaggtcagaaagatcagtgatttgcctctttcagctcacttaatggtcgatgaaccagactattgggttgatcaattaatcaaaattaaatgcgattggatttgcatgcatattgaggtgttgaacggtattgcgtttagacttattgatcaaatacatgaggctgggttaaaagcaggagttgtgttaaaccctgaaacgcctgtcgatgctatttatccggttattgacaaggttgataaggtaacgatcatgacggttgatccaggatttgccggtcagaaattcattggcgaagcactgaagaagattgtggaactacgaaggctacgtggcgaaaatggttttcagtaccttatcgagatggatggatcttctaatcgtcagaactttaagaaaattgcggaagcaggaccagatatttatatcattggtcgcagtgggctgtttggtctatcggaaagcatcgaaacttcctgggaattgatgcaaaaggacttccaagaaatgactggtataaagctgctttagttttaccgaaatttgatgcagtttggaactttttcaaaaaaggggagaggaggttctttatgctcagggagttggtaacacctgaaatggtccaattaaccgatcgaaagatggactggaaggaagctattagattcgcggcacagccattaaaaaactttggcttcatcgaatcacgttacattgatgcaatgattgaaaaggttgaacagtatggtgcttttattcacattggcaagggcattgcgatgcctcatgctcgacctgaagacggcgcgctaaaagttggaatctcgattctgaaagtggcgaatccggtactccttttgggccaaaaagaacatgcagtgacattttttatatgtctttctgccattgatgatacaacccatttgaaagctttagctgagttagcaacgtttttgtcggatgagcccagcctgaatcgactgttagctgctaaaagtaaagacgaaatcatttcactattaagtggaggaggagattgaaatgaaaattgctgctgtgtgcggatcgggactcggttcaagtttcatggttgaaatgaatattcagagtgttttgaaggatctcggtgtcaccggaattgaaaccgcacattttgatgttgggagcgcaacagaaggcagcgcagattacttcttcgtcgggaaggatttggctgatagtctcagcaccttaaaaaacgtgattgtcttagacagtattatcgataagaaagaattaaagaccaaagtggaggcactgcttaaaagtcaaaactaaaatttgaaacactagcataggaggagtaccaaaatgaatgggattttaaaaatattaattgatattgctagtacgccagccattttagttgctctaattgcgattcttggcttggttttacagcgaaagcacgttagtgaggttcttaagggtggcattaaaacatttgtcggtttcctagtgttaactgctggtgcaaatgttgtcacaggatctttgacgcctttcggtaagatgtttcaacaagcctttcacgtcaccggcgtagttccaaataatgaagcaatcattgctattgctatcaagaactttggaacggcgacggctttaatcatgcttttcggaatggctgcaaatattctttttgccagaatcaccaagtttaaatatatctatttaacgggacatgcatttttttatcaggcgtgtatcatagctgttattttgacaacaacccgcatgaataacgttctgatgatcattgtcggcggaatatttcttggaatgtgtggcgctatctttccggcgattatccaaccatttacgaagaaaattaccggcacggatgatgtcgcccttgcccataccggaaattttggctatatgattgctggatacattggcaagtggtttggaaataagaagaaatcaacggaagatattaactttcctaaaggcttgtcatttttacgcgattcaaccgtcagcattgctttgacaatgatggttgtttatctgattgtcgctattttcacaggatcgacctatatcgaaaccaagctaagtgcggggactaactttattgttttctcacttcaacaagctggtacttttgcagctggggtgtatgtgattcttgcaggggtacgaatgattttggcagaaatcattcccgccttcaaaggaatttctgaacgactggttcccaattcaaagcccggtcttgactgccctattgttttcccttatgcacctaatgcagtgcttattggcttcttttcaagctttattggtggcatcgtcagtctcattatcatggctatggctggcacgacaatcgttattccaggagttgttcctcatttcttctgtggtgcaacatcagctgtttatgggaatgcgacaggtggaattcgcggcgctgtcttgggctcatttgttcaaggaattgtcattagttttatgccgcttttcctgatgccattggtaagcaacttaggatttacaggatccactttctctgacacggattatggcatcatcgggttacttctcggacagtcgtcccgcatgggtgggcagattgccgtcatcggcgcggtcatcatgattggcattgtgatgtttgcactgacagccattggtaaaaggaaaataagtaaggatgaagaaacggcatagtgtttattgaaagggtggactagtttgaattcgaatgaattatctaaactgacaagacttgctgcgaaaattagatatggtgccattaaatcaattcaagaagcaggacaaggtcatatcggcggatcattgtcgatcgcagacactttagcagttctttacggaaaacagatgcacattaacccgcaagaaccacattggtcaaatcgtgattggttggttctttcaaaaggccatgcggggccagcgctatatagtgctttagcagcatcggggttcattgatgatagtgtcctagctaccttaaaccaaggtgggacaatcttaccatcacatcctgaccgcaataagacccccggagttgatgcaacaacgggatcgcttggacaagggacatcacaagcagcggggattgcaaccggactaaagcagaaacatttatcatcatatgtttatctgattgtcggagatggtgagctaaacgaaggacaatgttgggaagcgttccagtatattgctagcaataagctaaacaactgtatcgtgttcatagataacaataagaagcaacttgatggttggacagacgacattattcgacaattcaatattgccgacaaaatgcgagcatttggcttttcgactgtgacagttgatggtcgtgatattaagcaaattgatgctgccattgattatttaaagaccatcgaagattctgcagtttgcattgttctcgatacgataaaaggagcaggagttaaactttttgaagacatggaggataaccattctgttaagtttggtaatgaaaaaatcaataaggaaacggacgaagcattgataaacttggagcaaatttttgagggggagaaaaatgtttaaattgactgaacaaagaacgaagggaaaagagcttaggcagacggttgttgataccctcaatggattgatggagaaagatgatcggattatcgcccttgatgctgatcttggtggagccagtaattttctccaatttaagcaaacgcaccctgataaattcagtgacgttggcatctcggaagcaaatatggtgggggtcgctgctggactaagtttaactggttttacgccttttattcacacctttgcgccctttgtagcacgtcgagcccttgatcagttgtttgtatctggtgcttactcaaaaaacacgatcaatatatttggctctgatcctggtttcgccgccgggtttaatgggggtactcatacaagctatgaggacatcggaacccttcggacaattcctaatattgttatctgtgacgcagcagatgaaatacaaatgagctgggtcattaaagcctttagtcagatgaaaggcattcattacgttcgcggaaatcggaaaagtgtacgatcgatttatgaggcaggctctgatttcaagctaggtaaaggaaatcttattcggaatggctcggactatctgattgttgctgccggacagctagtctcagaggcactagatgttgcagatattttagaagagcaaggattaacggcagatgtaatcgatatgtttaccatcaagccgttagaccgtgatttgctgttgaaacggatggcatacaagaaagccgttatgaccatcgagaatcataacatcattggtggtttgggcagtgccgttgcagaagtgatggccgagaatcgaatttctattccactcaagaggattggatgcaatgacaggttcggacaagtgggcactccagaatttcttcaggaagaatacgggcttacaacaccgaagatatatgcgcaattgaagccctttttagagaaaagtagcggtggacgtcgcgaatcagatttgattgctgttaaacacattaagaactaaattgaatatttgtggtgtaactgcatgaaaacacaaaaccggctctgtgtcgaaaaacagagtcggttttgctttttgatcaatttatttgatcaagtttatttatttgtttagtaggtcttttagttctactttttcattttgcggcataatttggatgaacacatgaacgcccttatcaattaaccgcttgaaagattcgttttcttgggggcttgtcgagattgtgtgatataagcgttcacgaccttgtttagcccccataccacccaagtcgatttctttgatgtcgataccgtgatccactagatattcaagcgtctctggaacttttgctagtataatggttggtgcctcgagcggttcagataaaaattgcacgccatcttccttattgaagacgccaattgccatcgtatcagggatcgcattctcaagaacattgatcataaaatcgtcttttgcgactgcatcatcgataacaagtacttgctctgcgtgagtaatacggctccaggctgtcatgacttgcccatgaataaggcgatcatcaattcttgttaagactaagttttgcacgcttgttacctccattcgttaatttgattaattcaacaccagcgtttttaggatctaaggcgatttgagtcaaatcctcgagcgtagttgtttctgttcgagatgtgactacggaaatcaagattggaatattcatacctgaaattaggataaactcatacttctgtttcaaagaagctgctgtgttataaggtgtcccaccctttaaatcaatgaaaaccattgtttcaccagtgagtgaagacaagagctgatctacttgattgcgataattatctggattttctccttcatgtagttgaagtgcgtgcaaatttttttgcggtccagcaatcatttcgagactttttaacaacccttcacaaaagggcccgtgactgagtaacacgatgttaatcatattgatttaacctccgcaattttctacgctttgacaattccaagaacattcaagtaggaaagaagtatgccagctataaaaatgcctaaaatgatccaagttggattgacttttttacgtaccaaataccagacaagaacagtgatgccaagaggaattaacccaggagctagctgatttagaatactttgcagtttcattgtactcttgccaactgtccagaccagtggtgtgcgaacggcaacacggctagcggccatagcaccaacaaccattaatccaacgatactaaaagcatttgtaacttttccgatcaaaccattttttaaaatggaaatgacagattctttacctttccgataaccaaacatgaacataatgtagcctatcgtgtagataacgagttcgaagatcactgtgaacattactggcccgaggtaatttccttgtaaggctagtgatgcaccaacactggcaagaattggaaagaagataccttgctgaacagtgtcgccgataccagcagcagggcccattaatcctgtacgaactgagttaatatcatctgcagagacattttgcccattggcacgtgcttcttccatcgacaatgcaacaccgtgaataatagggccgaccatgtggggttcagtattgaaaaagaccatatatttctttagttcatcagcttgtcgatccttcgaatagagcttacgaataggatgaatcatcatattcgtaagtccaagagcctgaagacgttcatagttgtaagcagcctcgtcgctttgttcccacaaccacgtcttcacgagatctgaatgggttaatttcttagtgtattggatagttgcagcttcagaagccgatgcgccattttgggtaggtgttacttcttcggcggtgcctcgtctgttctgtaaggtcagccgacgtacttttttcttcggagatgtcgcatccgcagcttctttgctagaatgactctgactaataaagacaagaaatgcaatgcaggcagagaagatagcgattgccataatgtcgagtttcaagtatacagtcagaaagaaaccgataataaagaatgcattgagttctttttttccgagatagttgagaagcattgcgatcccaagggcaggcattaaaccaccaacaacttcaagagccgttgtgaactttgcaggaatagcggaaataagcgatgtcgtccaacttttgccaaacatgactaagcaaaatgcaggaatgccatagacaataaaggcaacaatgaacgagggaacataatttagaaaacgaatttgtccaactttgccttcgctaagtgctttatctgcacgatgaacccagaaagagttaacggtctggtaaatttgaaccatcagaagccctaaaagtgaaaatggaatggcaaaagtaacggctaatttaggattagcacttgagagaattgttaatgctgaaccgtaaatcccagcgaccatggtgttacttggcatcacacctcctgcattgatccatccaagatacactagctgtatattagcacccgctagcatacccaacattggattccccatgaaaatcccaactaacagaccagttgttagtggataagtcatacatcgagtgataggtgcaaagaaccaccactgtgagatgattgctaataaagcaaccaaaatggctgataatagcattgtttacccctcctttgggaacagctatgtcggctacaaaatcgaaaagcctaatgcgttaacgtccttgtgaaaaccttgaacagtatcaagagagagtttcttgggatccagaccaatcatcttcatcttttcaagaatagcgttagtgacagtgatgatatcaatacctagattatcagcttggaaaatgtttagtaattctcgtgaacttgcccacagtaggcttgcttgtgggtattgattaacaagatcttggctttttctcatcagcgggatgggatccacgccagtatcagcaagtcggccggcaaaaacggaaataatgttatgggttttgggagataaggcatctgcaacctcttttacttgttcataggtcagaatagcagtagcgttcacttggattccttcggctgataactttttgataagtggtgctgatgattcgcctttggtattggtgataggaattttaacaaaaacatttttactcagtgcagctagtttctccgcttctttcttcattgttggaaaatcgtctgcgaacacctcgaacgaaattggcaagccctcaacagcttttaaggcagcttttgcaaaactcatataatcagagatgccagcacgtttcatcaaagttggattggttgtaaaaccgctaattggccatttgcttttggcttcaaccattccttctatcgatgcgccatctgcataaattgcaacattaaagtccttcatcatgaatcctcctgattggtatatttgcggtaacgtttacgcaaaaatcaaaaaattgagccgtttggcacggcaggcttggaatggctgttattgctaagtccattcgaatttggtattattgtgtaaacgttttcgcatctttcacggtctattaaacaacgagtcctgtgaaaagtcaaacaaaaaatcttggtgatgattgtgtcaaataaaaagaacgtctcaatcaaagacatagcgcaattaagcggcgtatcagttgcaactgtgtctagaattatgaacaatagtggtcgatattctcaaaaaactcgtgataaggttcttaaaatcatcagggaaacaggctatgaacgtaattcgctggcaacaagtttacgtattaacaaatcgaacatgattggaatcttagtaccggatattgcaaacgagttctacgcttcggttctaaaaaaagctgagcaggctctgtttaaactgggctattcaacaattatttgcaacactgaacgaagtgttgagcgagaaacagcctattatcgaatgttaattgagcatcgtgtggatggccttatttctgtatctagtgccagcaaccagatgccgctttcagcgaaatatgcaattcctattgtttttattgatcgagacccacattctgcttctgagatgattgttaccactgatcattatgcagcggggagggatctgacacgattgttgctaagtcaagcagatgatttatgtcttgttatgaccaagtcgcgtccttcctcaacaatggatcgggtgcaggcatttaaagatgaactttcagatcgaggaattagtgcagatggtagcatattggcgttaaatacgacctctgataaatttttacaacgacattctgatctggaaaacttcattcaaatcaaacatcaagaaggcagacgccttggagttttcgcaattaacgataatgttgcttatatggttcttcaagttgcaaaaaggtttcatctaagtgttcctgaagatctgatcgtaactggttttgacggtatgtcaattgcttccatatcacaaccgacaataacgacaattgtccaagattcaacagcaattgccaatcaagccagtcaattattggttgatgcgatcaaaaagaataacgataacgatgtccaacatgggacgatacatgtaccatatcagctcgctcagaggaaaagtaccttaccggaagctaagaagtgagatacgttgaaacccctttcactttgacataaaatagtattcaaagttggaccacaagggggaatgtaagtggagattaataaaattcttaataacaatgtcattgtagttaaagatgaccatggtttcgagaaagttgcgatggggaagggaattggcttcaaacgtagcgctggtgaacaactagatccgaccgtagtcgataagtttttttctttacagaatgatgatatgcaatcgcacttttcggctttgatggcggaagtgccttatgaaatactacgcgtcacggaacagttcattgatcaagcagcaaagcagttgggtcaaaagttgaacgctagcttgcatgtatcactggtagatcatatttatcacgcacttaaacgttacgaagaagggcaattaattacaaattcgttagtatacgaaattcgaaatctctatccaaaggaattcatgttgtccaaacattttttggaaatggttgctgcggagacaaacgttcacttgccacttgatgaggctggttttgtagcgatgcatctcattaatgcggaaatgaacgaggagatggggacgacaatcgcgattatgaaggaagtttatgccatgctcaatattatcaagtatgcttttcacggtacttatgatgagcattcattaaacgattatcgcttattgacgcacctcaagttctttgttcagcggatcatacaggatgccatgcttcagggcaatgacttggaactgtacttgttgatgaagcagaagcatccggatgcgtatcaagttagttgtaaaattgcgaattatgttgccaatacatttggaattacgttgacaactgaagaaatgctatatctgatgattcaccttaatcgactgcaggtgcgcgcaagcgagcgggaagatgcttcgccgtgagtcgctcgttattgagtcattggaggttagcgaaacggcttatttgtggaaaaaccatttgcgatcttagcaaaagacctagataaaaaaagcttgacacacgtaaatgtaaccgttaccataaagccatcttaataattcagttgaagacgagtggattgtgactgttcggcaggcgaaacctgggctttgacaaagaagtatacagcattctgtatgcgttctttgtcagtgctcaggtttttattttgccctaaagccactaaatcaaacgaaactcgtatatcaagctgtattactaagcaacaaactgcaatgagtttaaggaggagatgttcaatgaatgatcaacaactagccgagcaaatcttggtacaagtcggcggggagcataacgtgaagtcgctggtacattgtgcgacgcgactgcgctttaagttaaaggatcgggcattagctaacaaggaacagattgaagccttggaacgggttgtgaccgtgatggaaagcgctggtcagtttcaggtggtcattggaaacactgtgagtgaggtgtaccaagcgtttgggaagatttctggtttgattgatgaggatcgccaggaagatacgcaagataacgcaaatgaaacgatttttggccgatttgttgatctaatctcaggcttgtttacgccacttttaggtgtcatggcgggtgcggggatcttaaaagggcttttggcaatcgcaacccagctgaagtgggtgatgccgaatacttcgacttatatcatcttgaatgcaatcggagacagtttgttctatttcttgccaattttgctggcaatcacggcagcacgcaagtttaagggcaatccgtttgtggcggtcacgattgccggaacactggtatatcctacgatcatcactttggcagatccgggaaagtcggttgacttctttggcattcctttggtgatggtgaaatacacctcgacagttattccgattattttagcgatttacattgctagcatttttgaaagatatctaaatcggtatttacccacgagtatcaaaaactttgttacaccagccattgtgcttgtgactgtggtacctctgacattaatgctatttggtccctttggtgtttatgtcggcaatgccttagcagctggtttgacagcggttttcaatatcaatcccatcatagcaggcgcactgatgggagcgtcgtggcagattctggttatcttcggattgcactggggaattgtgccggtgatgttgaataatattgctaccttgggacgcgatccgattaaaccggcgaacgccatttctgttttttcgcaggcgggggctacattaggtgtcatgctaagaacgaagaacaagcagtttaaagccttgtcagcatcggcggtcatttcggcactgtttggcatcactgaaccggctgtttacggggtgaccttgcgcttgaaacgtcccttcattatcggcgtcgtctcggctgctattggtggcgggattgttggcttttcaggaagtgccggttatgcagcggggccttccagtattctgatgatacctgctttttatgggaaaaacggtgaaggttttatcggcttcctcgttgcgattgccgttacattcatcacctcgacagtgctgacctatttgattggttttgaggatgttccggaaaaatcgggtacaagcaaaaaggatactgagccattaaatgcaaagacgcaaccatcgaaggccattaccatttctagtccggtaacagggaagctttgcccgttagaaacaattgccgacaaagcattttcgtcaggtgctttaggtcaaggcgtggctgtggtaccagctaaaggtgagattttgtcgccagttgaaggtacagtgacagttgcttttgagactggtcatgctattgggttaatggcggatgatggtcccgaaatcctaatccatattgggttggatacagtgaaattaaacggtcaatactttgagctgaaagtgaagcaaggccaacgggtgcaagttggcgatccactggttcattttgacttagatgctattaaagctgctggatttgatttgaccacgccgatcatctttaccagcattgcaccttatcaaagcatggagttaagcaagcaagaacagattggcgttggcgaacatttagcaacacttgtgtagaaaggaagatgaacatgcaaaagacgaacgtatttccaaaagattttctatggggtggcgccatcgctgcctgtcaaacagaaggggcatatttagaagacaatagtggccttgctgtttcggatgtttccttttttgatccgaaactagatcgtcaagatttggcaaagcaccgtcgaataacatcggaaattattgaaaccgcaatggctgataccggtaccgcgcgttatcctaaacgacatggcgttgacttttaccatcgctataaagaagatatcgcgctttgtgcggaaatgggatttaaggtgtttcgtttctccatcaagtggagccgggttttcccgactggtgaagagctagcaccaaatcgggcagcgttagatttttacgatcgtgttctaacggaaattgaaaagcatcacatgataccgctagtgacgatttcacattttgagatgcctttagcgttggttaatcgctacaatgggtgggcagatcggcgcgtggtggacatgttttatcggtatgctgacagtttgttcgcacgtttcggtcagcgtgtaccatattggatttcttttaatgaaattaacgctggtcggttttcaacgtttaagtcaacgggtgtggtggaagataagagtgcgaactaccttcaagattgttatcaagctgttcatcatcagtttgttgccgcggctaagatcacgaagcggttacgtgaaatcaatcctaatgccaagatgggatgcatgatcgcgcggtttaccacttatgccgctactagtaagccagatgatgtcttacaaatgatgctagacgaacaacatgacaatttcttctatacagatgtgatggtgcgaggtgcctatccgcactacatgaagcgtttctttgccgaaaacaatgtgaagattgcttgggcaacggaagatgaagcgttgttgaaaaaatatacagctgattatttggcatttagctactatgtatcgaacgtgacaagtgcggctccggaggcttcggcgacaacggaagggaacttaagaagttctctgaagaatccttatctcgaaagttccgcgtggggatggcagattgaccccaaaggactgcgttatacgttaaacaccttttacgatcgctaccaagtaccgctgtttattgtcgaaaatggcctcggcgcagaggacgttcccgatgaaaagggtcaggtagttgatacgtatcgaattgactacttacaaaaacacttagaacaagttagagaagcgctgatagatggggtggatctccttggttatacagcatggtcgtctattgatctggtttcctcaggtacgtcggaaatgtctaagcgttatggttttgtctacgtcgatcaagatgatgagggccatggaagcctcatgagaacgcgcaaagcatctttttactggtaccagcaggtgattgcctcgaatggcgaggctctgagttattcgaagcaaactcatgtcgcattaaccgaattgtgagaccgctagagagctgatgtagcagtagctggttactgtaagaacgcggaaagttaaaatcagaagatcattccaaaaatatcctcgaaccgggcaattaggtttggggatatttttgctgtgtgcgagagtttagtaaccggcttgagggtgcaaatgcggtcacgctgggattcggggaattattttggacagctcaggaagaaaccgtttacaaaacggacgttacctgctaatataaagtcattcgaatgaatattcattcgaatgacttttagaacgcaacgcgcgcgttactttcccaagaagattttcattacaaaaaataaagtgagggagattgctatgaccaaaaagacaatcatgcttgtatgtgctgctggtatgtccaccagcatgctcgttaaaaagatggaggatgctgcagcaaaagagggtgtcgatgcaaagatctttgcaacttctacggccgatgctcatgacaaactggattccgaaaatcctgacgtgttgatgttaggacctcaagttcgctatctggaaaatgatttcaagaaagacttaagcattcctgttgaggttatcaacatgcaagattatgggctgatgaagggtgacaaagttctcaaagcggcacttgatttgattgacaaaaagtagggggctcttatggacgagaaacaacaacttgtggtgatgcagctgatcatggctggaggcaatgcaaaaggatctgcttttgaagcgattaaggctgctaaaaccggtgactttgacactgcagaggcaaagcttagagaagctgataagtttttggcagatgcgcacaatgcccaaaccgggatgttaacagatgaggctcaaggtcatcatcaaccggtctcattattaatggttcatggtcaagatcacgttatgaatgctattacttttcgggatttagcaggggaaatcgttgatctttaccgaaagattttggaaaagccaaatagctgaggaggatgtcaacgcaatgccgtcaccgaataaatcaaagtatgacaaaggtcgccgagacctgagcctaaccagtatgtattttaatcgctatctattgatccggtacacgaccgctgcttttttctttgctaatttatactggtttgttttgagctttagtgctgtgggatttatcaagtggtggccattagctttattaatcatcactacggcagtagcagttgaacaagccagcaaatattggcgacgagacaataagttgccagttaccaaaataggttaccttgtgcaactgctcagtaattttggctcgttggtattagttacgactggctttggaccaaatgtatttccatttttcgggccaaaagggatatcccttgtcacgaccatattactaatcggcatggggttaagcttctatattttggcgcgagttcatttgattgaaacaaacaaagatcggtatctgaagcagattcacagattcgctcaaagccttgagtaaaccgaaatggggagaaaaatatggattcaagcaacaacaagttatttaagtttatgaatgatcatctaatggggccaatgggaaagcttgcctcatttagaattgtgcgtggtgtcatggctgcagggatggcctctattccgttcacgattgtcggatcaatgttcttgattattagtgtgttgccacaaagttttccagctttggctgggatttggaaagtttcctttgataagatcgctaatctttacatgttagcaaatggtgccacgatgggaattttggcgctatacttttgccttgttttcggatatgagtacacgcgaattcaggcgcaagaagagaaaattgatattaatcctttaaacggtgccttgctttccatgatggctttctttatgtgtataccagaattagtttttaaaggtgggacagcaacattagtcacagaaattacaaaggatagcaagattattgatggttatgcgattgcgggcggtgtcacccgtcttggaaccacaggtatttttacagccatcatcatgtctattatcgccgtgaagttatacgcgtggtttgttaaaaagaatattgtcgttaagatgcctgacacagttccggaaggcgtttcacgttcatttacagcattaattccgacagcagctatcgcgttaacggtaattgtcattaatggcgtgttaatggcctttaataccgacatttataagattgtggcgatcccgtttggctttgtgacgaatctgacaagtacgtgggtcggtttgctggttgtgtacttcattatgcatgccctctggattgttggtatccacggagcaacaatcgtaacgtcatttttaacgccaattgttctgtccaatatgcagttaaatcaaaaaggtgccaatattccatttgcaggtgagtttaataattgctttgtcacaattggtggatctggtgcaacgcttggcatggttgttttcattgcgttttttgcaaaatcagctcagctgggtgctttgggtaaagcatcgcttgtacctgctttcttcaatattaatgaacccattttgtttgggatgccggttgtttataacccgtatactgcgattccatttttcttggcgccaatggcttcaatgacgatcgcttactttgcaattgacttacatcttgttaagccgatgattgctcaacctgcatggccgacaccacttgggttatctggatttatcggaactgcaggggattggcgagccattgtgcttgcgttcgtttgcgcctttgttgcctttctcatctggttcccgttcattaaattttatgatggcaagttatataaagatgaacaagccaagggtgcggaagaagcagctgcttaattaaaaagatttgtagtcatatcgattacggtgaagaggaggaaaaaatttgtcagcatttcctaaaggttttctatggggtggcgcggttgccgctcatcaattcgaaggtggatgggattcagacggtaaaggcgttagcattgccgatgttatgacggcgggtgatcatcaaaccagtcggcggatcacggatggtgttaaaccaggtgagaattatccgaatcatgaagccatcgatttctatcatcgctataaaggggacgttgaacttttctcagaacttggcttgaattgttttcggacaagcattgcatggagccgcatttttccaaacggggacgaggatcaacctaacgagaagggcttgaagttttatgatgatctgtttgatgatcttttagcccatcacattgaacccgttattacgctatcgcactttgaaatgccatatcacttagtacaagcttatggtggatggcgtaatcgtaagctcattgattttttcgttagatttgcgaaggttgtcttcgatcgttacaaggataaggtcaagtattggatgacctttaacgaaattaataatcaggttggcatgttgaacgagtggtctttgttcacgaattcaggtttagttatccaacctagtgaagataaagaaaaggtcatgtttcaagcagctcactacgaagcggtagctagtgcattggcagttcaagtcggtcataaaattaatcctgacttccagattggctgtatggtggcgatggggccggtttatccagcaacgccaaatccaaatgatgtgtttaaagcagagcgactcatgcagatgaattattatttggctgacgttcaagtgaaagggcgttacccacggttcttagaaaattattttgatcggcgcaagtttgatctggacataacgttggaggatcgtgatgttctattagctgggaaagtcgactatattggcttctcgtactatgcatcacatgttattaaagcccaagctgacgaacccaaagatttcatcacgctaggcaacaaccaagaagttaaaaatgaaacactccagcgctcggactggggttgggagattgatcctgtaggtctccggtatgcgcttaactggttcagcgatcgctatgacgtgccactattcattgttgagaatggtctgggtgcttttgataaggttgaaaaagatggcagtatccatgacgattatcgcattgattacctccgtcagcatatcgagcaaatgagattagcagttgaagtcgatggggttaacctgatgggctacacgccatggggaatcattgatcttgtgtctgcagggactgggcagatggacaaacgttacggtgttatttatgttgacaaggatgatcaaggaaagggatcgcttgccagaagcaagaaagattcttttgactggttccgcaaagtgattcaaagtaatggggaagacttagcctgatcagatggttagcgttttcaccgaagcgtctttgccctgtaagcaaaggcgctttttgtgtagcatcaagaaaagcttaagcgctagttcacaagtttaaatggcgttataattcaatctaagactttgattgagtaaacactaactggcgaacattaggggagagaaaaaagttgtcacagcgagaaaaaaactacgacacaaaggagcttgtgaatcagcttctaaaagatattcagcaaggtgtgattcaggatgcagaaggccagcttccaactgaacccgagttaatgaatcaatatcatgtgacacgatacacactacgacaggctttaaagaatctggctaatcttggctatatttatcaggcccatgggagtggtacctttgcacgtccgcatcacgtagaaggcgcaatttctcttcaaaataacgttggattgaccgaagagatggcgaggcaaggaaaagtcgtcaagacgacacatattagtcaagaggtcgtcccgctggcaaaagcagactttattcccgagaaccagaagttggataaagcaaccgaactgatttcggtaattcggcagcgaaagttggatgatgaaccttttttggtggagcattcctactacttaaaatccattgtaggagaaattcctgatcgttcgcttaagggttctctatttgcatttatcaatcaaaagcctgggttgaaagtggggtttattgattctgtcattgagtgcgagatgatatctgggctgccagcgcgattttttaatgtcccagatggcagtcccagtcttgttgtccgcgatgactcatatttaagttcgggaaaattattcgcgttttccaaaatcttttacgactttcgcaagactaaattctttatgcttaagaaaatgcgctgagtctggattgaagtaaactcgcgtcttagcttcaaaaaggcggggagtcaacgaccgacactcaaacgaaggttaaaataggttttgcatttatgcacaacgctcggatgttcaatttctccccattccacctttacacccgaacgtttctccgataaactcagattacattcagctaatacagattcagcccttgggtgtaacagcggtacgataacgcactcacaggactgaatcatctagaaaaggctgaacaaaatagacgcgcgtcggtatgctcgcatctgatttgcgggcataccggtgcatagggggacagaaaatggcgaagttagtgttacagacggattttggcttggttgatggtgccgttgcggcgatgtatggtgtcgcttatggggtggatggcgacttgtcgattcatgatttgacgcatgagattccaccgtatgatatttttgcggcgtcttatcggctgtatcagacgacgaagtattggcctgagggaacggtttttgtgtcggtggttgatccgggtgttggcagtgatcggcggagtattatcgcggagacgactgatcatcattttattatcacgccggataacggaacgctgacgcatttggcgaagtttgtgggcttgaagcgtgtgagcgtgatcgatgaagcgtcgcatgcgctgcctgggagtcaggagagtcatacgttccatggccgggatgtttatgcttataatggcgctaagttggcgagtggccagatttcttttgaggatcttggtcagccaatttcgcctgacgaagtggtgatgttgccgctgggcgaagtgacggaaggcgataaccagattgccggcacgattgacattttggatattcgttttggctcgttgtggacgaacattccgctggatacgtttaagaagttgggtgttgagccgggcgagctggtgcaggtgtcgatttattatcgggatcagatgcggtaccaaaaccagatgccatttacgcggacgtttgccgctgtgcgggttggcgagccactggtgtatgtgaactccttgctgaatctgggtgtggcgattaatcaggattcattctcgaagctgtatcacatcggcaccggtgtcgattggcatatcacggtgaagcggctttcggtataattgacacgtcgtatgagtcatgtgaaaagtgccccgatgtgtcgatggccaggtcatgatggttcatccgtgaaaagataacgttcattcttataggaggattcggtatgcgagatcacaaagttttgagtgttcggacagttgtcgcaattggtattggtacggctattttatttattttaaaaagatttgcagttattccaacaggcattgcgaacacgaacattgacatttcctatggctttcttggcttcatcgccacgctttttggaccggtcgcaggcttctttatcggctttttgggccatgccttgaacgactttacccagtacggccagccgtggtggacctgggtgtttaccactggattggtgggcatggtgattggcttgttctggaaacgattcaacattgaagcaggcaattttggcatgaaaaagattgtcgcgttcaatgttctgcaagtgattactaatgtggttagctggagtttgattgcgccgacgctggatatcatcatttatagtgaaccggcgaataaggtttatgttcaggggattgtttcggcgatttcaaacagcattgcgaccggcgtgattggcacaattttgttggtggcttatgctgcaacccggacacgttctggcagtctgaagaaagagtcttgatatgacggtaccagcaattcaacttgaacatgtgacatttcagtatgacagtcaggcggagccgaccttgcacgatgtcaacctgacgatccaacctggcgaaaaggtgttgattgtcgggccctcgggatcgggaaaatcgaccctaggcaacttgattaatggcctgatcccgcatgcatttcccgggaaattgagcggtaccgtcaaagtcaacggtgcggtggtgcaggatcaaagcctggccgccttgtcggtgaatgtcggaaccgttttgcaggatcctgacgctcagtttgtcgcattaacggcaggcgaggacattgcgtttgcgttggaaaatagcgcggttgctcccagcgagatgcatacccgcgtcaaaaaatgggccgatcgtttgaaaattggcgacttgctggcgcaggcaccgcaatccctttccggtggccagaagcagcgcgtggcgatggctggcgttttaattgacgaaggcgacgtgttgctgtttgacgaacccttggcgagtctcgatccagcgacaggcgaagcatcggtggcgttgattgacgagttgcatcaggcctatcacgtcaccgaagtcatcattgaacaccggctggaagacgttttgcggcggccgattgatcggttggtggtaatggcagatggccgcattttagctgatgacacaccggagaatttgctgcgcggacaattgctgcaaaaaatcggcttacgggaaccgttgtatctggaagcagccgaatttgcgggcattgatttgaagcaagcgtcccatctagcggatcttgaaacgtttgatgcgccggaactcggcgcgaagcttgcgactttcaccgaagatgcgccaactgtggtcgcagaggagccgcaagcaccacttttaacggtggatgcactacagtttgcgtatccaaaaggacgtcaaatcttcaccgatcttaacctcacgctgcatcacggtgagatggtggcgctagttgggcggaatggggttggcaagtcaacgctgagtcatttgattgcgggatttttgactcctagtgctggcaagatcacgttggacggcgaagatctggcagattggtcggtcaaagagcgggcagataaaatcggctatattcttcaggatccgaatcagatgatcagtaaacacctgatttttgatgaagttgcccttggcccgcggttgcgcggctgggatgaggcacgcgtcaaagatgctgtgttggcggcgctcaaggtttgcgggttgtatccgttccgttcatggccgattaatgcactgagttacggccagaaaaaacgggttaccattgcggcaattttggtacttgagccggcgttgatgattcttgacgagccgactgccggtcaggattggcggcattttaccgacatgatgcgctttttgaccaagctgaacgcgcaaggcatcacgatgatgttgattacccatgacatgcatctgatgttggaatatgcgcagcgggcgattgttcttggggatggcggtgttttgatggacgccacaccggccaccgtcttgacgaatccggctgtcatcgagcatgcctcattggcgcaaccaagcctttaccggttagccaaacgcttgggccttgatccgctggcatttactcaagcagtcattgatcaagaacggagggtccgccaatgaattcactttttggatacgacccgcaagatacgtggctgcatcgtctgaccggtgccaccaagatgttggcgtttcttggtatttcagtgattgtcatggcaagttatgatacacgtttcgtgtgtgccgtgatgctggcgtcgattattttgtttgcgcaagccaaaatccgctggcatcaaattagcctggtcgtgaagatcattacgatttttgccgtggtcaatctattgctagtgttcgtcttctcgccgcagtatggcgtcggtctgtatggcagcaaacatgttttgctccacgccggctacttcacgatcacacaggagcagttattctacgaactcaacctcgcgttgaaatacatcgtgactgtgccgcttgccttgatcttcttgatcacgaccaacccaagcgaattcgcggcgagcctcaacaagttgcatgtttcgtatcgcatcagttattcagtcgcactggccttgcgctatattcccgacgtgcaagccaacttccggcaaatcagcttagcccaacaggcccgcggctacgagctgtcacgcaaagccaagctgttccaacgcttaaaaggcatgggccagatcctgatgccgctcatcttcaccagtctcgatcgaatcgatcaaatcagccaagccatggaactgcgccgcttcggcaccggcaaacggcggacatggtacatggatcaaccgttacggacgcctgattggctggtgctggtgggcgttgtggtgattattttggttggtttggtgctgtttcatgttaatggcgggcggttttataatccgtttcggggatgagttgggaagtagcagcttattttcatagtttataaaaagttcggcggtcattttttgatgatcaccgaactttttatttttatgcagctccgtgctaaaaggaagcggcaatctggatcagatgtggtatacaaaaggcactcaacatcctgtatgtggaggaattgagcgcctattgatttctgagttagatgtttgttaacttcatagaattaaacggcagcagaagttattctaattaatcgccactgacagccgcttttgcccggttgtaaattggtttgccttcttccatgtcttcaagcgtgccaattttggtaccctttgagtaataaccgtccagtaaaccaagtttttgcataagggtttgcttgaaagcaatatcagcattccactcaacggtatctacaattgctaatgcagagtgcaatgccgtcaagccatcgactcctttgcctccagtcgtgataagaacaccgtgactgttcagaagatacatgtgggggatggccttgtcgccaatttttgcaatgttttgtgcgacaagctctgctagaggttctgagcaatttggctcgaacggcagagtttcgataaagccaaccttctgagttgcttcggtgatgttaggcatatttaaaccacttgtcgcccaaaacatagcattttttgcgtgtgagtgaaagacacagcggatgtcagggttagcatcataaactgcctcgtgcatattgatttcacgagtcaaatttccttcacctgcaatgatttttcgtgtgtgtggttcaacaactaaaatttgttctggtgttaggtgtccaagatatgcttcagacatcatcgttggcgtcatgataatgtattctttgccagtattgttgtcagtcactttaaaagagatgttgccacctgcaatattggtatcatcacgttccattacgacctgtactactttagccaaatcttcacgctcatgttcaaatacaattcgtcccttcggtgtattaaaattattcattataaattaatctccttttttgtatgattcgcttgtttaatgacatgtgatttgattaaatcagccttaatatctgctcttcttttctcgttctctgaaaaaagagttgtgtatcctttattcttgattaagagcccgaggatgatgacgaaaacatttaaccagtagatctttgttgtaatagctataacaaagattccaaatgcaacaaagcttgcaaacgtccaaaacattttcatgacttttctttttttctcaagcatgttatcagacctttattcttttgcggtgatgggggcagcggctttacttgcactatcagtatatttttttgctggattaggattctttttaaacgaacggtagacgatccagaagagggccatcaacaatgctagtcccaatagcgctaaccaattgcctttgaatccctgtgccattaagaaccgaagatcaggtgcttcaatcgagctccatgagactgttgaaccctttggaacgttaattgcttgagtcgattttgccaatgcggtgaactcattagcaaagaacgtacctccgtagaggaataatggctcataaataatcccaaggacaaccatacgcagtaggtttcctccagttaacaacaagccaccaacgcctaaacaataattgatgacgcccgcaaatggtaggattgtattgcctggtaaaacggcagcatatagaatactgatggggattaggataaccattgtgacccagagctccgtactttgacctaaaataggccagtcaagtccgataacgaattcacgatttttaaatcgttttttcataaagttactcatagtcgtgccaaatggggttaatgaatccatgaagaatttggccatgactgggaagattgccatgattgctccagttgtaactgcaagattcaaagctttacctatcgagtaacgtcctgctaatgcaaggattaaaccgataatgaaacccataacaactggttccgaaataatcccaatctttttcttcagagccttcgcgtcccagcgacgattaaagacaggaatgtaatccattaacttgttgactggcgccatgagaactgccgtgaaagcttcaatgtgggttgtagtaacacctgggtatccaagcatgtcatggatttcttcggaccacatgtcaccaagcttcagcatgacaacaacttgaatggcaccagcaataaacgcccaaacataacttgaagtagttgagtacaccatatagccagttagtgcaacaccccagatattccacatatctgcattgataacatttgttgtttttgtcagtaacatgactaagttgacaccaatctcgaccgcgaaaaagatgaatgctaacggccaagcccaggtgatcgctgctgcacctgtccaaccaaagtcaacagttggcaggttaatgccagtatttgtagctaaagctttagcagcagggctaactgcagcaaccagtgcgttaattgccattgtcatgccaacaaagccaacaccgagatataatccggaaagtatggcttttgaggctttcatgccaaatgcaaatcctaagaccatgatcagagccgaaacgacaacttgaggaccaggagataggattgcttgaacaatattattccaattcataacttttcctccaaatttcgaaaactaattatgctgagttgatcctaggactgcttgctttattttttcattggcttcatcctcacccatacctgtcaaccacgggactccaactacttctgtcacatgatttgcttcgattgtttctcgaagatcatcatcggcaggcgcaatgccaacataagcaatgatatccggattggagtcgattctggatttcgcggtttctaccggatggggctcagcatgtgctaacccatctaaaccttgctcttccaagaaatcgttaattttgtttgctacttgtggactagtcgctacgccagagccacaacatacgagaatggttttcataattatttcctcctagttgacacttatttttgtgaattgttctgacagtaaatgatacatcttggtttcatcagtggttttcaagaattccttgacgaattcttggtctttaaaagcagacattatttgggcaagtaaaccaacctgcttagaaggttccttaattcccaaaaacagaaaattacttgtggacatgggtttcatatcgcccatctgtttccagccaattggggtattggtttttacaacatagataaatggcttcaaaacaaattcaggatctacgtggggtaatgcaatttttaaacttggaaacataaggcctgttggaaatttagcctcacggtctattaaccccttcccgtagtccttgcgtgcatatcctttatcatgtgcgactgaagcaaccgagtcgaacaattcgcgtgaggaagttgatgggttgttaagatcaatcagttcctttgaaaacattgattcgtacaatttgtatgctcctttcaaaatgtttgatcttgtaaaaaatgatcaactttgtttcacttcgtatagtaagcggtttctgtttcgttgtcaacaaatttaaactaattttttaagaacagaaatttggccttataacataaacaagacgcagatcttcaaattcttaaggtaatcttggcattacaccagtcgaacatacttgaacatttccggaatacaagttatgatgtgaacatcgattaacttggacaggagatgcattaacatcatgatgaaggcgcaacgccaaagtgccatattggcattactgaattccgctgaaggtaaatcactaacgaccaccgagatagccaagagcatgaacgtggcttcgatgacgattcgaagagacttaaatgaaatggctcaagaaaagcttattaatcgggtttatggaggagcttcgttaattaatgaaaaatcaactaaggaaaagacgcaggttcagcgtgagtccaagattgaaattggaagagtaataggttcgttgattcatcccaaagcaacaatttttctgggagcgggcacgacaatttatgccgccgctgactttctaccaaaaaaggatgatgttaagtatattacgaactcagacttaatttttcggtacttggttaataaagatatcaatgtgtttcttaccggtggcttctatcacaaaataacaaatgaatttgtgggaagcattgctgaacaaacgctcagcaactttatttttgacttagcatttattagtacaaatggggtctttgacgatcaggttactacggccaactttgatgaaggaaacatacaaaaagcggccatgaaacggagcaaaaaaatgtacgttgttgctgatcacactaagttcggacgaggcgattcctttagctttgcccaattagaagagtttacaggtcttatcactgattcaaggatttcacaatctgatttaaaacactaccgagaaataactggtgtgcttgtaggaaaggcggatagcaatgctattgacaataacaactaatccatcaattgatgttgtttatcagactaatttctttaagcttggtcagactaaccgagaagttagtcattaccaagttataggtggtaagggtattaatgctgggagagtagcttcaatcttaactgggaataaagagaatgttgctgctatgggcttcgtcggcagagataattcagctggtattatccaagatttacaggaatacggcgttgttaataagatgatccaggttcctgggaagactcgcttttgctataccatcattgatggtaagggacagaagacagaactcaacgaagttggacaacagatttcgactgaagaagccaatcagcttcttgaacaaatatcgtctttaacgaacctaaatggtgtgtcaattaatggttccctggccccaaatcttccggaaaatttttattctcaagtgatacgtactgtgagggaaaaaaatcctcgggcaaagattgttctggatacctccggtgcagctttgaaatcagtccttatgggaaaagatctgccagactatattaagcccaatagtgaagaacttagtgagttactggctactgacgttgtggaagaaaaaaatgccgtactttccgcactaatgaaccctatttttaaaaacattccaaacgtgctggtttcaatgggtgcgcatggaggtgtggcaaaagtaggcatagaaactcctaggtattataaaattaaaatttcatcgcaattggctgtcaatcctgaaggctctggagatgcgatgattggcggaattttatcagccttggcatatgggaaaagtaatattgatgttattagggccgcaatggcagctgggatggcaaatgctgtagaggcgaaaacaggtttcgttcaaaagtctacttttaatcgctttttgagaagtgataaggatatccatgttcaaataattaaggcagtgccaacacccataaaatagtaaaaaatgaagccgatgcttttaagacattcagtctaggctcattgagatttagtttgtagtttgcctagcaatgaatgggttgagatttttcgaatctaaccctttttcaatcgtaacgtgtatgtgagaaatggatattacacaaacgtgtataaatatttccgcaatctggtttactcgattgtgagatagttgacaggcggaacgactgtattgcaaattcgtttaattgaaacaaagtacattaaaatagcggcgattaattccagcaaggttctgtcggccatgggaattaatcgccgctttcattaaatatgttgttgatatattgcgcccaaaatatgttctaatgttgtgcgaattaacattgtccaaaaagtatataaaatgccactattatgcgttttcgaaaatagaacaacacaattggactcaacttttttgtgaattcatagtctggaaaaacaacataatgacattttttagcaacaaacatagctctttaccagatgatttgctcgtattatgaaagcgcaaacaaaaccagcatgcttaaaaaatacgcgtatgacaccggttctattgctaggcagtacattgatgaggaggagcacgatgacaacagcaaaactatgggaacaacctgaattaaccgacattaatcgaatggtgccacgaagccatttcgaaactttctttccaggtgagtacaaacaaccgcggcattaccaattactaaatggcacatggcagtttaaattcttagacgcgccggaatatgcgcctgcagattttatggcgagtgactttaatgatcatgactgggatcagattcctgtgccaagtaactggcagttgcaaggttacgggaaaatgcattattccgatctctggtataactttccgattgacccgccttttgtgccacgggaaaatccgacgggactgtatcggcgaacttttacggtagatgaaatagcggcgagtgaacaatatatcattggctttaatggcgttgattcggcttttaagctgtatctcaatggcgagtttattggatatagcaagggtgcacggctgccaggcgagtttgacgttacgaaggcgttgaaacaagggaccaacacgatcgccgttgaagtcgttcaatggtcggatggtacgtatcttgaagatcaggatatgtggtggttaagtggactatttcgcgacgtgagcctttattcgcgcccacaaaacggcctttatgatgttcgtattcgcacctacctatcgaatgcataccgtactggcgaactggtagtcacaccgactttgacgggtagtagtgtctcgtcagaaattcactatgagttaactaaagatggtgcaacattggtagatcaaacgctacccgctgatgtttctttggatgcgactattgacaacattcaagcgtggtctgctgaagcaccgcatctatacgatttaaccatgacggttttgcaggacgatcaaccgctagaggtagtacgacaacgggttggttttcggcagatcgagttggatggcaagacctttttagtcaatggccaagcaattaagtttaagggcgtcaacatgcatgattacagcgctactaaggggcgggtcatgtctgaagctgatctcaaaaagaatattattttgatgaagcgtcacaatatcaacgcgatccgcacgtcacattatccaaaagcaccgtacttttatgacctgtgtgacgaattaggcatgtatgtcattgatgagactgatcttgagtgccacggatttgaattgaccgagcgctatgactggattactgatgatccgcgctggaagacggcatacgtggatcggatgcgccgtacgctacagcgcgataagaatcatccatcgatcatcatgtggtcactgggcaacgagtctgcttttggagataacttccgggcaatggcagcttactgtaaagccgaagatccaacgcgtctcgtccattacgaaggtgattttgaagctgaggtcagcgatgtttattcgactatgtacacttggcttgaacatgataccaagatgacgatggcggatgttcttcagaaaactcaaaagccgcacatcttatgcgaatatgcccattcaatgggtaacgggcctggtaatctgaaggaatatcaagatcttttctacggtcataagcagttgcaaggtggttttatctgggaatggtttgatcaaggcgttgcgactaaggaaggtgatcagacctattaccgatatggtggtgattttggtgatcaacctaacaacggcaacttctgtattgacggcttgattcgcccggatgggaacccatcgacagcattgactgaagttaaaaagacgtttgaacctttccagatagcggtgcgtgacttagcaacgcagaccataacgattacgaaccggcttgattttctgagttcggatcaattcagctttgcttatgagctggaagctgacggtcagacggtcgcaaaaggcaaacttgatttaccgactattcagccgggaactgctaaaacggttaaattaggtattcaattgccaaagtttaacgctgaaaccatttataacctgcatttactcactgaactcaaggaagcaaccgcttgggctgatgccggcacggtattgtcacaatcagtcatcaatctgcaaaggccaaaatttcaagtggctcatcaacagacgaccgcgttacaggcaaccgaagataacaccacgatcacggtgacgggcggggattacgaataccggttcgataaaatcaagggaactttcagtctgagtcatgctggaagcgacctaattcgcgacgggattaagatgaacttctggcgtgcgccaatcgacaacgacatgtatttgctggatgactattacaacaaatatttcctgaatctttggcatgagagcacccgcgaagttcatttgcagccccaaacaaatggcaattatgttgttagcttaaccaagcaagtgggtacgaccaatagcggttggtattacatgatccagcaacaatataccattcatcaagatggcagttttgaccttgatgtcgtaggcaaggcgagtggcaaacgcgatatggctccggagatgctgccacgaatcggggtcaaaatgaccttgccgaaagcttatcaacaagtctcctatgatggcctgggtcctacggaaaactatcgcgactcacaccaagcagcatattatagtcacttcacgagtagcgttgacgatttatttgtgaactatgtgaagccgcaggaaaatggcaatcatatggatacagatcgacttgcactcacagatggccaacatcatctgacgttgacgatgacaaaaccactgaacttcagtgtgtctaactatgctgatgaaacgctggaggctgcaaagcatacgattgatcttaaacagtcagataggctgaacctgtatttggatttccggcaaaacggtttagggacgaattcttgtggccaggatcaacttaagcgttatcgctgcaagtttgatgattttgagcttggttttaacttcaaggcgaattagtgaaaacgtcataaagaaaggaagtgttttccaatgtcagaagataaatcacggcagcggttaggttcggctgctttaatgttgatgactttctcggcggtgtttgcttttccgagcatcgtcaacaacagcattcaaattggccttgcgacaattcccggttatatttttggcagccttttctacttcttgccgttcattttgatgattgctgaatttgcttcggctaactctgataaagagtcaggggtgcatagttggctggaaagtgtactgggtagtaagttcgctttcctgggagcatggtcgtatttcttcgtcaatttgtttttctttgtttcattgttgcctaacaccctgatttatggctcatatgcgttgctaggccataacgtttttggcggggctatggggacgaaaattatctcaattctgtcaattgttttgttctggttagccacgtgggtttgtattaagggggtctcgtggatttcgactgtcaccaattttgccggaactgcgcgattactgatgggcgtgatctttgttgtccttgcctttgtggtcgtcatggggatgggcgaaaagcctgctcaagacttcagtatgaaggcaatcaccccgacgtttaactggacattcttcatgaccatggcgtggattttgcaggccgttggtggtggcgaaagtatcggtgtttatatcaaggatacgaaaggcggcaacaagacctttgtacgcactatgattatttcgacccttattgtgggcttaatgtatgttctcggtgctatcgcggttggtttcgttgttccaaagtcagttttggccggcaacttctccaatgggatctttgatattttcaagattttaggcacgcattttaacattcctggtaatgtgatggtccggctcgttggattaattctctttattgggagtttgggatctctagccctatggacagcagcgccggttaaagtcttcttctccgaaattcctgaaggtgtcttcggtaaatggatggtcaaaaccaatcaggaaggtaatccaacgaatgcgctgatcgtgcaaggctttgttgtaacgctgctgatgatcgtgccagcgcttggcattggtaatctggatagcttcttggaaaccctgatcaacatgaccgccgcaacttccttactgccagtcttgttcctgttgattgcttatatcatgttgcgatggaagaaagacgatatgccgcgcgactttcgctttggtaatcgaacagtcgggttgattgcagggattttcctgctatgcgttttcctgttcgtcttctttatgtccactgtgcctgacccgcatctgattgctgaggaactggcaggtcatttaccaaaaggaactgctagcccgatcggcacgttactatacaacgtacttggtgtggtgattttcatgggtgtcgcttggatatactgggatcgctatgaaaaacgcgaacggctagcaaaggctgaaccagtatcccattaagttgattttcaattttaaagaattggcatggtcgcggcaattaccgaggccatgttggtgcattgagctgcttttgaggaagataaaaggggtcgaacattggcacagatgatcgcatcgacacaggttaaacgcgtgttaaagacacgccatctttctatgattgcgttaggcggcagcattggcaccggtctgtttgttgctagcgggtgtgcaatcgctactgctgggccgggcggagcaatcgttgcgtatattgcgattggcttgatggtctttttcttgatgaccagtcttggtgagatggccacttattcgccggtttcgggatcgttttccgaatatgccagtcggtttgttgatccggctttggggtttgcgctgggatggaattattggctgaattgggcgattaccttagcagtggatgtttcaacaaccgcgattgtgatgcacttttggttacccaatttaccgggatggggcatctcggttggcttccttgcgctgatttttgtcatcaattttgtttctgcaaagtcgtttgcggagaccgagtactggctatctttggtcaaagttgtaaccgtgattgttttcttgggtgttggtgttttgactattgttggtattatgggcagtgatggtgcggttggtttggggaattatacaaccggcgcagcaccctttgtcggaggcttgcccgcaacgctctcggtatttgtggtagcaggcttttcctttcaaggtacggaactgattggtattacagcgggagaaagtgagactccggaaaccagcattcccaaggcaatcaaacaggttttctggcgtatcctattgttctacattttatcaattgccatcatcgcagcgatcatcccatataccagtcccaacttgcttggctcttcggttaatgacgtggctatttctccattcacgctggtttttaaccgaatcgggatggccggagcagctagtatcatgaacgctgtgattctaacgtcggtgttgtcttcggccaactcggggatgtatgcttcgactcgcatgctatgggcgatggcaggctcagggtttgcaccgcgcatttttaaaaagacgaatcgtcgtggcgtaccaattgctgcgttgcttttgaccacactggttggcggcatgacttttttgaccagcatcatgggcccagaggtctatcaattattagtggcagcatcaggattgactggatttctggcgtggctggggattgcgatctcgcatcttcgtttccgtagggcattcatcaagcaaggtcattcattgaatgagttggcctatcacgctaaatggttcccggtcggtccagtgcttgcgatggtgatgagcttgattgtgatcattggtcaggatattgggtcgctaactagttttgcttggcggcggctcttgatttcctatatgtcgataccgctatttatcggtttgtttgtttattacaaagttaaaaataagaccaaactgattccacttgaccagattgatttaacacgccgccgggaacggcgctagtattttgaagctattttggaataggtcacttaaataaacgcaatttcaaaaagttccgagttttacgagggtaaggttaaagaggtttatcagaataaccactggaggaaaaaatgaagaagctgattaagtacgtggttgttggctgtgcgagtctcattttatgtttctgcggcatcatgttaactcgtgggacagtcgtacatgcagataccatcaacgattatccgaatctgttaaatgttggagggaacccaactaaacatatttattccgcaaataaagacgtttcgactaacaagtattcacatttttcagacttaggagcttggcatggctattatcagccaatcaagcgggttgcgtcgaccttgggcggttttcctggcccaatgattatcgctgaagaatatccggtaaatctgtcgcaccagctttcgcagctcaacttggttaaccgcaagactggtaaaaaatacagttttaaaaatgccaaggcaacattcacatcgtatcccggacggttaaatcagatttacacgtttaaggatcttgaagtgactttaaatttgatttttacttcaaatcggacggcgcttatccaaacaacgttaaagaatagaaccgagcaatcgttagatctcaaatgtgcttggacaggggacatcatcaataaattacgtgctggggaaaaggatatctccttaaaacagcatttggtagcgacgaatgacggcgtacaagttgctttccagaaagttcgtaatgacaattattacatgacgaccgatcaaaacaaggtgactgtggcatacagtcgaccagtcacaacgacaattactggcaaccagtacaaaagtagtatgaaagactcgatcagtttagctgcaaaagggacaactgatttatatacggtagagtcctatgtctttaatgcagcagaacaagcaaaagaaacagcgaactatcaagattacttcaccaatgcaaaacagtattttgaaaaaaatgcagcccgttggaacaattacctcaacaaagctgtttcttctgaccaaaagaatgtgaagaagaaagagaaacgcgatcgggtcgccattaaaagcgtcgagacgttgatcaataactggatgagtcctgcaggagccttaaagcatgacggaattgttccatcgatgtccgatcagtggtttgtgggattatgggcttgggactcttggaaagaagcttctgccgtggccgaaattgatccaaccttggcggaaaatacgattcgcgctttgtttgattatcagattcaaaccagtgataaagtgcgtcctcaagatagcgggatgattcctgacgccattttctacaacaagaacaaagagcgtggcggtgacggcattaattggaacgaacgcaattctaagccgccattagctgcatgggcagtgtggcaggtatatcaacagaaccatgacaagcaatttcttgcggagatgtatccgaagctcgttgcttatcataattggtggtacacaaatcgtgatttcaacaagaatgggttggctgaatacggcgcaacagttgatccattacattttaagaaagttaaaggcaagaaggagccagatactaaggcgattatcctggcttcggcgtgggaatccggaatggacaatgccgttcgttttgatgccaaaggtgttggcaaggcggacaaaggcgtcaaaattcgggaagataagaatagcgatggcaaggtggtcgggtattccattaatcaggaatcagtcgatcttaacgcatacttatatgcagagaaaggctacctaaccttgatggcaaaagtcttggagaaacaagatgatgtgaccaaatatacgactgaggcagcaaacctcaaaaaggtcatcaaccaagatttttatgatcaaaagaccggattctattacgatcgccaagtgaatgggaagcagtctatgttgctgagcaatcgcggcaagggaactgaaggctggattccactttgggctaacttagccacaacaagtcatgcaaaaggtgttgaaaaagtcatgatgaacaaaaagatgttcaatacttacatgcctttgccaactacttcgcgcgataataagaaatttaccgcgacgaaatattggcgtggaccggtttggcttgaccaggcgatgtttggtgttgaagggttgcaaaattatgggtacaccaaggacgctttggcgctgacggacaaactttttgatcatgcacaaggactaaatggcaccggccctattcgtgagaattacaatcctttaaacggtaacggactcaattccatgaattttagctggtcttcaagcgtctattacatgctccaccacaacatatacggcaccgaagaaacctcatcccaaacagctttcaatcgccgcccttaacaaccaataaccattgcgatccgtaaaaggttcacaatggttattttttcgccttaaaaatataacgaaacggagcgcgaaatctggttctaagtgttaagctatggtcatgtaagcgctatagaaagaaacgggttcgaattatgtttaaggaaaacaagtggctgcgaacggatcagtttgtgtgtccggaactgtcggtttttgaagtggggtatgaggacgttcatccgcgggcgccttatcagtatgaacagctggattactacttgctgcattttattcttcaaggcgaagggctgttctttattaacaacgaaattcaccagttgtcacgcgggcagggctttttgatcccgccttttacggataacaactattatcccttgattggcaacccgtggagttatcggtggatcggcgttcgcgggacaggcgctgaggccgtttttagagctgcaggcctggggaagaccaattttgtttataggcatcaagatgttcatcaaatggatcgcttatttggcgaggcttacgattattttagcggtgatcatttgtatggcgctttggggaagttctatgaaattgtgagtgccttggttgaggattatcagcaggagacgcgcttgggcgtgcttcctactcagcagtatgtattgcaagccgttgagattcttaagaatgagtatgcggacaacacgttgagaattgatgacgtggcagcgcgcgttaaagtcgagcgtacttatctttaccgcattttcatgagcaatctcggcgtttcgccgaaaagttatttgatgcagctgcggattaatcaggcaatcgagttgttgcgcaatactaacgatgcgatcggcgatattgcgatcaaagtcggatttaccagttatccgcaattcgcaaaggcgtttatgaaggcgcgaagcatgtcgccctcggcttttcggaaggcaatttcgagcggcgagctgagtccgcggaagattgattgaacaaggctcatcattttgatctggcaaatattagtacagatgagttcaaaacagatcgccgcgtactggccgattttctgcaggtcaaggaataatgtaaccatgtcaaaataagccaagttggctgcatatgttgtgagaacaggcgtgtctggggcaattccctggacgcgctttttcttgtccaaaatttcaacgtagctgttcccacaaacaattgaacaaaaattttctgcgcaatacattccagcaaaatgccgtcgcaacaatctttttcaaataaccaactccaactatcagtgccaagccttattaaaccaaccttcacggcacttcattgcgatcagacaacccccttcatcatccgttacactacgcctatcgatatcgaaagacatgaggcgccggattggatgaaggatggcagtagcacagaaaggattttcgttgtttcttgagcaccaagccgtggtttacggtgcattagcgaagttgggtattcgaccgcatcatagtgattttcaggattggcgggatgaggggatgttggtgtatctcaactacttcagccggtatcgcgatccgttaacggatgaggcagcgattaccaagtttaacaagctggcgtggcggtttgttttcctcacgttgatgcaacggatgcaaaaagttcggcatcggcgggagttggaagaagcaccggccaatgcggcagtgttgcagacgaccaccgtggccacgtcacccgctagcttggagcagtcagtggaattgaagcagctgttgcgccagcttgaagctattttgacaccggtagaacggcgggttttgcagctgcggttagctggcttacctgataccggtattgcgggggagttgcaggtgagccggcaacgggttttaaaagtgcgcaagcaaatacaggcgaaatatcggcaactcgaattggaggaatttttaaatggataaggaattattaacgtatgttttggatcaggcagttggtgttgtcattgccgtgattttactcacgcgaattgaacggcgactcgatacgctgatcacgaatatgggcacttttatggtcaagcttgaaggcaagcacgagagataggagggaaaagatggcgattttaatggcagatgtcagcagttggcagccggattcggagagctggtttcgtaagttggccgattttggcgtcaaggcggtggtggtgaagctgacagaaggcaccacttatcagaatccgaaagcagtcgcccaattagcggccgggcgcaaggtggggatgcaggtgcatgcgtatcattatgcgcattatcgcaatagcgccgaagcggttgcggaaggccggtttttcggtttggcggcgcgggcgcttggagtatcgacgcagagtgtgatggcggcagatgtggaagcaccggaattaaccggtgacctgaccggcttgacgaatgtgttcattcaaacggtcaagtcgctggggtatcctcacacagatctctatacgatggccaactggatgaaaaccggccgttttgatcgggtggcgttgattcccaagaatttatggatcgcgagttatggcgttgatcagccggggatcgacaatgtgggcacgtggcagttcaccaacaattttcatgggctaggcgtcgacatgagttatgatttcttcggccactacacgacccgactttcaggtgagctcaacggtggcgtggttcgagcgcccaccgtccggtatcatagcgttcaggcaggcgaaagctggtgggcgattgcgcatcggtatggcctgaacatggacaacctagccgccttgaatggcaaaaccatctacagtgtgattcatcccggcgatcagttgcggttgaattagttgaagacgaaaagaacaatcgttgatttggcgaacatagctaaatcaatgattgtttttgtttgtgcgtaaactagcgtggacagaatgccttaactacaggcttttgcagactgaatcgtgtcgctgaaaacattcatgaaaaaattttgccaaagtgttgacacggtgtcaccttccgtgtagactacaggatgttaagcagtgacacggtgtcaccaaggaggataacgatggttttatcaacgtttgaacatttagatgaaaataaacaacaacgtattttagctgcgctggtaactgaattttccaagtatccattggcgcaggcgcaagtcgcgcggatcgtcaagcaggccgacatcgctcgcggcgcgttttataagtacttcagcgatttgaaagatgcgtatcaatacgcttttaaagaagtgattgggcgcttacacacggggatcgccgggccggaaatgcggcgtgatccatatgccgccacggttgcttttctgcaggaagctgatgaaagccaggatcgtgattttatccggcagcattttaccaaaaatagcgggatggtgtccgttggcgaaccgccgattgctgccaatgcgatcgagtgggccgtcacaacgctgtgccacagtgcgatttcccaggccctagccaatccggagcaagcggacttaattttaaaaaacttgaaagcagctcttttacagctgcacgtgaaggagtcgtgagtcaatgtatctctcattaaaagaaatctggcatgaaaaattacgctacggtctgatcgtcgcgatgatgctgttggtcacctacctagtgttcattctgagcgcactggccaacgggttgtcgcaacagaacacgcaggcgattaactcgtgggacacgtcgcgggtggtgttggcaaaagattcggacatcaatttgagccaatcgttgttgacgtctcaacaaaccaaagatctcaacttaggcaagtcgcaagcttacgtcggaacaatcggcgtagtcgcgaccagcagcaagcatgacgaaatccgctcgaccatgatcgggcttgactgggatcagtatattggcaaggacatgaaactggtcagtggccatcgagctaagggcgaccatcaaattgtggtggatacggaattcaaagataaaggctatgcgcttggcgacaaggttaagttgagcacgaaaggcaagcgctataccattgttggttttaccgaaaatgccaaaatgagcgtcgccccggttgtttacggcaccatgaacgcttggcgcaccttgcataatctgccgaataccttcacggctagcggcattgtttccaagtcgaacaatttccaagtcaacacaagcgacctgaagacttactcggcgaatacttttatccagaaactgcccggttattcggcccaaaatagtacctttacctttatgatcggctttctgtttgtgatttcactgattgtcatcgccgtgttcctctacattttgacgatgcaaaaactgccaaactacgcggtattgcgggcgcaaggtgtgccgtcccggacgttggtcatcacgaccattgcgcaagctctgattttggtcacattaggtctggccttaggtggtgcgctgacggctgtcacggcgcagttcatgccgatgggcgtcccgatgatcttctcgcctcaacttaacgtcgccatcgtcatcggcattctgctcaccggttttctcggttcgatcattcccatccggaccattttaaaagtcgatcctgttaccgccattggaggttgatcttatgtcagcaatcgaattaaaacacattattaaaaatttcaagaccccgacaagcaacgttgaggtactcaaggatgtcaattttagcgctgattctggcagcctatcattggtattaggtccgtccggttcaggtaaaagtacatttttgaccatcgccggcggtattcaaacgccgactgaaggggtggtcacgactgccgggaagaatcttgaacaattgtccggcaaggcgcgcgatgccctacgtctagataacatcggctttgtgcttcagtcttacaacttagtaccttatctgacggtcggcgaacagtttaagctggttgataagatcaagccaaaaggcaacctcagtcatgaggccttggaagcattactagacgatttaggaattgccaacttggtaaaccaatatccggcatcattatcagggggccagacccaacgcgttgctattgctcgggcactttacccggacccagcgattgtgctcgctgatgaaccgaccgcggctttggatagcccacgggtcgcgatcgtcggccagctgttagccgacctcgcccacaaacacaacaaagctatcgtcgttgtcacccacgatgtccggctggaacagtttgcggatcgaaagttcacactgctcgatggccaattaaaagaaggcgcgccgaagtatgctgcgtaagtttgtggcggcacattgatcatacgaaaaagggccaagcacaattgaaaagtgcttggtcctttttgcatggctgatgaaaggcattagcccaaatgccttttgtcaaataaacaatagtcgattaaaaccggggttcgcctaatgcgtgttgcgcagctaggttcagcaggctccactgccggtcgaaaccaggttggaagaagaagtcggcttcggctaaatcttctaggctcaggccatgttgaacggcgagcgccaagacattgccttgcgcagtgacgtcgtacgttgataaaacagcgccaccgagcagtcgatgagtttgcgggtcaaagacaagattgacgcaaaccgggggattaccattgccttccggtacataggccgggcgaagggtatccgtatagaacgaggtgtcaaccttaacccctgagcggccggctgtgaacgtgttcagaccggtagccgcaaaatgataatcgaaaacgctcaatgcgctggagccaaccacgccgccaaatggacgcgccggatgttctgcaaaaatgttagccgcaagatagcgtgcttcacgccgggcaaccgttgccagtgcaatcggcaccttttgctgggcggcaaccccgtaaaccagtgttgcgtcgccgatagcgtatacatcaggcaggttggtgcgcagatatggatccgtgttaatgaagccacggtcgtcaaggtcaacagtacctttcagccattccgttgccggcttaaccccagcagcttgaatgaccagatccgtcgcaacatcgcccgcatcggtcttcacggcgctgacggcaccgtcaccggcaaagctttcgattttgacgccgagtttaagctcaacgcctttatcggtaagttccttggcgataatgtcggtcatatccggatcgagataagtgcccaatggccgatcaatgatatccagtagtgtgacttctttgcccgctttccggctggcttcggccgcttcaataccgatgtaaccggcaccgataatcgtaatatgtttaactgccggatcttccagctttgctttaattttggttgcccagtcgtaaccgcgcatcaggaaaatatttttcaagtcgttaccaggaactggcaatgaattcggccgcacgccggaactcagaatcaatttatcgtaaggatagtcctgtgccgtgccattcttcgtgtcgcggacagtcacggttttgacatcagcgttgatcgccgtgacctcatgattgttaaggacatgggcgccgcgcttgatcaaatcatccgggcggaagttccgcacgtcattgacgtccgtcacctggtcttccaggaaaagttccatcccacatgacataaaggaaacaaaatcacccgcttcaaacatggtaatatcagcatccggataccgatgcagtaactccaaaacgctttggtgaccaccatgtgatgctccaacaacaataatctttggtttgtccacaataaattcctcctcgtatgtagtaaccgccttcaacctcgcgattccacctctatattagaatagttacaatctgacgtcaatggctgactgcaattaattatcgcacaattttattttagctttgcctaaaccgagtgtaccaaaaaaacgctgcaaagggcagttatctgccttgctacagcgcttttgcagaatagcttggttaaccaagtcaaatttagatgattttgaagtgcttcaacgcctggaccacgccatcttcatcattgctggcggtgacgtaatcagcttggtctttgacaacgtcccgaccattggcgactgcaacgctggtgccggcaaaatcaaacatatccaaatcattatgttcgtcgccaaacgcgatcacgtcatctggatgcaagcccagatactgggtcagctgtgccaatccccagcccttgttgacaccgcggggcatgatttccaacatgaacggcatactgcggatgacggtaaaacgattgccaaactccgcctcagcttgcggttggattttagcgagattttccggttcacccagcaacaagcccttagcaatcacaaaatcattcggcatttcctgaggctcacgcaccttaatcccggcgtggttctcccacgcctgcaaaaccgtgtacttgctgatattacgatcagctgtatacacgtcgccagcaggagtgataacgttgctgtcaatttcggccgccgaaacatgggtcgcaaaagtcgaaaagtcctgataatcctgatgattcagaaacttctgggcaataattttgccgttggtgctctgtaccaccccgccgccttgaacaatgacatactgatcgtctccatgcagccccaaagcgtccaacgtggttcgaacgcccggcaacggtcgcccggtgcacggaacgattttaatccccttagcctgcgccgccttcaacccacggatggtggcagacgacaactgcttgtgcgagtcgagtagtgtgtcatccaaatcgactgcgatcaagcgaaacatggcagtcacatcccttcttgaagtcagcttagcatggaaagcgggcggcaacaatgtggaaaagggaggcaacgccaaaattgcatgatgtgcatcgacaaggctttcgataagtcagaattctaaacctccccatgccggccaacatctagcaggcggacaacatcagtctcaagccgatagatcaacagccagttacccttaataaacagtgcacgatcggttttgcgtttcttaataacatgatcgtcatacttttccggcagtggttggcctgaacgcaagtagtccaatacttgttgatagtccgcttgtgtaaatcgtccggcttggagaaggtgcttgagatgttttttgaagcgcgattgttcgatgatctggcgtgtgggcatttgtgagaaggctccttcgttttcttaagcgtaacgctaaaaagatatggtgaacattctttaattcaatgccttatttttacgctagttttcaaactagttttgaattagaaacagaatttcaaatttagttcttcggtgattaaattgccttttttgaaatcgataccaaaaattgttgacatttatattgaaagcgctatattagttgtgtaaataaggaacgaatgggggcggcgacaaatggcaacgatttcagaagttgcaaaattagcaggtgtctcagtatcaacagtttcacggattattaatcatcggcctcatgtttcgccacgaaaagctgcacttgtcgcagatgcgatgaaaaaactaggatatcaaccactacaggctgcgcgacaaatgcgcggctctgggtcgcagacgattgcggtgacggtaccttatattacaaacccgtttttttctgaattggtggcggcaattgaacgaacagcagatgagcgttcatacaaaaccgttatcgtgcaaacttttggtcaaaaaagtcatgaacggaatgccttggatttcctgaaaacaaaccaagtcgatgccgtgatcatgtgcgcaattgaaaatgactgggatttgattaagcagtatcggcaatatggcatcattgctgtttgcaatgagtatgttgctgatgatgacacattgatggtgcacgctgaccaagaaagtggcatgtatgctggcaccaaatatttgctcaatcaaggttaccgcaacctagctttctgcacagggcaaaaagctattcgctatgaagcggaggctgaggatctcaacagtgatcgttatcgcggttatttgcgagctttgcgtgagtttgatttggagccttctgttgaatggcaattcactgatatcaacacgattgcagatgggcaaaatgttttgcagcgattgatggctatgaagcagcagcctgatgcggtgattgccggttctgatcaagtagcagccggtatcattgccgaggcgcaggttatgggcttaaaggttccggaagaccttgccgtcatgggctttgatgatcaaccgctgagtcaagttgtagcccgcccactaacaaccattcatcagccggttcatgagattggcgatcaaattgcaaatatggtggcaaacgagctagagggcaaatcgatttcggataagcgagttgttttaccgctttctgttgtggttagacagtcagcctaaaaattttagtcaaaattggtatcaataccaaaaaagtggaggtagtttcttatgacagttgtattagccagagtagatcagcgtttagttcatggtatcgttgtcaatcaatgggcggcagaggttcaaccaaaacgatatatggtcattgacgatgttgtcagtcaagatgaaaacgtcaaggccagcatgcgattaagtaagccggcgggcacaggcatgtcgatcatcaatactgaaaaagctttgaccaactttaaagcgggcaagtatgatgcgcagcgtgtatttgtcattgcaaaggagcctagcacgatgctgaagttgctggatgcgggcattgagattccacgcgtcgacattggcattatctttgcggaagatgggcgaacgcaaatcagcaaattcgtttcagtcaaccaacaagaagtggctgattttaaggagttggagaaacgtggtgtcccagtgaacattcgttatgtcccggcagatgccccggtgccatttgatagagcgcttgaagggaaaaccattcagtagtccttgatcaagcggacaaataatttgcggagaacccacagaataatgcgtttttgagatcagaaattaaagtagcttgggtcaggcatcatcgccctagctagccgagttggtttctatctaaacgtgtttatgttcatcataacgcgctcaccagcgcagaagcctgcatgtaaggaccttggtcgcaatggcaaagaccgccatcacgccctaggccacttacactccggcttctacccgcgctggctcgcgctcaggaggaaatatcatgcctcatattttgcaagatatcttaattattttattggcatcatatgctacgttggacaaccaaggcattaccattatgaactattggccggtcacggtcggactattcgctggactgatcatgggcgacctaccaacagcaatgacgattgccggcacatttcaactcatgagtctaggtgtggcgggcttaggcggtgcttcggttcccgattacggactggcgacaattgtcgggatttatctttctgcacgaaccggtgcgggattgggtaccgccgtggcggtcggcctacctgtaggactattaacgattcaactggacgttgtgattaaaatcatcaataactttattgcgcacaaggctcaagcttatgcacatgcaaaagaatttagcaaaatgcgaatgatcaattggcttggaccgttgttctttgcgcttaagaactttattcccatgattcttattgtcacagttggcccatctgccatcagtgctttactaaaggtcattcctaagtggcttactaatggcctgacgattgccggcagtatgttaccggtcgtaggtattggcatgttaatgcactatatgccgctgaagaaatacatttgggtactcatgattgggtttgttatgtcagcttacttgaaagtgccgattcttggtgttgccattattggtctggcgcttggcatttacacctatcagaatctgattaacgcttctaagaaaaaagaggttgctgctgtaaacggtgccgatgccgcggaggacgatgaaggagacgactacgatgagtgatgtacaaccgaaattgacgaagaaagaacgtcatagtgcgatccttcgttacatggcgatgggcgttaacaatttcaactacgagacgcaacaagggccatcagttgtctgggctttttccaaagtcttgcggaaaatttaccctgatgacgatgactatgtagctgcattggataatcattttaaatatttcaataccacaactgcaatggcggggatgattttaggcgcgacattggccatggaagaacgcgatggcattaagtcaaaggacgcagtgcaggcactaaagacttctttaatgggaccgttcgccggcgttggtgatacgatcatctggattctattgccaacaattatggggtctattgccggttacatggcacttcaagggaatccactaggggctattatttggattttggttgatatcctgttgttctgggcccgaattaaattgtttgatattggctatgattccggtgttaagttggtcacaacaatggccaatcagctcagtgcctttaccgaagcagcttcggttatgggaattactgttgtcgggactttgatcgcaacggttgtaaaggtctatacgccacttcaatttcagtttggcaaagtaaagctagccatgcagaccgggattctcgacaagatcatgcctgcacttttgccggcgttagttgcatggatggtttataaattgcttggatcaaaaaaatggacgccaaatcgcgtgattattttgattctggcgatagctttggtaggctcattcttcggcatcttaggggtacagccaaccaagtagatgagatacgacaattaaaagaagggctgatattttgaatcaaaaaaatcaaatcaaaggtgatcattttcgttttacggttctgactaacaaaatgattcgcatggagtatcaacccgaaggtaagtttgaagatgcaacaacgcagaccgtcacgaatcgtgatctaggtcagtcggagtttcgggtcgaacataataaggatggttttgtggttcaaattgaaacggactccttccatctttattatcgaggcggcgaattcaatggtgagaacttattcattgacacaaaatataattaccagacacattatccccgctggcattacggagatgacgatcctaagaatttacttggaactgcccggacgttagacggtgctgatggtgccattccacttaagccgggaatcatgtcgcggagtggctttgcgatcttagatgactcccaaagtatgttgcagtctggggatacagttagccaacgttcagcctcagagattgatctctatgggtttgcttatggccatgactatcgcgcagcattacgtgattactaccgattgactggctttccacctttagtaccacgttttgcactaggcaactggtggagtcggttttatccgtatacccaaaaaagttaccttgatttgatggcgcatttcaaaaaagccggtgtgccgatttccgttgcagtcttggatatgaattggcatgttaccgatataccggctcagtatggaagcggttggactggctatacttggaataaaaagctgtttccagaacctgccaaatttttgcaaactctgcatgaacaaggcaagcacgtgactctaaacgttcatccggcggcggggattcgcccatctgaagcgaaatatgggcaggtcgccaaagcagttggaatcgatccggcctcaaagcaaccagtgctatttgatttaaataatcggaattttgtgcgagcttactttgatttagtgcatcatccgcttgaacgggaaggtgttgatttttggtggctggattggcagcaaggagcggcgcggtcacaaaaacaaattgacccattgtgggcgctgaatgtattgcactttgaggatcagcaacggaaaaaaggcgatcaagcactaattctctccagatatgccggccccggaagtcatcgttatccgatcgggttctcaggggataccgtagctagttggcaatctttgaaatttcaaccttatttcactgtaacagctacgaatattgggtatacatggtggagccatgatattggcgggcatatgcacgggcactatgatccggaactttcattaagatggctgcagtttggtgtttttagtccaatcatgcgactccatagttcggacaatccttttatgggcaaagagccatggaattatgacgaggttactgccgaaatcatgactcaatttatgcgattacgtgcacaattggttccttatctattcacggccgatattttaacgcatcaacagggacaagccttgatcgaaccgatttactatcacgattcagaagttaaagaggcataccagtttaagaatgagtacttttttggctccgagatgcttgttgtgccgatcacatcacctagtgatcaagagactggattagcaagtgcaactggttatgtgcctgcaggagactggacagatttcttcacgcaccagatgtatcatggcccggcaatcgtgaagtttcatcgtgaggcttcacattatccggtgttggtgcgttcaggtgggattattccgttggccctcgatcccatggcatcgacagatactttgccaaatgcgatgacgatcaaacttttcccgggggagcgccatgcttatgtgttacgagaacaaacgtcatcaggagaagcacaaaccaagtttacatgggatccgcaggccaacatatttgcgattaaagtggctgatccagatggtgtgattccggctaagcggacgtatcgactcgacgttgttggatctgctgaaaagattaagccagttaatggacatcataaccaagagatgagtcttgctatgaagtcgcaaaatcacgagacagaaaaaatggcgcagatttttacggttcttcagcaagccaaagtggatttcgacttaaagaagcagttatggcaaagcattcagaatatgccaactattaagacggccctaaccgtgacgagtcttgctcccaagaacctgagtgatgcgctcttagagatacttttaaatgatcacgcttgaattcaaaaatacgctggtttagttgatcagagggtgtctttcaagcattaaaaacgactgattgaagagacaacaaggaggaaaagacaaatggaacgcacaattgtgttagcatcgcaccatcgacttgcagaaggtttgaaagatacgcttaattttattagcggcggcggtcaagatatcgtgtcgatggcagcatatttagacaatcaaccggttgaaaatcaagtcgatgctttgatggcatcttttcccgctgatcgcgatgtgattgtattaactgacatgatggctggcagcgttaatcaaaaattttttaaatatcgaacgcgcccgcatacacatattattagcggtatgaacttgccattagcacttggcatcgcaatggcgccgacaaatgagtacgtgagtgacgaccaaattaatgacctgattcaggaggcaaagaatgcgatcgtgaatgtcaatacgctccaagtcgaggcagatgacgatgatgaataaggtgccttggtggaaaaagagcgttgtgtatcaagtctatccaaaaagttttaatgacagtaatggtgatggcattggcgacctgaatggcatcactgctaagttggattacttggcagatcttggtgtggatgtgctttggctgaatccaatctatcaatcgccgcaaattgataatggctatgatatttcaaattatcgagctattgaaccgcagttaggaaccatgggtgattttgaacgacttttgaaggcagctcatacacgccatctgaaaatcattttagatttggttgtcaatcacacttctgacttacatccgtggttccaggctgccaaatcgtcaaaaaatgattcgcatcatgacttttatatttggaaaaagcctgtggacggacatgaacctaataattggggttcaagctttggcggttctgcttggacatatgaaaaggatctgggcgaatattacttgcatctttttgccaaacagcaaccagatcttaactgggaaaatccgcgtgttcgtcaagaagtctatgacttgatgcaattttggctggataagggtgtagacggtttccggatggatgtcatttcacttatctccaaagatccagcgtatcttgatggtcctttgattcaagggaaggcatatggaagctactatgccggagcggcaaatgggcccaaagtacacaagtatttacaggaaatgcacaagcgagtgctttcgtccaaagacattatgacagtaggcgaaacaccgcatacaaccgccaaacaggcgcaactatacaccgcggcagatcgacatgagttggatatggtttttcactttgaccacatgcatcttgattatggtcagtatggcaagttttcaactaatcgattcaaattaactgatttgaaggcagttcttgcacgttggcaaacaacattggcgcaggttaacggatggaacagtctttattggagtaaccatgatcagcccagaccggttacacgatttggcgatgagggccagtatcgggttcggtcagccaagatgctaggaacggttttgcacatgcttcagggaacgccctatatctttgaaggcgaagaactcggtttaaagaatgttcattttaaacagttgagtgattacaacgatcttgaaaccaagaatatatttaaagagctcacacaactgcatcatgagagtgagcaggaggcaatgcaggcgatttatttacattcgcgagataatgcgcggacgccgatgccatgggatgcaagtgagcaaggtggcttcacgaccggtaaggcatggctgaaattgaatcctgatcatcaggaaattaatgcagccaaggatcttgctgacagcgatggcgtttatcattattatcaacggctgatcaaactgcgtcacggggagcccttggtcacaagcggagtttttgagcttttagatccggaagatccgaatcttttcgtttatttacgtaaaggtgaaaaggaaaccttattagttgctggtaatttctccgcaaaaactcagaagtggcaaactccagagtcgctccaacagcaagcagcaactattttaatctgtaatgcaaatttttcgaaacaacttggtagcactttaacgttgcctccctttggaactgtggtttataaattaaagcaatcgtgataatggtaacactcatttgaagaagccggtacttaagtgaaagttgagaaggggtatttgatgaatcgtctgaccttatatcgggtgcatctttcaatatgattcacaagataatctgtttgcaaaatacgttgaccgctactaagataaagccatcaaagcagcgatgtaaccgttgccaaaattgctgctctgatttcaaaattttaagttagaagcaatgtctacgaggtgtagatgaagggtgatgcttaatggcagttgacgaaaaacaagcgctcattgctaagatgctgaagcttcaacaccttttcgagccgcaagcggacgagatatcccaagaaattgttgtcaaaatcaagcaggttgtcgatcggttggccaagaaaaggatacaaggagccaacattgaacccgaagtgcatccggtcagcatttttattagggaccaaatgttagatcatcactatcagatcacgactgagcaacgcgatgcgctttttgatatggaggaagcggcgcaggagattgctaagaagtttttcattagctttccaggcatcagtgggcccctgtagttgcaaggtatctggaaacatataaacaaaaacacaagcggcaccacctcatgtcgattcatgaagtggtgccgcttgcgtagtttaagaaatagtatgggatcagtttgcttaaacaaaaacgctttttcgtttcaaatatgatacagaccaagcttcgccagatctttttttaacgagttaacaaattccacgcagtcacccgcttttaaagcctgtagagaactatcaatcaattgatcaccttctgctcgtcggcccgtttgagtcagtaatattcccttgtagtagtttagcaacacccgttctagtagaaaggattctggcagcttcttttgttcgagaattgccaacgtttttagagcatgctgggttttcccatggcggatgagtaacgcaacggtatttagcaacacattgatgcaggtctcgtaaacgctggtgaggccaatgtagatggaacatttatctaacagagtttgcgaaaagaccgtgatagtttcgatcggcagttgagtcatggtattgccgtagagaaccaattcaaagttgccccaatcttcacactgaaataagtagttggtgagcacatttaagtggactttatcagacaagggtttcttttctgcctctgcgcgaacgcattcggccatgatccagttcagttggtcaaaaattgaatgcgagttttgccaacgcgcatattcactatctgccaagcgcttaaggcccgcaaagtcattgtttagcgcagattgcgttaaatttgtcgcgaacttgttgtcgtataaaggctcaaagtgattcatgacgaccgtgaattcgaatggcgtgatataaagctttttaagcagatggaaaaatcgtttcgttgatagatcggatgtcccgttttcgaattttgagatcatgcctttggacacaacgtcatcggccaaagagctaagggtgataccgcgcgattctcgtaagtatttaaatgttgccccaaagttttcgatgatgaaccgctccttgtttcatattttaaacgtatcggttatcagtcattttagcgactatcgtgtgaagtatcaataaacgatagaagatgcagatacgttgaagcatatgaaaagaggaactaacatgaaaagttatttaaaacacgaacatggacgcacaggtatcaacattatttggattgtggtgaacgttcttctatacactgggacgtcggttcttttgactttcacaacgaacgcaattttttctagggatatgcgcgctttgttggtgtggtcggcgattaatttctcggtttggggagcctttctgatcagcaattattttcaggtggtttttcaagagaaattgactcagcggattatggtggacatccgggacaccatctcgaggaaaattgttggcagctcatacgcgcagtaccacaacaaaacgaccggtgagtatctttccgaatatgtcaatgatgtgggcaacattgaaagtaatgcgattaagaagttcttcacgttgctttccgatggcacaaccgttgtcttttcaaccattgcgcttgctgcgtatcatctgctgtttatcccggcgatccttcttttgtcggtgttgatgcttagggtgccttcgcggctaagtcgacctatgacctcagcaacaaaaacaatgtcgaagggtaacgcagccttttcaaatcaagtgaccaacgtgcttaatggcttcgatgttttgtttaatgctaataaattaggcaagcttcatgacttgattaagtctgccgcaaaaaaatacgccgcggtcaaggtggcttatacgaagaccaatgcgcgcgtttcgaatttgatcgcagcgctgagcattttctgtcaggtgatggttgatatcatgaccagcatacttgcgattcttggcgccattccgcttggggcaattagttcaaccggcagtattgctgccaacatttttaactcactgtcgagtttaagcaatgacactgtgcaaattaaggcgacttatcccttatttgataaggttagcgccggcgcttcaaagaagttgccatctgccgaaaaaacgccagtacctgtctttcatcatgctttaagagtggttgatcttagctatgcgattgacggcaaacagattctcaaccatttgaatctcacgttcgagcgcggtggcaagtatgcgattattggccgcagtggtgtgggtaaaagtaccttgctgaaaattctggacggacagattaccgattatacgggacatgtttatatcgacaacaaggacttgcgggcaatgagcatggcggagctaaccaaggtttcgcagtacgttgatcaaaacgtttatttatttaacgattccgtggcaaacaatacatcactgtgggaaaaccagtcgcggtctaagcatcgcctacaagaagctttttcaaaggcaaaagtcgattttgttgaattcccgggtcaaatcatccaggaaaatggtcagaatttatcaggcggccagaagcaacgcctggctttagcgaggttcttctatgcaccaaaacccattgcttttgttgatgaagggacgtcggcgttagatgccaaaacggctagacttgtcactgaggaattcttgaaggatcctgatatgacgctgattgaggtgagtcaccatctcgatcatgagctaagaggtgcgtatgatcaggtgattgatttaggcgcgtaggagtggatactgagagacttttatattttaggatgcagtaagcaaaataaaaggaggctaaggaaatccctagtcctcccaagatcaaaaagccattttgagtggaatgaaactaacttctcaccgcttcaacttatccatatccgccagcggactgttgtacagtttcgcgtaaaagccaccagcggccagtaactgttcatgcgtgccggattcaatgagccggccttggtcgatgacgaggattttgctggcgtggcgaatggtggagaggcggtgggcgatgacgaagctggtgcgttgctgcatgaggcggttcatggcgcgctggacgtcggtttcggtgttggagtcgatggaggcggtggcttcatcgagaaccagaaccggcgcttgggccacaaaggcgcgggcgatgctcagaagttgacgttggccttgtgacaggcggctggcgttttcgctgagcagggtgtcgtagccgtctggcagttggcgaataaacgtgtcagcattggcggcttgagcagcggtttcgacttcgacgtcggtggcttcgggacggcccatccgaatgttttcgcggatggtggcggtgaaaagaaacgattcctgttgcacaacggtcaccaggcggcgcaggttcgcgcgagtaaggtcggtgacgttatggccgtcgagggtaatgctgccgctggtgagtggatagagattcgtgagcaggttcatgatcgtagttttaccagcccccgtcggcccgacgatggcgaccacttcgccttggtgtgcggtgaaactgatgtcgtggaggacttcggttttaccgtcataggcaaacgaaacgtgatcgaactgcacattgccggctgtgtgggtcagcgtcagtgcgtttggcaagtctttttccggctcggcgtccacgacctggaaaacccgttcggcggaggccagcgacagttgcagggtgttgatcaggttgaggatgttgttgatggggccggtaaaattgcgcagataaataagaaaagtgaagatgacgccgaccgtgatgctcgtgccgccatgcagaatcgcaagcgcgccggcaaacgtgatcaacaggtaggcgaagttattggtcatgttgttgaacggaccgatgacaccggaaaaaagctgcgcccgatacgccgcggccgtgtagcgggcattggtttcattgaagcggtcaagcgtgtcttgctggtgatcgaaaagttgcaccagctgcttaccggccacattttcttcgatttgcgtgttgagactgccgagtgcttcctgttgcacggtaaacgcccgctgggtaattcgcgcagctgcccgcgaataaaagaaggtcgcaaccgaggccagaacgacaatccccgtcaacaaaggactgagcagcagcatcgcaatgcccattccgatgacactgataatcccagtgtatagctgcacgaatgtctgcatcagcgccgtgttgatattatcgacatcgttggtcaatcgactcataatatcgccattgtcatgggtgtcaaaatagcgcatcgggaggcgttgcattttagcaaataaatcatggcgaatggcggcgctggtgctttgtgcgactttggtggtgatactagtctgaaaatacgtgaaaacactgcttagaaaatacatgcctgccaacaagccgctgacgatcaacagttcgcgcagtcggcctttggtgataaattggtcgaccacaatgccgttgacgcggttgccgatgatggtggctaaggttgtgaagagtgttaacccaaaaacaatgagtaatttactgcgatccgcattgaggtagccccaaatccggcgcacggtttgtttccaattcactaaagttactttttccggatgcaggttgcgcgggccgcggcgtccaccgatattaatcaaggtactcaccacctaactgggtttgaacaagttgcgcgtaaaatggcgaacttttgacgagctcgtcgtgggtgccgcgggcagtgatgcgaccgttttgcatgacgatgatctgatcgcagtccatgatgttgggcacacgttgggaaatgataatggtcgagcggttgcggcgatttttgaccagcgcgtcctgaatggcggtgttggtttcctgatcgaccgcactggtggcatcgtccatgaccagaatatccggatcggggatgatcgcgcgggctagattcaggcgctggcgttggccgccggaaaagttcttgccggcttcttcgactggtgcggtgtaatctgtcccgatgaattccgtggcactggcgatggcgacacccgaggctagttgtgcaggtgtagcttgcggggcaccataatccagattgcgctcgacagtgccggagaaaagcaacgaattttgcaaggcaacggtgatctttttatgcaacgatgccaagctgatttgctgaatatcggtgccgccgatggtaatgctgccttgatagtgctcgtaaagccgcgtcagcaattcgatgagtgtggttttaccggaaccggttgagccaataatgccaagccactgaccgctgggaacagtgaggttgatgtcatcgagaatcggccgacttttggagaagccaaaggtgacgtggttaaacgcaatggtgctatcggccggggcagccagcgtcccagttgcttcggtgccggcttcttcggccaaaacggcactgacccgcgcactggaggtgacggctcgcgagaaggtggtgataaggttgacggtgttggtcatggcggtggtgatttgaatcatgtaattaacaaatgccatgatttcaccagttgtcatactgccggcgattgcaagattgccaccataggccaaggcggcgaccacggcgaggttcagaaccaacataatcagcggcgccaaggtaaccgttgcgagtacggcgcgctggctgatttgctgcaggttgtgattttcggtgttgaactgagtgcgttgatggtcttccagaacataggctttgattgttttggccccagtcagattttcactcatgatgcggttcatgacgtccacttgtccttgcatcgcggtataaagcggcaaggagcggcggacgacaacgtagatataaattgccagaatcggcaaggcgatcaggacaatccatgaaagtcgcggcgacacgatcatggacatgacaatcccgccgaacagtaacatcggcgagcggatcaagccacgggtgagcatgctgaccatggtctgcatctgcgtcacgtcgttggtaattcgggtgatcaaggtttccggcttcagcgcttgcggatcgcgatcggctaacgcaatggccagcatgtggctgcgcagattctgccccattttcagcgccgcgtatgatgaaaaggcattacaaatggcgccgagcgcaaacgccgctacggcaatgactgccatgaggatcgcggtctgccagacataggtcatatccttgcgcgccaagccgacatccacgatcctggccatcaaagtcggctgctgcagatccagcaaggcttcacccataatggcgatcggcgccagaaaaaagctcacccgcgcccagccatgcatgtggtcgaacaagattttcagcatgtcaattgcctccgttttacttatgaagccattctacggcgggaatggaaaagttgcatgtgattggcttgttaagtgggttgatgagggggttggggggttgtggatgggcgttggatatggtttggggcggtattgggaaagatcaggtgaacggcttggaagcaaataaaagctctagagttccaagtgatttggaattctagagcctttaaaacaaatgcacaatattggcatcgttgtagcaatcatcggcaatcaaaaagactatcactagatttctggcacggaagtctaacggtcttttttgattgttaacccagtgctagtagtgtccctagcaaaaattattttaacacggaggactttttgctagcaatgataacaccaccaatgaattcatgtgatttaataagaccgaccgcattcaagccatcaagcaatggctgtatgatcacgctgtattcggtgtagattaactcctggtacagttgagagaaatcctaagatacattaattaaaaaacccacgatatgattggtcgtgggcgtagcatctgataagctatgactaagcagaaagttaaataagcggtggcgcttcgcaatcgaaagaaggtgatgccgatggttttaggactatcgaaccacattccaacgaaaggaggtgccagtttgtcgtctgtgattgacgcctttgcggcaatcacggctggcctcggctcggccattgtcatggtcaacgtgttcacacgtttgatcaaggctttggagaaactgtgtgatgcagtttacgagctgaagcaagcgctcggaaaattccgagaaaagtaggcagactaaaagccgcgttaactttgacgaggaaccgcggcttttagttgcgacatagtcaccgtgcttttgacggttctgctgttttacaaggggcgtcttgtttgtgcaaggcgctctttgcttacaatactcattataacaggttcgaattcacagtggaacccgtttccggtaacttgtgtagtgcatagatcatagctcatacccacattcaaacggaggtaggaaagttgaagcataaaacgcttagggtcatcactggcattttttcaaccggattactacttttaattctcgtctttttgacgtatcgagttcatcgtaatggcagccgtatcggaacattgcaatcatatctggcactaatggtcatcatgggggtgacgctattactgatgatggttgcagaccgcacttttttgcttatcaccggacgtcacttaaccaagatgttcgtagaactgcgagatgccattgacgaattgaaggaagcactcagaagactccgggaataatagtagataaaataaaaatgcgcaggcttcggcaagagtttgcctcttttaaatgttccttgaacttgagccctctaaaaattgttaatgataaatccgatattcctgtccagtttgttttccctggacacttttcaaatagcccgtcgccgcaagctttgccgggatggggataaaacctgcatacgaatccttgagttggtcgtaagattcttctacgatcgtcgggctcacacaattgattcgtaaaccgcgcttcagatcgatcgcggctgacttaacgaatgctgctacgccaccattagccatcgctccagacgcaccacctgcaatcggatcgtctttggtgacgccggtggttaaggtgatgctgccgttgtcattgagatggtgttggccgaccaatacaagattgatttgaccgagaagcttgctagtgaccgcaaccatattatccgccggtgtcatcgtgtccaatggcataaccttgaccgcgcccgctacattgatgattgcatcaatgctgccaatcttggcaaacatagcctcaatacttgacagatcggcaatatcaactcttacatcgccttgatgccgactagcagtgatgacgtcatacccatactttcgcaataattgcgctacttgtgacccgattgtcccgaacgcaccaatcacaacgactttcttcatgaaaacgacccgctttctaataaaattttgccagcgcttttgcctgattcaagcaattcatgggcttttgtatgtgccaagttaagcttcttcgcagaagatccttaaacatatcgaccttgatattttgttttggccagcttggtgtatttctggataaattcccctttggccttggtgtaagcatcgcgattgtgctcgaattgatgccacaatttaatttttaaggtctcgtactttttggctacttctggatgattgttcaggtaatctctgaaatacaattcatcgttatcgccggcaaaccttaaatgtaaatggtaaacagatttagcgaagccgtgaactgtataccctttgttcagagaaattctttccttttcgtcagacataatgatgtagccatttctggaaagctgttcagctacatcgaccaaattagtttttggcgatacctcaaccaaaatatccacgatcgacttagcccaaatgtttttaatggctgtgctgccaatatgactgattctgacgacggcgacattctgcaatattttgcgaattctgcttgactcttgttcatagtcagttgcccattgtttctggggttcagtcagcgaaattggaaatagttgccatagctcttctaaagtcaattcagacagcggtttagtcattttgttttcccctcttgcggacagtgtacgtctcgaaatagatgggaacaagttaggctgccgaggatgcttatatcagagcattatttattcgttgccccaatatactgaaacaggctattcggcgtgtattgaacgcccttaactgatggttttgtcagatggacagtaccccactggtaaagcggaatgattccctgctctttggtgatcaaccggttagctttgagcaaatcgttccagcgggcttgcggcttggtagcgtctttgccggcagcattagccatgtattgatcatattcttgactgctccagctgccggaaaaattgctgacagaactggtgtaacgggttagaaagttttcggcatccggataatcaggaccccatatgctggccatcataccgtattgatgcgccgtgcccatctgcagccaacttttctgcggcacggttttaatcgtcattttgaccttgataccggtcgtcgaaagactttgaaaagtgccttgcagatactcagctgtttcttttgctgccggcgtgtcatttgctaggaatgtaaagttaagtgttttttgcccgacttcagccatgccttgtttgaaaagttggcgggcttttttgaggttgtaggtggtgtactggacatatccgcctttaagcgactccttggcaaagtcagcgccggttttggcattgtaaaagagattagtggttacagcactggttgccggagttgacccatcacctaaaactttgctaatgaaagcttttcggttaattgccatcgataatgcttgtcggactttggtattaccaaaagcgggaactgcttgactattcattctaagataggtttcccacggctgcttgataacatggtaaccactctgacctttggcggcctcagccgtttgccctgtcactgagacatcgtccaacttaccgctcttgtatagattcatcgccgtcgaattttctttgaccgcttgataggtgattttctttaaatgtacgtttttggcgttccagtaattgggattcttaacctcgacccatgaatcatcggtacctttccaatttttcaggataaatggaccgttaaaggtaagctgagcggaagtcttggcaaagttcttgccatatttttcgacagctttcttttcaactgggtcaaaagtctgcaagcaggtcatacttttaaaatatggaatcggttgatcaagtgagacgacgaatgtgtatttatccggtgccttgacgcctaattgtgaggcagccattttacctgctgtgatggcatcagcgttcttaatgccactcatgataaaggcgtaaggggacttcgtggctgggtcgacaacccgctgccaagcaaagacgaaatcaggtgccgtgacgtcggtaccgtctgaccacttactgccatggcgtaggtgaaacgtataggttttttgatcagatgacacgtcagttttgacggccaggtcagatgttaacttttttcccttatagcgatagagtcccgccattgtgtccgttaatgtttggccagaaacagcatccgtaaattgcgccggatccatggtcgcgataatgtcggatgtcatcgtcttatatgtattgttaccactggtttttgaggatgattgctggccgcatcctgccagtaacagcgtgatcgagaaagctgatgcaatttttgcgagccgtttcaacatgtaatctcccctttttctaattaaatataaattcaatgatgaaactataacacttgcttaattgtgtcgcaaactcaatcactataagaacgccgttgaaaaagcagttcctaatcaggggaaagaacaggttgacgcttatattcgaacgagtaaaatgaaaagaaaatgagagaaggcgttatggtgcaaattaagaagattcaagtctttcgccgcccgatcactttacatgagccgttcaaagttgcatttaccacactctataaactcgagacactgattatcaaaatcaccaccgacactggcttgattggctatggggaaacgaacccacttgagcaggtgaccggcgagagcattgatacggaagaggttgccctcaagactttgtcccaagcgttaagtgcgagtgatccgcgcagcttagaagccattcacgccaaaatggatgcctgttttgctggacataccgcggcaaaagcggggattgatatggcttgctgggatttgcttggaaaagataccgggttgccggtttatcaattgctgggtggtaccgggaacgttttaaccagtgattgtaccatcgggattaattcgccggaaaaaatggcgcaagaagcgaaacggctggtcgatcaaggatacagagaacttaaggtaaaagtcggcattcaagacgctgatgatcttgcagctgtgcagacgattcgtaaggcagttggcccaacggtagatttgcgcctggatgccaaccaaggatggaaccctaaacaggctgttcggatgatgcgagccattggcggtgctgcttcggcggttgaacagccattgccagctaaccgcctggatcagatgccagcagtatgtcggcaaattgatcaattggtgatgttggatgaaagcgtccataatgccagcgatgcctttgcggcggtgcggtcaaatgcgtgcgatatcattaatatcaaattgcaaaagtcggcagggttgtctggcgccgagcagattaacgcggtggctgaggcggctgggattccgtgcatggtgggctgtatggcggaaacgcgcatcggcattgctgcggcagcgcattttgttgctgcccaccaaaatgtccagtatgctgatttggattcttttttgctatttgatgaaccggcgtggttgcgcggtgggtttacggcggatgcaggaaaatatcagctaagcgacaaaccgggattaggcatcgaatgcgatctgtaaaagctgtttgagctgttgacagtggttactataacgcgttcaccgacgcagaaacctgcatataagggcctcggtcgcaatggcctaagcccgggccatcacggaccaaggccgcttacactccggtttctaaacgcgccggttcacgctcacgctaggctaggaggtctttatgacaacttttaaattttatcaatcgggtttacatttcggtacgttcgaattgactgatcaaaccattacatattcttggttaggtagtcgggaaaaaacgttaaacgatgacgataatgcgatttttaagacatacggcgagcttgatattcaggcaacgttaaagcggtggcaagatggcggctacgcggacttttcaaaggcggatcattttaaaaccgcttggggcgctgaataccaacgggccgatgaacatcattggatgaatcgcgggccaaagtatgcggttgacttgattgaggctgatgatcagattgtcgggtttcaggtttgtgcgcgtaatctgaccagtgtgctgattcaaccgggatacgagggttatagtgttttggctaagtggcaggaagcggggtacaccgcgacgccaggtcacgcacatcaaccattcacggcttgggcgcccatgcgtgatggtgtcggtttggcggcaagggtgattttacccgccggatccggaccatttccaatcgtgatggaacgaacgccttatggtcgcgaggtttatgtggcgagttatatgcgttatgttttgcggggctatgcggtggtattacaggatgcgcgtggccgcggtgattcggaaggcgaatggttgccgatgatccacgagcaggatgacggcgatgacacgctggattggattgctgcccagccttggagtaacggcaaggtagggatgtctggcggctcatatggcgggtatgttcagtgggctgcggctgccagtggtaatccgcaccttcaggccattgtttcgatggttacggcaggtgggccattcactgatacttactatcgtcgcggcgccccgtttatggcacaggtagcatggtcgattgcgacggacggccgccactttaattcggcattaaccgatcgcgatgactgggatcaactcatgaaggttcggccgatcgaaaagattcccgagattgttctggggcatccgcagtatggcatgacccaatttatgcgccataatcattatgatagtttcctcaaccgaggggactggtttgccagacgcgacaaaattaaagtgccggcgctcattcaaagtggctggtacgatgatgatggtatcggctcgactgaagccattgcggcgacggctgactatccgtccgacaagcgccggattattcttggtccttggctacatggcggcaatgcccagtatgatttaggaccggttcacttaggcgccgaagcactgcggccagatattgatctgattcaccagcaatggtttgatcattttcttaagggcgttgaaaatggcgtcgctgcgggcccattggttgaatactataccgttggcgaagaacgctggcatacagcagcatcttttcccccagcaggcctcgtcaaggtcttacatctgggcacagatggcagtttggcagcgtccgcgccagcagcgggaactgtcagctatgttcacgatccgagcaatcccgtgcctaagttaatttcggtgacccagaatgaattcgaatttccggctgattatcaggaagttgaaaagcgtccggatgtggttagttttaccacgaaggaactaacaaccccgctgcgtgtcgttggccaggtgaagcttgatctgtgggcgtcatccagcgccgtcgattgtgactgggacttccgggtcttggatgtcacgccggatgggcagtccatacaaatggcagaaggcacgatgaatgccaagttccgtgacagtttgtcagagccaaaatatctcaagcctagcaaggtgacccattttaccgtactttctcagaaaacatcctatgaattgccagccggccatcgcctgcgtgtcgacattcaaagttcggctggcggatttgtttttccgaatcccggaaccgaggaaggctttgccagtgaccgcttcgtgaaggcgacgcagacgattagctgtggtggcgaacatgccagtgcgattcgttttgttagtgatcagccagagaactgacgaaccgcgccagctcacgctcttggtaagaaatttgacatttgcgagtaaaggccgtatattcctaacaactaatcaacactttgagaagaagagtaaccttggcgcaaatgattcagcgaacccggttggtggaaaaggggcattggcaagaaggtgaagatgagcttcgaatagtgattcgtgtggttaacgcccatggatcggctgcagccgttatcctgccaggtatcaacaggtactggaggcggtgtgttaataacatcgcgaataagggtggtaacacggcatggtcgtcccttgactacgaaaaagtagtcagggggcgactttttgtttgcagcaggagcaagtttgaaggtcactcaaaacaaggtgttgagacggtgatcgtgaaaataatttttgtcgaggtttctatcggccatgttcacggtggctgatcatttgagggggctgtgtttatgaatcgttggaagaaaataatcgtcacaggaattgctttggtgtcacttttgacgctggtcgcttgcggtaaggctgcgaatgatagcagtgctgccagctcaagcagcaagcccatcgtgctcggcagtagtggctcggattatcagatctggcaacatatcgctaaatcgccgcaagccaaaaaggcgggactgacgattaaagtgaagcaggtcacggatggcaacgtaattaatgcttcgactgctgaagggcaacttgatgtaaatgcgttccagtcgtatgcctattttcagcaatacaataaaatcaatccaagtcaaaaattggccgcacttgggacaacctatcttgagccgatgggattgtattcaaagaagtacaaacatttaagtgacattcccaatggcgcgacgattggcatttcaaatgatccagccaatgcgacccgcgggctattactacttgcggccgctaaattgatcacgctgaagccgaattttaatgcgctgagtacggtgaaagacattcagacgaatcctaaacagctgaaatttaaagaagtggaaaccacggtgcagacgctgccggacgttgatgccgagctgatttccaatacacgcgccttggatggcgggcttaacgttttgaaagattcacttttccatgaaaaattaacccagaaaacgcgggcaaatgtcaatattcttgcaactgcagccaagaacaagaacaataagcagttcaaaaaactcgtgaaactttaccacgatccaacgcttcaagcctggatcaagaagactttttccgggacgaagcttgaggttaataagccgatcagctacctgcaaaaaagtaactaagtgagtttacctggctgaaacgcgttcactggcgcagaagtctgcgtgtaagaacctcaggcgcaatgccaaaatcgggccatcacgcctgaggccacttacacgccgatttctaaccgcgccagttcacgctcttgtcaatttccgcggttcctatgtcattctggatctgttataatggacacgtaaaagagacgccttgcctcaacaaagcgtcccttgttacagcagaaccgtattaagaacggtggcttacatcgcaaactaaaagccgcgattggtgtccaaagtcaacgcggcttttagtatatttatttttttcggaataatccgagcgcctgctttagctcgtaaactgcaaagcacagttttctcaaagccttgatcaaacgggtaaacgcgttgaccaaaacagtgaacgagctgatgcaaaccgtgattgtcgcaagtgcggcaatcataaacacaccggcacctcctttcgtcggaatgtggttcgatagtttttacaccatcggcatcaccttctttcgattgcgaggcgccaccgcctattaacttttctgctcattcatagcttatcagatgtcacacccgcgaccaatcatatcgcgggttttttaataactaaaagtctgaaaagatgtcagaggttaaatgaacctaaagtgctgactgaacaagcgtataataacaactgtactgttagatcacgtgattcaattttcttgaaggaggtttttctatatgtgttcatctatgacgatcaaatcgcttcaaggtgatattttctggggccgaacgatggactataacacgagtttctttcacgagacaccggctggcggcgttccggggaaaatcgtgagtctgccggccgatcatcaattgccggcgcaaagtggaacttggacaaccaagtatgctgcggttggcgttggtgttgatcagagtgtcgctttatttgatggcgtcaacagtgaaggacttgctggcgatttgcaggtgctggttgagtgcagctgggcgagtgccgtttcactggcgaaacgcaacttgaaaccgatcaaaggtgaagagtttgttagcctggccttgacgacttgcaaaaacgttgccgaggtacgggaactggccggtcaatatggcttgattgacgaaccgctccagtttggcggtcaaggcgttaaaattccgctgcactacacgtttgtggatccgtctggcgctgggttagtgattgagccaaccgatcatggagccttcaagctttatgacagcattggcgcgatgacgaatagtccggagtatcattggcacaccactaatttgcgcaactatgtcagcctgaacgatcgcaattatcctgaaggtgccgatctcggtgaccaccatcttgacccgatcgaactgggaaccggttatggcatgttcggcttaccaggtgattacacctccccgtcgcggtttgtcagagctatgtttgtgtcccgcaatcttgatccgtttgaaagcaaagatggcatccgcgtgctttataatgccttcaagacagtcctgattccgcaaggcttgggtcgcgatcctaagcatgacattttgacggactacacccaatattggtcaggctatgacttaagtaagcgggcgctttacgttcaagattcaaacacgctaaccatgaccaccaagacgctcgacccgaccgttacggaagtcacctatgacgatttggtaaaaacggaacagtttaatcaactataaaaaatctccaaaaactcatcacaaaaacgccgccaaatagggagctcccctttgacggcgtttttgcacaatgctataaattttatcgttgccgtttttgccgtttgttcttctgccactcggccatgggaataatctgatccgagtcggcgtgaccggctgttttggcgtggccttttcgcgggaccggctttttggtcaaggcttccttaatctgattttgcgccgtgtcagctagggatttcatttgggttgccgtccacaagtgggtgctggcggtggacttgatgaagatggctaaggactgccccaagccttcctgcttatccggtggcacgagcttggtgtcgcgcagcaatagcaacagcgcagcgccaatgtcctggctggtccattctttcggctcgtggccaaacatggcttgaatcgtgtgaattaggaaaaagatcaccgcgccaaagaattcttcgtcctgagtggcttctggcaggtgatgccaggcctttgaatcgaaaaagaccatcagctggtcgactaggattgacatgctttcggaatcaacatcaagatcgccagcaggatcaaagccaatatcacgcccgtcagaatcatcagccatcggagacgcaagctcaccatcttcgactaacccgaggacataggttgttgtgagcaatgcgcccattaatgcatcaatgaagtcgacaatcgtcaacttgacgcgtttggtgcgaatcaaccaaatcatcatggctttaatgagctctgaagcaacggcgatcgcttcgctgcggcggcgatcgtcatcgttgacctgttgcagtgtcgtttcgagtgcaatcgacaccgattcagcagaaagtgtctgaatggtggagcgtagattcttgaatgacgcagcaaagaaggtgaccagaatggcgcgaatttcttttggtggtacttttctaaaatccggatcctgcatcaaggctgcatagtcatcgcttttttgaaaatcagaccaataaagatcgatttccttgctagcatgtcgttgcagtttttcttggtaatccatgttgccctccacttcttgttgttacgggtttgcttatcttcagtttaacagttgttcgcccttgctcacatgaaaacttgctttgttttctagaagaaattcatagcagcaaaagccctgtgatatggatgctttcgagagccgctattgcttaaaatttagtcaaataaaatcggcaccaaagacagaatacgcgtctttggtgtcgattgactgtaagtgtggtggataaatgatttttacctgcacaggttacttcagtggcagtttattcgaacattttcttcgttgcccgcatcagcgtcttaatatccttgtcgtatcttggcgtttggacaaggtgactcatcgggatgccggtgaagtgataggcagcaatttcgcctgagcggacagcgctttgttccgtgaagaccatctggaatggctgttcgacgaattcaccggtgaaggcgaggttcgttgagtgggccggaatgacttcgggacgatcgactttggcgcgattgttgaaaagtgccgaagcatatggcatgtagactggaatattgttgatgatgctggccataatcgcatcttggtgatcgcggatattgccgggacccggatcgacttttgccaattggccgatcagttcaagtgccatttccttaccggtcattttgatatacggcttgttcacaaactcaccgtaacgtcgtggatagaggaaatagccccaaagaacggtctcgtttggcttttgggtggtgaagtgcggctgatgatgcacgacaatcgacatcatcacgtctttttgcccaagcgccgtgatcggctgggtggataagaaggaattcaaggcattccccggaagctgcgttgtgatgcgctcgatttcattgagcagcaggtgatccttggtggtcaaagtaaaactgacccattcgctggcggcgcgatcagcaaagaacttatcaggattgccaaggttataaaaatgttcagtggcttgtttccataggccagctgcggcaccttgatccatgttttcaacggccgggtggtcaaagtcgccttgcgtggccgaatcagtgatggagccattggtaaagaagacggcagtgtcatcatcaacatcgacatgctcggttttggcggtttcagtgttcagcatgttgagaccggtgacggtgatttcatcggtcatagccgtatctttaaactcaaaatccgtgacccggcgattgagaataatccggcagccttgatccttcaggtagttgatcagcggcaacatgatgctttcgaattggttgtaacgggtgcggttaacgcccaccagatgctcgatttgcgtaaactcataaatcatcatgtgcatgtaacgccgcaactcttgcgctgaactttcaatccggaacgcgaaggttgtttcccacatgtaccagaaattcgtctggaacatatgcggatcatctttgaagtaatcagcaatgctgacattgtcgagtttttcttcttctgagtctggcatcataatcagcttggttagcaaaagacgatccgtgttgttcagccctagatggccagcctgaatgatgccgatgccgccttccatcagccgcgccttgtcaaaagtgcgatgctgggcatcaaactgccgggtatcttcttcagccgtcaatcccggttcagttgccgaggggatccgactcaacagatccatcaaatcaacataggtccgatagttcagcatgcgaccgccgcgtgccacatagcctttggtgttttccatgggatgaaccttattccagtactcatctgccgcatcagcagccggagcaccgtcatttgacccgtgatcgtccagtgaataaaacgtgatttgattgccctgccaatgaccttcctgaatcagataaacggcggccgccatattcgccagcccagcgccgatcatgatcgccttatgcttgatcatcttttagtccccctaacgactttcaaacttcttgtatgcatccgcgtcatctttgaacagttccattttgttagcgaagtaccaggctgttcccccggtcaccaaggccaggctgagtgccgtccataaaagttttttcatataaaaacgcttcctttccgtctatagctatagtatagccatccgaaaaagaagcgtctttagtcaaaatgtggcgtttgttcgaaaattaagttcttttattgtgcgcttgcttgtgcacaatgaacgcaattgaaccgttaagcatgagatcagcacgtttgatgaggtcgtcttcgggttcctgtaacgactgtgataaccacaacaaaacctggccgacaatcgcggcggcataaaaattacagatgtccgcaaccattttggcaggcgtggtcggatcaatgtccaggactactggcttgaccatgtcagtcgcggactggaaaaggaattcttccagcatgtcgcgaccaacggaattaaaggcgttcagacaaaatgcctgattggccagaatgtaatcgagcaccagccgatacttggcttcccaggtggccgccccaagattcttcatgactttacggccgatgtcagcttcaaacgtccacttcaggaggccgtaaatatcttcaaaatgataataaaacgtgttgcgattcacgtgggttgcggcactcaattccgcaatggtaatgcgatccagcggtttatgctgcatgagctgctttaaggtggtcgcgagttgccttttggtctgatcggatgtggccatcaacatcattgctcctgtagttatgctaaaagtatcgagttggttgggttgggacaaaagtttgccatgccactgctaggcagcgacaggtgggaaggttacttgactttcaacggcttcaactgtgcctcgattttatccagtgtcacgttggcttcaagtaacgcagccgcggcataagcgccttcgacaaacgctacgtcatagacatgcatttgtttgtcgctgacttcttcagcgatgtcgagattcattttggcgctgccgagatcatagaaaaccagcaactcggaagccgggttgtcgttaatggctttttgaatatggtcaagatcggtgccgatttgaccgtcactggtaccgccggctgtggtgattggcacatccttggcgacttgtttgattagcgtttcaaggccgctggcgatggccggtacgtgggaaacgagcaacatgcccattgccatagaatcacgctcctttgggatttagcagttcacgctcttgcatcaaggtatgcttttagtagctcaccagtcgaagctgcgcctgggtcaatgtggccgacactcttttcaccgaggtaagaagcgcggccgcgtttggcggtcattggcttggtggcttcgaccagtttgtcaatggcgtcatcggtcaatttgttttgcttgatcaaatcagcagcaggtgcccagacatctaacatggttttgtcgccaggcttagcttggccgcgtttggcaatacccttggcagctgcttcgacaaggtcgccaaagtcagtgtcggttttggcgagtttggccatttccagaaaagccgttccgtacaacggaccactggcgccgccgactttactgagcatcgccatggcaatcgtcttgaagtcttgcgccagatcatcggttggcggtgtcttttcgaatgctgctttgatcgcattgacgccgcgttccatgttgttaccatggtcggagtcgccgatcacgcggtcaagttcggtgagatgatctttttgatcggcaatccggttttcaaaattcgtcatccatttggttaatgtctcaacgtttaacatcagtatccccccagcctacagtatgtgcagatgcattcagataagtcagccattgcggatcgtccagcgccagcatcgtcagcgaaacgccagccatgtcgagcgatgtgacataattgcctgccttggtgaagctggcttcgaggccttgggcatgcaactcgttcaaaacatcgcccatgaaaatatactgctcggacagtggggtcgcacccatgccgttgaccagcaccgcgtatttatgagctttaggatctttgaattcaaccgttagcttgccaatgagctgcttggctaacactttggaagtcggtagcttttcctgaccggtgccgggttcgttgtgaataccgacgccaaactcgatttcatctggcttcagatcaaaaccgggcttgccgacttccggcacagtcgcagcatgcaaggcaactgcgaacgacttggtatttttaacgaccgcatcgcctagctttttgaggtcatcaaggcctaatccagcctcggaagctgcgccgagaatcttttcgacaaaaatcgtgccggcaacgccgcgacggccctgtgtgtacagtgaatctttgacggccacatcgtcatccacgacgactgactcgactttgatgtcatcgacgctggccaggtccttggccatgtcgaagttcatgacgtcaccggagtaattcttgacgatcatgagaaccccttcgccttggttaactgccttgattgcggcgtaaatctggtcgggcgtcggtgaggtaaagacttggccggccactgcggcatcaagcatgccttggccgacataaccggcatgcagcggctcatgccctgaaccgccaccggaaataacaccgacttttgcatgttgcttaaatgcggcgtcattgcggacgaccgccgttgtttcaggaatctgtttcaaatattgcggataactggcagtgagaccagcaatcatttccgggacaatatcgcccgggtcattgataatcttcttcatatttgcaactcccttctagttatcagtgtaccgctttcagtgctaaaaagtcaggtcgtcagctaagaataacaaggggaatcttaatggtggcggcgtttgtagtgatcggttttagatcgcgggtcagaaaataaaaacgcctcgttaggcacattttggcttaacgagacgaagaggtgatgcaacggttagtcatcgaaatcggtgacagtttcgatggtgtagttgccgctatttttaagtaattttgaaaccgggcagcgattttcaatttcttcggtgaaggatttggcggtatccagatcgacgcctttcaccataacctgggcatgaaccagaaattgatactcagcacgggcgccgatgaacgccaccttcacgcgaactgcgccggtatgtggcagtccgtgttctttttcaacggcttccaatgtggcttcaaggcaagtgctcaacgacaagcccaaaagctgttcagggttggtccctggatggtcattcatcgggctgctcgtctgaaccttcagtccgcctggcacataagcgtgaccttccagtccttcgtcgttaatggcttcagttgtgtacagtgggtgattccaacgttcgtcttgcatgaaaattcctcctcgtggattgtcgatagactagggctcttggagcagaaacttatcggttatgccggtgcctaggatccttaattcagctgtggcataactaggtaaccatattaagtataaacgcttacatgtgttcagtaaactgatgttcttttctctcaagctaagactggattacgatttaaagattctggaaattgatttataaaggatcacaatcagaataatatcgtttccaacaccaaaagctaacgctgtgactagaagcaaacctccaccaacttggccataaagaacgccaaggactgaagcaataaagaaagttgcaaaggctgcaatccataattttcgcattttgattgacacctcaaatccaaattagccatttttggctctttatagattaccgcattaatgaggaattttatgctaatatgaagtcattcatatttttatatttcgaaaagaaacgaggtacttgcgtggcggactatgcagcaggatccatttatcgcgaggtgcggcgaagacgtgacttgaaaatcaaagaagtaaaggcggatttacaccaatcaacaatttcccacttagagcacgatcagagtgacatgacgttgcggacaatgatgaagatacttcagccaacgtttatgtctgccgaagaattctgccatttgattgatgataaacgcgagacagcaacgtcaatttttaaacagatagctcactattatgactcgacagatctaactggcttgacgcaattgttgaaatcatataaggaaaaaagtcaaccaacaacgcctaacaggctcatagagttgatgattcaaagttttatcgatgagttgtctgagcgggagtcttcattgtccaaagatgattgcgattttgttcaggattatctattacaacctggcagatggtttagctttgaatacatatctttcgctaatcttgtattctcgctacccggaaagattaatttaagaatcgcaaaaaagatgtttcacgcttatcagcaatttcatctgccaagctacgatgagttgctagtaaatgccttatataatttatctgcttctttcatcgaccaagatgatccttcttcggcaacacggcttttaaactttttagatctagaaaaattagaccgccacgttctgtacatgcggcatcatgtgacctttctgaagttgatgattcagtttaagttggagcccctaaatcgagaaaatttaaacaagctgaaggtctttttaaaagccacaaagctgattgatgagactctttttgaaaagaacatcgactggctcaaatctttaaaaattgatccagatacaattttagagaatgcttagcagggcaagctcattgcgactattataacgacgccatcaggtcaaaaaacaacgacttttgcaaatggtcatagaccacgaaagtcgttgtttttttacttttcctgaattttcgttttctgaagttttttcttttgctgacttaactttgtctttcgtccaccttcccaaatgctgattagtgccataagtccgacaatgggaagaacaatgtcaataacggagaaatgtatttgaccttgagtgatgaaataaatatatgcaacgaccaaagatactggcaaaatcgctcctagtatcttgctgccgatgtaaccaaagaaagtctgtagcaagatgatggcaactatcatcactacttcaagtatgatgtacggcatggcccgtctccttatcttttgaacgcttacgtaagatatggacttgagtttgttttacaatcttcgaggaaatgattctttacaactttaatatagctaaattctattggattggtcaacaaaagtggactgtacttaatcgttaagttgaatgaattaataaaatataaagaccggatttttgaatcggacgcaatatgtttatttttaactatttgtcactcaaatccggcttctgataaggttccggatcattggcgtgttcaggtgggcgttgttcaaagccaagttccttggtgatgagtgggctgccttcccagatgaggtgttcgagcaacgccatcgtggtttgggcatcactcaaggctgtgtgggaaggtaagtcaatgccgagtgcctctttgtagtattgcagtgaaggggtgtgctttttgccgatcccgaaagttttacgggctaatgtggcgacatcgaaggtttgaacaggtggcacatcgatcgcgaggccggcgcgaagggcgcgtaggtcattgctgagtgcgaagccgacaacgagttcatgcttcaataattgctcgacggcggttttggcaagcggcaacggttgtccgtattggttcaacaagtcatcggtaatcccggtgattttgaccgagaatggcatcacgtgatggccttcgggtagttgggtgaaaatgtcaaacgcacctgcgacttgatgaccacgcacccgtaacaagctgatttcggtgaggtcaagttggttgcgatcggccacaaactctgtatcgatcacgatgtagtcgccccgagccagtcgatcgatgacgtctttttgcgtttttaacggtgcctggtctgaggcaagctgggccatagttggcgggtctaactgcagcgacttggccgcgcgctggttggcagattgcactaacggcgctttttcctgcgcaaacttggctgctagtttggtggttaagcggtctgcttgttcttgccgttggtggcgcaaatcggtcagggtctgatcggcttggcctaaggaaatgccaaaaagcctggccagccaagtagcaggggcagtcggcatcgtcgtcaagacataggtgcctttgagatcaagcaaagaaaagactacctgaccgttttcaagccaattttgcaacccaagggcgaggagatgaacccagtcactaaacggctgcatgatgattggcaatttatcggcggctctcatttgatccagttgtcgagcagcgctagaaacagctagcgtaaggccgcgggcgaggcttttgcggtgattaccaaaatcctgaaccgaaaacatgatgggaagcagcggaccgcgcgggcgcaacatgtcacgcaatcggctaccttcaggataccaacgagccagatcgaattgcacgtttccttgaatgttgacccgattaacggttgcagactggtgtggccggtactcacgatgctgaaagagcgccatgagttcatcaacgcgaatgcgcacggctgcggcattatgcggtttggcaattgggtcgcgcaataacttattcaactgacgccgtgcctgtcgcggcgagcgcattttcctttttcgattagtggaccgcgccatgctgcaactctccttacttggtatttgacatatacgaacagtataccaagagtgaagaaaatttgctttgggggatcaattatggccgatactgcgagcggttagacgcaaaaaatgattcggacgtccacttatttttaagaagttccttgttttcaccgatcatctgtggcataactgttgtatggatatcaaacaatcaacagacgcaacagctttcaagcagcgaattttctttgccttgtccgagccgggacgttacacgattgtgcgcatgctttaccacgtgggccacgaaatggggtgcaatgagcttaaccagcacgtggagattgacaaatcaacgatgtcatatcatttgcgcacgttacgtgaaatcggcatgattaccacacgtgttcagggacggcagaaatttgtcacgttaaataccgataagattgaatctgtcttcccgggattacttgctgagctgtaaataagcacatggttgcttattttttagcgacaattgtttgataaatttaaaactataaaacagattggagactttttgcatgaaagaacgcagactctcgcttttatttttcctcgttatgttcgtaattggcacagatacgtttctggtttcacctttattaccgactttgacccggtattacggcatttcaacgagtctttccggtctcattgtcagtgcgtacgcggtgggttacatgctgtcggcgttgctgattggcccggtttccgatcgtcatgatcgtaaacgcattttagttatcggtctaattgtctttaccctcgccactgccgggtgcggactggccaatacgtttccgctgatgctcgtcacccgattcattgccggcattgccgctgcgacagccggtccgcagatctgggcggcgattcctgtactttttcccaagtgtcaggtggtcaaagtcatgggctacgccacagcgggtttggcggttgcccagattgtcggcgttccgcttggtagttatttggccgttatctcgtggcgttttcccttcttctttgttggcacgattgcactgatactgacattgttggtcgcgcggttcatgcccagtcttaatgaagttagaaccgctcagccaaaatccagcatctacggtcagcttttccagaacaagccggtacttaagttattgggcgcgtacttattgtttcagacggcaaattttaccggctttgcgttcatcggtacctggttcgcgaaaagctttgggctctcggtgggcacgatcggcagctttattctggtgatcggtgtcgggcagtttgtcggcagtttgatcggcgctcgactggtgacgtggttaggtcagccgcacgcgttcctgcttgaattcctgttgttcatcagtggctatgtcgttttgccattggcttcgtcggcgttagtcgcaacgatcattctggcattgatttacaccattggcggcgcgctgttgccgttgttcatgagcactttgcaagatcaagcgcgttcagcccgcggcaccatttcctctttggccaacgcggtgatgtatcttggcgaagcaatcggcggcgttgtcggtggtattttgattaaacagttcacgggcttctccggcattgcagtgtttaccgctattggggtaacccttgcgatgttgttgtacgcacggcaaggctattttaattatggctggccgaaaatcccgtgactttagtcatgggatggacaggccctgtcaacgcctgttagggtgttttgttagttcgttgtacttttgttcgttgatgtaattctcaaccgcgtccttgcccatgttgccaagggtactcatgtagtagctgggtgaccataaatgcccaccccaatcttgagaatgtcgaatttctggatgccgtttgagaaagataaaggcacttctacccttgagcgccttgatggcactggttggtgccttgctaggcggaaaactgatcaag

SEQ ID NO: 297 - DNA, 24798 bp, Lactobacillus casei
gggacgctaaaggcactggtaattgccgtgtaagacaagcagttcgtagaactgcctgcagtggtgtatctgtgcaaattgtgattcaagcgctcgtaacaggggtgcttgctcacaagccactgactttagtcagtggtggttgacgcagctgcaaacaagccgctgatgattcgtaattttttgcatagaggtattgttccgaaaagtagcaaacgatataattgacgcaagaacatatgtttgctgttcggaaagaagatgccatcatgcaggaaaatttagcgcaggaaatcttattgttgttaggcagtgggcggtttttaacgaccaaagaaatcgctaaactgctaaaccatccagaatcaagtgtcaaaagcgaattacttaaattggtgcatgctgagaaaattaaccggcgacattttgccggtcgcgattattttcaaacggttaagccacagacggagccgaatatcctcagcacagcagcggaacaatacttggatcggcgtcatgcagcggaaaaactgggtgatgcgcggacttgttaccatcatttggccggaaaagctggcctagccttgtttgaccaacttttaacgcaaaaactcattaccttgacgaccgccaacgcctatcgattgacggaaaaaggtcagcacgttttggcgcggtacctcggtcacccagtgcgccaggaaaaggttcagacttgcatcgacttttcagagcgccgggttcatttagccggtaaattaggggatgaactgctgacaaagctggtggctaatcatcaaatgaccttgagcgggaacagactcgtccgggttttacatccaattgatcagcaatcattggcggtatcccatgtcagttgagcgacaacggtgtgcgtggggtgaaaccggcaatgccttgatgcagcaataccacgatgaagagtggggcagacccagtcatgacagctgccacttgtttgaactcttgtcgctggaaattatgcaggcaggcttgagttggcagacggttttgaacaagcggtcagcgtttaaggcggcctttgccaactttgattatcgccgggtacagcagatgacccccgaaattcctgtactcttgcaaaatccacaaatcatccggaatcgtctgaaagtgacagcgattatcaacaacgcgaatgccattgcaaagctggctgataaaggcgagaactttgatcactacgtctgggcattcgtcaaaaatcggccgattcaacatcacatcacaagtcatgcggaagttcccaacacaaccgatttggccaagcgcatgggcaagcaaatgaagaaggacggttttagttttaccggtcccgtcgtcatctactcgtttatgcaggcagcagggttagtcaacgatcatgaaaccagttgctttgtttatcagttgctggaaaaatgaaagtgttaaccgatattcgtcgattggaatgctgacaacgcttatcagaacgctaggaggattaacactcatggaaacaaccattcgcaaatttggagattcaattggtgtcattattccaaaagagtttcatgcaaaagttggcgaaaagtatcagattcacaagatcgctgatacatttgttttgacgccagttcacaaagatttgtttgctgacgaaacggaatggtatgggtttagagatagtgttacggaaagcgatcgtgagtgagatgagagcgcacttttatagcaaataatattccataaaggatgccgagtactgaacgtttctgaaagatcaaaaagcacgccacctcttgttgaagtgacgtgctttttggttggcagccatgcggattcgctgaagatgcaatagaagtctgccgttaagaacaacctatcttgagttattagtcgtcaatatcattgtgcaaatccttcagtaaagcgccgaccgtcttaaaacttttggtccggccagctttgacatccgcttctgcagtttgcagctggccttcgacaattatctcaggagtaaatggcagttcaccagtgtcgctaatatacttcaaatacatattaatggcagaggacatgtccaatcccatactattgatgacgcggagagcgcgatcttttgtttctgtatcaacttcaacgttaatgcctgatcgagatgccattgctgtcaacctccttaggccattgttgctttattatgacgcaaaaccggcgatattgtcacccgttataaatgccatgaagagttcgagaaatcctcaatgaaaactgaattaaaaaaagcccacccgcaccaaatgcgaatggactcattaaactcaaaacggtttaaattaaagtgcttcaggaaccatcttgacaggcttgttgccgatccagccggtgatttccttgaaggtgtctgtgatggcatcggtgcctggcttgagcatcttacgagggtcaaagcccttgccttgttgatccttgccagcttcgatgtattcacgggttgctttagcaaaggcaagttggcattcggtgttgatgttcaacttggaaatacccatggtgatcgccttttgaacttgttcttgagggataccggaaccaccgtgaagaacgagtggcatcttaacggcgtcattcaattcttgcaagcggtcgaagtgcaggcctttccagttgtctggatattggccgtggatgttaccaatgccggctgccaggaagtcgatcccggtagcagccaaagtcttggcttcttcaacgtcagctaattcgccttcgccgacaacaccgtcttcttcaccgccgatggaaccaacttcggcttcaacggaaatgcccttggcgtgagccagcttaacgatttccttggtcttttccaagttatcttcaaagtcgaggtcgtggccgtcgaacatcacggagttgtagccggcagcaatggcttccttagcagcttcgtaattaccgtggtccaagtggataacaaccggaacggtgatgcccatggctttaaccgttgcttcgatcatggtttggcaaaattcatagccgcccatgtacttagcagcacccatggaagtctggatgataaccggaacattcaattcttgagcaccggcgagaatggcacgggtccattccaagttgttggtgttgaaggcaccgatacagtagtgacctttatgtgcagcttttacaagctctgcagcgttaactaatggcatgtagatatcctcctacgaaatatacaattcacaaccgttgtattctaccatagattgcaagagaaaagggcgagaaaatgatgagatcctgacggtttaagtgacgggttttgcgggaaccagtcatcattgtcctcgccaaataatgagaacgctctcattattcgaatgatcgattcatacactacgtagcggatttcacaagcgactttaaaaacaataaaaataaaacagctttatcacgctagttctaggcgctatttgattgctaacctccaaaaatagattatattttcacaagcgaattataccagtataaatgaaaccttgctaagaatgattgaccatagaaatcaaagaactaaggtgaagatagtaacagattgagaacaattgagttgttcacacgaaaaaatagtcaaaagaggagatcttgatatggcaacaaaagcagcagatcagttagtcagcgttttgatggattggcaagtgaagcacgtttttggcctgccaggtgattcgattgatacgaccgttgatgcgttgcgccgccatcaagacaagattaaattcgttcaggttcggcatgaagaagttgcggcactggctgcctcggcaacggccaagctgactggtggccttggcgtttgcttgtcaattggcggtccgggtgccatccatctgttgaacggtttatatgatgccaaaatggatcacgccccggttttggcactgttgggacaggtcacgaccagcaatctgaatgaaggctttttccaggaagtcaatacccctaagctgtttgatgacgtggcggtttataataaaacggtcatggcttcggataatttaggccagattgtcgatacggcgattcgaaccgcgtttacggaaaaaggcgtagcggttttgacgattccggatgacttgccggatcaaaaggaaacgacgagttatcgcgacagtgctgcggcctttgcgttgaacgtgccggaagttgatcctaagcagctggatgatgtggcttcgctattgcagaagtcgcagaagccattagctttgatcggccgtggggcggaacatgccggggaacaggttcaaaagtttgttgaggccaaccacgtcccgtttattcaaacgatgccggctaaagggacggttgccgatgatcatcctaatagtctgggcaatgtcggtaagctcggcaccaagccggcttatgaagcgatgaaggcaactgatttgctgttcatgatcggtaccaactacccgtacacaccttacttacccgatgaaggacaggcaaaatgtgtccagatcgatacgcagccggaaaatctgggcaagcggtactcggttgatgtggcggtcgacggtgatgtcgaaaactttttgaccgagctgaatgccaagggatcgttacgggatgacgatcgcttcttgaaagcttgccagaaaaatatggaaagttgggacaagtggatggccgaaaagcgtctattgaccacgaacccagcctcgccggaagcagtctttgccacgattgatcaaaccgcgccaaaagatgcggtttactcagttgatgtcgggacgtcgacgtcatggggtgcccgttttctaaacgttcaaccaacgcagaaatatactatttcggcttggttaggcacgatgggctgcggtctgccgggcgcgattgccggagccgaagccttcccgaagcggcaaaatatcagtgtggctggtgatggcgcgtttgccatggtcatgcaggatttcgtcacggctgttaagtacaagctgcccattatcatggttgttttgaacaaccagaaattagcgttcatcgaatatgaacagcaaagtgccggtcagttgaattatgaaattgatttggcggacatggactatgccaagattgctgaagctgctgggggcgttggttacacagcccacagcaacgacgagttcaaggaagcgttgaccaaagcctatcaggaaacggataagccggttttgatcaacacctatgttcaagacgacgccccgctaccaggcaaaattgtcggcgaggaagcgaagggttacatgaagtatggttcccaatatcttgaaaattactggaagattccatccatgccaccgttgaaggacattatgcggcagttcttctaacagaagttcaattattaatggcggtgcaagggatgtactcattagaaaaagcgcgaattttctaaatggaaactcgcgctttttctattgctcataaatcatttggtatgaagacgtgcgcttttgttaaagagttgacagccacacagccatttccttatgccatgctttacgcgcctcagtgcttggcgacatgttgtttaacgtgatgtgcgttaactgtttgtcaaatgaaacgtcaaagtaggcccagaacccaaaaacgtgaccgttgtgtgccagccatcccggggttttagacttcatccagcccatgccgtaaaaatcgtgcgtcaacgttaatgcctcacgccaagctgatgcaggcaaaatctcctgatgcaaggtagcttgcgcccatttggccaaatcggtaaccgaactgaccacggcgccatcgccaccggtgtaatcgccgcggcctaaagccactggttggccgttggtaaaatctagatcgtcgtaactatttgcctcggcggcctgggttccgaaacgggtttgggtcattcccaacggctggaaaaagtgccgttcgatgaaatcgcccagcggcatattcgcgacttgggcaatgatgtggccaagtaggaaataattactatttgaataaacccctttttcatccggcgcaaaatctagcggatggcggttcaataagtcaaggacttgttgaagggcattaccctgaaccagatcttccagtatcgggtagcttaaatgggattcactggcgttcggcatctttttggtgtattcggctaacaacaattcagtgtagtcaggaatgccgcttgccatgtgcagcatctggcgcaaggtgatctgcttggcgtaccgatattctggcagatagtccgacaacggcgcatcaatgttcagcgccccatccgcatccaacagcaacatgctgtcggccgtaaattgcttgcttaacgatcctaaaccgctagtagtgtggatcgtgaatggttcttgtttcgcaaaatccgccatgccgttttgccagtgggacaactgatgattggcatccactaacatggtggcaccattgagatgatatttttcattgatagcttgatagccgttccaatctgtcacgaaaaggcctccttttagccgaaaaaacgttgaggcaacgatagcatgcatcgcactgcttttcaaactaaaatatcatcattggccaatgagaatctaattgggggctttacttgccataccggttgcatcctcttgcctggactgcgatgacggccttaatcactgaaggaggaaacacagatggctgcgatttatgataatccggattttttcaaggcatatagccaaatggatcgctcgaaaaagggcttagccggggcgggggagtggcatgagttgaagacggttttaccggactttaccggtaaacgggtgcttgatctcgggtgcggttatggttggcactgtcgctatgccgctgatcatggcgctaaaagtgtgcttggcatcgatacgtcagccaaaatgcttgccaaggcttctgagatgacggacgacaagcggatcacgtatcgccagctggacatgcaggccatcgaccaattgccggggcagtttgaagtcattttaagctcgctagccattcattacattgccgattacgctgagcttgtcggtaagatcagcaacaaactgccaattggcgggcaatttgtcatgtccgtggaacatccgatttttacggcccaaggcaatgaggagtgggtcacggacgagcagggccacaacctgtactggccggttgatcgttattttgacgagagcaaacgggaaaccgactttttaggccatcgaatcaaaaaataccatcggacgttgacgacctatttgaataccttgctcgacaaccatctgcgactggatcgcgtgattgagccgaccccgactgctgaaatggtcaaaaccattcccggtatggcagatgagttgcgccggccgatgatgctgattgtggcaacgaccaaaacggcgtgagcaatcgtgcctgtctattgtcgccaaccctttcacggcgtatactcatgaaatcaaaactaaaatgaatagaaggaaatcgctcgtgaaactaagaattggtattcccacagacgaactgatcgaagtcaatcccgtgatgccgaataatcatcctgcctatgtgccccatgatgtcaaagaggcgtttattcaccttggtgcgctcccgctcgttttgccgtttcctgatgatgtcagtcagaccgaacagctggcgcaagatgatatggccttggtcgacggcctgatgctgccaggcggcccggatgtggatccgacgctctatggcgaggaaccgcatcccaagatcggcatgacgctgtaccaaaaagatttgttcgaaattgccttgattaaggcagccctagccgcaaacaagccgatttttggtatttgccgcgggatccaaatcatgaacgttgccatggacggcacgttgtatcaggatcttgaacagcaatatcctgatttgaaaattcaacatccccaagccacattgggtcagtttgcgacccatcatgccgaattaacgcctggtagtcgcttggctgatttgtacggtaaggagaccattaaagtcaactcccgccatcaccaagcagttaaaactgtcggcaaggggttgaaggtgacagcagttgcgccggatggagtggtcgaaggaatggagtccacggacaacgatctgttcttaggtgtccagtggcatccggaaaatatgtggcagcaggaagatcctcagcagctcgttgttttccaggactttttgaaacgggttgcagatcatcagaagtagttttgtgcggtttaaagaatcgcgcgaaagccggtatcatgcttgtgcttgtcatgatcagacgaagaagcacaggctagtggtgtctatgttatttcgtggtttgatgcaacaaattcgattggtggttatcactacacaatgtataagattgcatcgtattgacggtgtgcgttgcgcacgtcccccttgccccaaacagcaaagaccaattctaaatgcaccaaagaagccatacgattattgcgtatggcttctttggtgaatttctttcaacttgaatatcgctaggttgcttggcttcggtcaaaagcccttcatgatgttaaggtagatgactttgccatgagatagccttcactcaggttgttttatgattcactgttttgcagaacggtatataacttttccaaatctctaattgacataaagttggataagtctaacgaaccattggatttgacaataaccctttcagaaagaatgcctcgcaacatgtcatctagagtatgttgtgaaaacattttttcttgttggaaattctgcaggcgaatcagaagttcatttagtttctttttccttttgtaaatatataaaaagttgattaaagggcctatagccaaaaatgctacgatgattaacactataatcaagttattcatatctcggaaaaagctcctatttaagtcaaattagtgaacgtaattggtgctcatgcacattgataagcttgttgctccaccaaatgcggctccgaacgctgtgaaacttgctgaaccgattagcacgcccccaattaaattcgggatacattctctgaacttcttgccgccggtgacttgctgcagttgagagttcgagagatcaatcacactagggtttgaaaggttatctagccgagacatttaatagcacccccaaccattccaaggttcgcaccgataacagccccgccgatcgttccgattccgggaatcgctgacccaccccaagcgccagaagctgcgcccttggctaatccaaagagaaaaccgggtatgcaatttttcccttttccaccggcaatgacggctagagattgatcatttaggttttcgtaagcgttgagcgataaatccatataaatacctcttttcttgtatttgagagttttagttgcctacgttgtgaattataagtgctaaacaagctttgcgtaagtgacaattcgtcaccttgtaagatcatctaaattcacatccagtatttctgcaagatcaataaacacagcagtattaggcaaacgagagccggactcgtagtgggtaattgcggtacggtcaattttgagtcgctctgcgagttctgcttgtgtcattttccgctttatacgatacttttttagattgtgcggaatacgctcaatcccgccacccttaattaatagcaacgccaattcattaagcgagttactattgagccaagtttcgccagttttcctcaaaaaactttctttgcgtttggaagtcaaaaacattttgttttttagttgtcttttgttcaaataaatttcctcttcgacggttaggcgataagcagtggtgtagttgattttaaaattccagtaaaacaacgagttgtacaaggctgtggtcaaaaagtcttctgaagaatcttcagacgtggttgatagcgtcaaaatcggatgggtactcgattcaaatttagtaaatcataaattggcttttatgaccagcacgacaaaaactaggattagtggcacccaactccaaaaacagttttcagaaaatcttttcttttagctagaatcatgtaagattgaagccgagtagcattgacgaaacggttgttgtttaatgaagctatctggtgcgaggtaagggcaccataacgcgttcaccggcgcagaaacctacatgtaaggaccttggtcgcaatggcctaaaccctggctatcacgcccaaggccgcttacacttcggtttctaaccgcgccggttcacgctcaaacaaggaggaaccggaatggacgatgaagccgttattgagcagctcacggagaagcagaccgagctgattgagtttttgtatgtggactataacggactgacgcggggaaaggtgattccgctggctagcctgaaagccaagctggctgacgggatcggcttgaccaaagcaacgctaaatgtcagtgagcgcgacaccattttgccggtcgccgacatgacaccgattggggaattgcggttgatcggggacgctgcttcggcgcatgtgttgccttatatgccacaagtggcaaccttgatgggcgatatttataatcttgataaaaccccttatgcttccgatccgcgcaccattttaaaacgggtggtcaagcagttggctgacgcaggcttcaccgtgaaaatggcttatgaaaacgagttcgaattgttcactggggataaggatcatcgcgaaccggccatgccgcgagttgccttttcaacggagtccatggattttgcttatccgttcattcttaaaacgatcaatcaactgcagcaggtcgggattatgccgaatgcctattatccggaaggcggcattggccagcatgaattgagcatgttgccgcaggatccagtgaccgcggcagacaatgaagtgatttacaaacggatcattaaaaacaccgccaaagattttgatttgtatgcctcttttgcgccgaagccccttgtcgattcggctggctccggcgcgcatattcatttatcgttgtggcgcggacaagaagatgcctttttcgatgcggacgcgccgatgcagctgtccaagaccggtcagtattttgtcggtggcgtattgaaacatattcaaggcttgctggcgctgacctgtccatcggctaattcctatcagcggctggctccggggcattggagcagcgcttatgcgacctatggcaaggacaatcgcgaggcggcggtgcggattccgtcgacggcgtggggcgatccggctagttcgatgaacattgagctgaaagcgagcgatgcgacggcaaatccgtatttggcatttgccggcttgctggcggcggggctggatggcattcagcaccagacgcaaccgggtgattattgtgatgtggatccggcaacgttaagcgaagcccaacgcaatgagatggggattcaccgtctgccgcagtcattgaaccaggcggtcgacgcgttcgtgactgattcgcttttccacgacgtgttcgggccgcaactgatcgatgcttacgccaaaatcaagcgtgaagacgatcaatattattcgaagttagcattagagaaaattgcggcattgcaccgcgagctatattgaattgcaagttgaagaactaatttcggccatcatcatgaatggtgaccgctgtgcatgaggaggaaacattttggacgacctaacggagtttgtcgaccaagtcccattgttggaccatcactgtcatttcttaattaacgggaaagtgccgaatcgcgacgaacggttggcgcaggtgtcgacagaggcggacaatgattatccgctcgccgacaccaaaaaccgcttggcctatcacggctttttagctgtagccaagcaatttgccctcgatgccaagcacccgctggcggcgatgaatgatccgggttatgccacttataatcagcgcattttcggccactatcgctttaaaaaattgctgattgataccggatttgtgccggatgacgcgattctcgacttagatgaaactgctaagctaaccggtgtgccggtgaaggcaatttatcgtctagaaacgcatgctgaaacgttcatgctgaaatcagacaattttgcggcttggtggcaggcttttagtcaggacattcaacaggcgaaggcacatggctatgtcggcttcaaatcaattgcggcttaccgcgtggggttgcacattgaaccggttaatctcatggaagcggctgccgggtttgatacctggaagaactccggggtcaaacggttaacgtccaagccactcatcgattacatcctgtaccatgcagcgccgttgatcatggcgcaggatctgccgctgcaatttcacgttggctatggcgacgcggacacggatatgtatctgggtaatccgttactgatgcgtgatttcctgaatgcctttgccaaaaagggactcaaagtggttttactgcattgctatccatatcatcgcgaagccggctatttagctagcgtctttccgaacgtctattttgacatttcgttgctggacaatctcggccccagcggcgtacagcgggtttttgatgaagcggtcgaactggcgccgtacacacggttgctgtttgcctccgatgccagcacgtatccggaaatgtatgggttagcggcgcaacaattcaaacaggcactgatcgggcattttgcctccctgccatttgtcgatctggcgcagaaaaaagcttggatcaacgcgatttgctggcagacagcggccaagctttaccaccaagaagaggagtttgtgaattagttatggaaaaacgcaaaaaattaaccttgcttgaggtcttcggactctcaattgcgatggtggcgccaaccggggcgatgtcgtttaacacggcaagtgccgccgccaatgccggcatcaacatgccaatcgcttttttgcttggcggcatcggcgtcttgtttgtggcgatttcgttcgcggaactgggcaagcggattcccggcgatggctcggcttatgcgtataatgccaaagcacttggcgaaaaggccggcttcatttccggctggttattggtgttgacgtacgtgacgtttgtgtttagttccggcgccattgtcggcaactttgccaatgtctttctcagtcatttaggcgtacatctaccggtgaatctctacaacattttggttttgttgcttggcggctggctgagtcataaaggcattgaattttcgacgcgcttgacgctggtccttgaattgctggcggtattggttttgagtgtgctgacggttgtgattattttttccggcggtcgcagtggtaactcggtgcagccgttgattccgcaaccgcatatggcgaccggtttggggatgggcatggtgtttgcgctgatgtcctttgccggatttgaaggctcggcaacgattgcgccgcgcgccacgaatccgcgtaaagcgattagtattgccttgctgggggccgtgagctttgcggcgattttctattttcttgtcagttacgctgaagtgattggcttcggctccgcgcacattggcgatcttgcaaaaagtacggcacccatgaacttcctggcgacccattatctggggaccaatgccgccatcttcatggacttcgcggcgatggtcagctattttgcctgctatttcggagcgcttaatgccggcgcgttcatgttggaggcgttaggtaaaagcggttatctgcatccgtggctggcggtagaaagcggagacaagcagacgccgacgcatgcgcttgacagcattaccggactcgcgttgattgtgtatgttattttcgcgatcggtttgggtgtgagtgccagcgatatgtataactggtttggcacgatcgggatgctagggctgctgacggtttacgtgttggtgaatattggcgcgatcgtttacttccgcaaagacaaaggccggtcgatgttcaaacatgtgttggcgccggtgatcgggattctcgtactcatttatccgatttacacgagtctctggccgattccggcatttccaatgaacacgtttccttacatcgccatcgtctggttcctgattgggctatgggtcgcgactaagcggcgaaaagttgaaacgcggttggaagatttttgatttgtttggaattttgacgaaaaaagtgcgcttgacatgttgagatgtcagcgcattttttaatctcgctgttcttgctcagttgccacagctttaacatgagcagtgccggttttgacgtacttttcagtaccgtctgcaacggcttggcgataatagtgttgcttgtattcaatcgtgttcagcgtttgttccagttgcttcatctggttttcgaccgcggtgtggagctgattaaagaagtccagccgcttggtgagggtggcgtcgccttcgagattccactgcataaacgtgcggatatccttaatcgacatacccgccgttttaaggcaattgatcatttccagtgcgccaagattctggtcggtaaaacaccgcacacctgcttgatctttttgcaggtcagggatgagtccttccttatcatagtaacgaatagtcggaacggacagatgggtgatcgcggcaacttcgccgatggtgtatgaaactgacatgacagcctccattattgtttgtgcggcagcgcacatgttgcaaaaagaattgacttgccctaaagtcgactttaggggataaagtgagtgtagcacgtaagccgacagatgcaaaattgcgttcatcggtgttttttacgcccttatcggcgaaaaaaatgccgttatggcttgttcagcaatcttttaaaaggagcgaggctatcttgttagaagagacatatacgttaacgaatggggtcaaaattcccaaaatcggctttggcacctggatgattgattcggatgatgcagcggcaaaggccgttcatgaagcaattgatgtcgggtaccgtcacattgatacggcagaagcttacgacaatgaggccggggttggcgaaggtgtgcgggcatccggtgtggcgcgtgaaaatattttcgtcaacaccaagctcgcggccgagatcaaggaccacgacacggccgtcaaagctatcgacggctcgcttgagaagcttgatctggaatatgcggacatgatgatcatccatgcaccgaagccatgggccaaatatgatgaaccggagcggtacttcgaggggaatctggaagcctggcgggcattggaagaagcctataaagccggcaaattgcgcgccatcggagtttctaattttgatcccaccgatctcaagaacctactggatcatgctgaaattgccccaatggttgatcaggttttagcgcacattacccagacaccgttcaaaacgattgactttgcgcaagagcatcagatattggtcgaggcttattcaccgtttggccatggcgagatgttcaagaataaggacatccagaaaatggcagctaagtatcaagtctccgttgcgcagttgggcatgcgctatctgctgcagctgggcttactgccgctgccaaaaaccgttaaccctgaccacatgaaggctaatgcggaggttgattttaccatcagcgacgatgatatggcgatgctgaagcagatgaagccgctaaccaactatggcaaatatcagtcattcccagtttacagtgatcgattgagctaagcccacggaccggcaacaacgaccttgccaatcatgtgaccggattcgaccagtgcatgcgccttcctcaagttggcagcattcaacggctgtagtgtcttagttaaggtgcattgaatcgtgccgtcattgagtaagctggcaactttgtcgagaatgatcccttgggaagcgagatcataaccataccaagacttcgaaaacatccactcccaggcaaacgtggcccgctttttggtcaacttttgtaagtcaataccgcgccgattttccgtaatggcggcaacccacccgtcaggacgaatcatggtggcgatttcgttccaatgttcgtctagatgcgagaggttaaggatgtagtcaacatttttgaagccggctgcttttaactgtggcggtaatggctgacggtgattcaaaacgtgatcggcgccatgttctagtacccatttttgtgactccgggcgcgaggcagtggcgagtacctgcaggccagcgaggtcggcaagttgcgtcgccattgagccaaccccgcctgagccgttaatgatcaaaatgctacgcttccgatttgcctctttgtggtcaaatgggatgtgtagtttttcgaacaacgcttcccatgcggtgagactggtcaatggcatggcggcagcttgggcatcggtgagcttagccggagcgtgaccgacaatccgctcgtcaatcaattgatattcggcgtcactgccggaacgtttgtagctgccagcatagaatacccgatcgcctacgtggaaccgggtaacgtcatggcccacagcggtcacaatccccacggcatcccaaccaatgatcttcggctgggcaaggcgtgcatgacctgcgccacgcgttccggtatcgaccggattcaccgaaactgcccggacattcactaataagtcgtggccttcaggtgttggtgtcggtaacgtcaaatcttctaaactatttttctgttcaatcggtaaatgctgcgtaaatccaatggctttcatcaaaatggcttcctttcgtttgctttcttaacctttcaccttgtatgttagccagcatgcactaacatagtaagtgagcaaattgtaagtaacttgtaggaaagcaacgagggggccttgtgatggatcgtgaactttataattgtgctgcaggatgcccggttcaaaatacagttgatctgatttcgggaaaatggaagagtgtgattctctatcatctttttaaaggagatgccacccgcttcagcacgctgaacaaggccattccttcagtgacccagcgcatgttggcgttacaattggcgcaacttgaaggtgatgggattatttacaagaaagtcggcgatgaagatggtcgcgccacggaatatggcttaaccaagttaggccaaacattggcgccggtgatcgacgccatggcagcctggggtaagttttatcagacgcagcagcctgcgctggcatgaacggtgacgatatattttcttttattcatcaaccagttaagcaaaaaggcatcgtcgaaaattcggcgatgcctttttggatcttttgcattaaagataagcctgataaaacaagacaaccgcaagcccgattgcgaagatcccaaccgccgttttgatcacgtgcgatggaatcaagcggacaatcattggaccgagaaagccgcctgcgaacaagccgatgcagaccggaattagaacccaccaggcaatcggcatcgagaagatgaacatgattgacgtgaccgtgttgttcacaagcgatgcgaggttacgcatggcgttgtaagttgcatacgggccggcgacgatgcgcgagagcaccgcgatcatcaacagtccggcaccggcgccaaaataaccgatatataacccaacaagcataatcagcgcataaccgaatccttgtgcaagtttgcgatgggtagcctgatcgggatcttttttcggcgtcaggatcatgaccccggccaggaaaataataaacggaacgactcttttgaagctggcattggaactgtgaattaagataagcgctcctaaaacgccgccaagggcattaagtaatgtgatgagtagcgcttggtgccagtggccttttaattcccgccgcgatgaaaggaccgacgaagatccgctaaacaaaagaccgattgtgttggttgcattggccgtaatcggggaaatcccgaccgacagcagcatcgggtaaagcgtgagtgccgccattcccaccgtgccattgaggatgccggcaatcaggctcataccgagtaaatacaagattgtttcgagcgtcataagctcgcctcatttgatttgtttttcggggtaaatctgttttcttttagtattttacacccaatatcatcttatcaagcttagcatttgcggatactgttgtcgcttttgaacgttgtgaatctgcagactgattggttttcttttgtcggtgaaaacagttatttatcggctagtgtcaggagtcttgtcaatggtatggctgaaaataatttgctatactcaagaaaaaattcgggtgatactggaggtggcgacgtgaaaaagcttgaaattgcccatttggataaggcctttgatcagcaggttttatttaaagacgccaattatacgtttcaacaaggtaagatctatggcttgctggggcgcaatggttctggtaagtcgacgttgttcaacatgattgtccgtaacctgccgattgatagcggcacgattgcggttgattcggatgatggccaagggctgatcacaaattactcggatacggcagttggtatggtctacacccagccacatttgccggcattcatgaccggcgttgaattcgttgactactttatcgcgattaaccgcgaacggctggaacggatgcatacaacggtcaaagcggcggacttttttgatatggctgggctgggtaaggcagataccaataagttgttgcgcgactattcggaggggatgcgcaataagctgcaaattgtggtgtcgttgatgctgaagccgccggtgctgttactcgacgaaccgctgacaaccgtcgatgtggtggcggcgcatgagatgcagcaaatgatcgttgcgatgaaggccgactcggtagttgtcttttccacgcacattatgcagctggcgcaggccatctgtgacgcggtggtgctgttgcatcagcagcaactcactgaattgacgggactggatattcacagtcaggcatttgaagacgccgtgattgcgcgattaagtgacgaggtgcaggcagatgcgtgatgcatggcgatattactggtttcaagcgcaaaccgatgcgactaccggggtgaatgggatcatttactttctacggcggatcccgtttttaggaaaaaagattccgactaagtggtatcgaaccggggctttgaaaagtcttttggccattttgttaaatttcatgatgctgctgaccaagccggtgataaccctcttgatgatgggcttggcgttcctggtcggcaatgcttacaacgatttcattcatccgctcccatccgacttcaccttgcgaatcatggttgccgcggtggtttattcgctgggatgtctcatgcttcgtggactgatttttcgatatgcagcgattaatatcaaaacgattaagcttggcgagtacttttcgttggatcgggttgcgttagttcggggtactttgttgatcaatcagatcattgtggttgtgattggcccgtttctgccgctttttattctggcacttatcacccgtaatctatggttgttgctggttgggctggaaatggccatctttagttggcattggcaggcgtttctgccgcgcttggcgtggtcacaccggcaactgggcttaatggcacagatcatttactgggtgagcctgtggggtgtggttgccggcgtgatgataaccggccaactcgcggcatttgttaacggtgttttctcacctttaggattcattatcggcttgttcgctttgctggcgatggcatggtatattcaccgcttttctgatgatattccgtttttgatggcatccattcagcaggcgaccattactttgaacatggtaacgtcttcccgggatcagcagtttttggccgctggtaaggcgatgcagaaaaagttgacgctggacaccaaagtaacggtcaagccaaccagccgatccggtagtaactatctgaatgccttattatttgtccgttatcgccagcaattatggaaaaagttgcggacgcggctgttatggattggcagcattggcgttggaattttagtactcatcaaacttttcgccgttcattcggtcggcgatttgacgtcgatttatggtggcttgttcttcgcaatgtacctgtcatcactcggcgccccgatcgttcaactcttatttgttaactgcgactcggccatgttgtactatccgttttatcggcaaccgaaaaccattttggccgggttcttctacagattctggcggattgtccggtacaacgcagtcacaggcgggctgatttttctgtttatttttgcgctgcaattcgtttcatcggtaccggatgcggtgaacttttatttggtgttactgctggaagtttgcggcatggtgctgttcttttcttttcacgacttgtttatctactatttaatccagccgtttacggacgacatgtcggtcgtttcaccgctgtatcggttcttgtactgggggatgtactgggtggcgtgggttttcacccaagtgcaattttccggctatgcatatgccattttgattggtgtggtgacgctgatttatgtggcaatcggcaccgcggtgatttatcgggtggcgccgaagactttccggattcggtattgaggtttatcttgtggtggcaaatggtggcgtgttgctagtgggagtgaagctttcgacaaaatccgctgaaaaataataaaaaggccaaccacttcattcggaaaaaggtggttggccttaatagtagtttgggctgaccgttcgtgcaattccaaatttctggtatacggtacattggaatttagaaaagcaccacgatcttgagaaatagaaggattgcaaagatgaacgctgctagcatcacgactaaaaaaatgagtgaggccggtcttttgacttttagtttgaaataatcataaaccaaatagctcaaaaagctgatcggcacaacggtagaagaaaacacggtgaggggcagaggcaaaccagaaaacaatgaatccagcgtgaagtatccggcgatccaaaaagttaaaaaagtaaggaagtgcttgtaacgttttttaaagacgtcctcgttattcatttgaatcaccccgctgttttaaatcctacatgtcagcaatgttgcgatacggtcggatttatcatagcttgacgattttaagaaacacaagtagtaccaaaaggagacccagtaccgcaaagatcaaaaggctcagttttgctggtcgtttgacttttagtttgaaatattcgtagatcaaatatcccataatgaataatgggatgattaccacgacaattatattgaggattagtggtttatcggtgagttcaaacccgtttaagagtaaatatccggtgttccaaaaaatataaaatcttaaatcgcgtttgtagcgcttttggaatacgtcatcgttattcatttgaatcaccccgcgaaagtaggtgcttgtcaaaggttgttaggcgaaaagttgcttatacgatcgctttgtattcggttacattatagagccgatattgttatttggtcaacaattggttttgtgacttcaattcccatcaggacaagaaaactacaagtttcaaaataagaggtatatgttatctacgagctggaaatctcgttattttaaattggctcattgtggtcgcattcaaactgataggtgacgtcctgttcaatgaaaaacgatgcgctaaaacggtgacatgtaccacaggctttggttaaaccggacttttcactgattagattcctacacttggcgtataatgagcgtaatctaacaatttgaggaggaaagtcatgagcgaagcagcacatttctatgaaacttttcaaccgtcgcattatgatctctatttggatattaaccgggaggccaagaccattagcggcaagacttcgattatcggtgaagcgaagcagccgaacattgcggtccatcaaaagtatttgaaggttgaatccgttgaggcgaacaaccaagcagtcccgtttacaaccgatgatcctgccgaggccgtgcggatcacgttgccaaaagcaggcgatgtgaagttgacgattacctacacggcgccgttgacggataccatgatgggcatttacccgtcttactacgaagtggacggcgtcaagaagcaaatcatcgggacccagtttgaaaccacggcggcgcggcaggcttttccgagtgttgatgaacctgaagccaaagcaacatttgatttggcgattaagtttgatgaacgtccgggcgagacggtgattagtaatatgccggaagtgcgtgaaatcaatggcgttcattattttgataccacggtgcggatgtcgacctatctgattgcgtttgcgtttggcgagttgcaaagtaagcagaccacgacgaagagcggcgttaaaatcggcgtttttgccacgaaagcgcacaagcctaacgaactggactttgcgttagatattgccaagcgttcgattgaattttacgaagacttttaccagacgccttatccgttaccgcactcttggcagctggcattgccggacttttctgccggtgccatggagaactggggcctggtgacgtatcgggaagcgctgctgacgatcgatccggacaacacgtcgctggagaccaaagagcgcgttgccacggtcattgctcatgagttagcgcatcaatggttcggtgaccttgtaaccatgaagtggtgggacgatctctggttgaacgaaagcttcgccaacatgatggaatatgttgcagtggacgcgttgcaaccggattggcacatctgggaagctttccaaacgctggaagtcccgatggcgttgcagcgtgatgccacggatggtgtgcagtcggttcatgtgcaggttgaagatccggctgaaatcgattcgcttttcgacagcgcgattgtttacgcaaaaggggcacggatgctggtgatggttcgtgcgttaattggcgacgatgccttgcgcgccggtttgaaggcttactttgaagcccacaagtttggtaatgccgcgggcgccgatttgtgggcagcattgggtcaggcttcccatcttgacgttggtaaaatcatgcagtcgtggctggaacagccgggttatccggttgtaactgccgcggtggtggatggcaagctgaccctgtcgcaacaacagttcttcatcggtgcaggcaaagacgtcggccgtcaatggcagattccgttgaacagtaactatgcagtcgcaccacagatttttgctgataagcaagcgacattgggcgactatgcacagttgcgtcaagatagcggcgagccattccgggttaacgtaggcaacaactcccatttcatcgtgcaatatgatcaaacgctgttaactgatattctggatcaccttgaccagctgaatgcgattgatcagcgtcagatcctgcaagatttgcggctgttggcagaaggacggcaaaattcatacgctaatattgtgccgttgttaccgcgttttgccgaaagtcacagcgcgattgtcatcaatgccttgtatcgggttgccaatgatttgaagcaatttgtgacacctgattcctcagatgaagcccagctgaaagcattcttcgatcagctcagcgcaggccaatttaagcgtctcggctggttgcctaagccaaacgaaaccaatgatgatcagttgacgcggccatatgtgctaagcatggcactttatgctaaaaacgctacggctattgcgcaaggtcacgaccttttcacggctaacaaggataaattgttgcagttgccagcagacgtgcggatgtttgtgctgcaaaacgaagtgaaaaactttggcagcgccgccttgttcgatcagttgttgacggcctacaagcagaccacggattcaagttataaggcagacattctcgctgccttaaccagtacgccggataaggccttgatcgggaaaattgttgatcagttcgaaaatgccgatacaatcaagcctcaggatttacgctcatggttccgcggcgtattgaacaaccatgtcggcgaacaagctgcatgggactggattcgcaaagaatggtcatggctggaaaagacggtcggcggcgacatggaatttaccacctatatcaccgtaattgccggcatcttccgaaccgcaaaccggcttgacgaattcaaagcattcttcgagcctaaactaccgacgccagggttaactcgtgaaatcacgatggacaccagcgtcatcgccagccgggttgatttgattcaggccgagcaacaagcagttaatggggcggttgctaaggcggttaagtgaatttaattcgcgaatgatgactggaaacaactatacacaggataacgttacaattcgctgtttcagtcatagagacaagtatatttccaagaggtttttggaggtgtgcttgtttttttgtttccgtaaaagtgacttggtagggcgtttaagatagtagtgccaaagcggagcaatcgtaggccagagggggctcagtggtgaaatagactaacttagttgatagatattgatcaggccagatcaatatctatcacttttttgttagagtgagcgtgaagccaacgccgtagattacaacttggcatttaatgccgtgggtgaaattggcgggcttcattgatcct

SEQ ID NO: 298 - DNA, 40654 bp, Lactobacillus casei
catggcgttatcgatacgccacaagaaaaccgcaagaacactgaaaaacctaatgaatgagacttgacttctggtagaaaattgtactagtcgggcggtcttcccggcgtagtacaaggccgatctttgagactctgcgggttttgcagaggctcaaagtcgcgcccaccacgttccagccccctctggccggagattgcggagtttggcacggcaagaagcgtatagactaaattttttatacgctttggagccagtccatggcgaaaaagcaactgcctttttagaaaaatctaatccatatctatacattttcacgggaaataggggctgctaaaccggtacactggagaacaaattcctgtttttccaaaggcgggatttgtttggagggatattcgtggcagacactaagaaacaactgcgctggtataacgtggctttgattgcgttcgtctcggtctggggcctgggcaatgtgtttaacaactatgcacaacaaggcctgtccgttgtgaccagctggattctgattatgctgatttacttcgtgccatatgccttgatcgtcggccagcttggttcaacctttaaggatcaggcgggcggcgttagttcctggattaaggaaaccggcagtgtgcggctggcttattacgctgcatggacctactgggtggtgcatattccgtacctggcccagaagccgcaagcgattttgattgcgctcagctggcttttcaaaggcaatggtaactttgtcaacaccgtatcgtcgatgaccgtgtcgttgatctgtcttgcgctgttcttacttttcttatggctgtcatcacgcggcctgacgaccctgaatcgtatcggtagcatggccggcaccgcgatgttcttgatgtcgatcctgttcatcatcttggcggtcacagcacctttgatggtcaaaggcgtccatgtggccacgccggacatgggcgatttgcacacttacttaccgaaatttgatttaaattacttcaccacgatttccatgctggtctttgcggttggcggggcggaaaaaatttcgccatacgtcaacaacaccaaacatgcttccaaagaatttccgttggggatgttggtccttgccggcatggttgcgttctgtgccttgctgggatcttttggcatgggcatgttgtttaacagtcaccatattccaaccgatctcatgtctaatggcccatacactgcgtttgcgatgcttggcaactattaccacctgggtaatatctttgtcattctctacgccatcgccaatgcgcttgcttcgatttcagctttggccttctcaattgatgccccactgaaaatcctgctgagtgacgccgatccgcattttattcctaaaaaactacggcggatcaacaaaaaaggcacgccgattaacggttactggatgaccgggattctggtcagcattctgattattgtgccggcgttgggtatcggcaacatgaatgagttatacaaatggctgctgaacctgaactcggtcgtgatgccactacgttatctctgggtcttcttggcgtattacctgcttaatcgccatcttgagaagttccaagcagactacatgttagtgaaaaacaaacacgcgggcatgctcattggcggctggtgtttcttcttcaccgcatttgcctgcttactggggatgctgccgaaaatcagctatctaagcgatcccggcacatggtggttccaaatgggcctcaatgtgattacgccggtggtgctcttggcattgggactcgttttgccaatgttggcccggcgcaacgagttaaccacggaataaactgcgatatgaaaaaggatctgctaccgaagagggtggcagatccttttttgacctaaagatgatgttcgcgaatcgcggtcaacattttcttttcagggtaaaagtgaatgagcagcagcaagatgccgtaaagcaacaggggcagccagacataattcaaatcaatcatgccaagggttgcggcattttggctggtgtttggaacataaccggtgaggtcgaacaagccagcggtgacgaggccgccgatgccgagaccgaggttgacaccaaagtcgttgcttgaggcgaagaagccttcagcttgggcgccgagggtgataccgtagcgaatggtgtcggctaacataatggaaaccaagccgacgatcatgccttgaccgatgctgttgaccagaatgccgaaaaatagcaaccacagctggcgcaggtacacgcccccggcaatgactaattgtccggccaagccaatcagcatccccaggcgcatcgtgtgcttgttcccataatgtccggcaatgctaataatcagtaagacgccgatcaatgatgaaaacgtaaaactattggcccaggaaaccagattctgattgtgcaacgtgtatttgaaatagtaaaccgtcgtctggttcttgatcgccgtcagcagccagtacgtgaaaatgacgcctgacagaatcagccacggcttgttacgaaccgcgattttggcaaccacgcgaaaaggttgatgggcgatttttttctgggtaaagcgctcacgaatatgcacaaaggtgttgagaattaatagtaatgaaatgccggcaaacaaagccatggttaaaagaaagccgtgctgatcattgccgcggccgaaaaatgccactagcggtaaggtgaacacggctacaataatctgaacggaactgccgaagaactggcggataaccccgagcaaagtcagctcctgttgattttgggttagcgtcggcagaaccgaggtgattggcaggttaactgcggtgtagaggaatcccaagaggaggtacgtcgcatacgcccaaagcagcttaccattagccgaccagtttggggtgacgaaggtgagcaccgcaaaaacggcataaggcagtgcgtaccaaaggaagaacggccggcttttaccaaagcgcgagtgggtgtggtcgatcatcaaaccgaccaccggactttcgaaaacatcggcaacgcgggcgatcaggaacagcaaggcgaccgcgccggcactcaatccgtaaatgtccgtgtagaaatacagtagataggttgtcatcacctgaaagaccagattatcagccgcgtcgctcaggccgtaactgatgcgttcaggccactttgtttgttgtgcagtcggctttttttgcatccgcaaaccttctttcgtggataactgacacgaaacatgtacgactgcattcttcggatattagcagtcgcttttaatcatgcttttcccgcaacatatcactgatcacgatttggttaaccgtattccaaaccatgtgcccaacagcttcggacaaatgttcttccgccggttgatctttagcaggcggtacgattttcagcgcaggcatcgcccaaagatgagcaccggcccacacgccaagtccccacatgctgccataacccaatttaaacaacggaacataatgaccggcaacagcataaagcgcaccgaggcttgacgaaaagccaaagtgaaccaaaagactaacccaaggaatctgatggccggaataagtgtaagtggcgtgggtttccgccggggtgaggccgtgctgctgcaaaaattgttgcggcggattggtggcatcacgttccggtgttcgcggcggtaaaatattttcccaacccaacttgacaagccctgatactaagcccgcaacggccccaaccgccgccagctttaagacagatgactgagtttgtgtacgcatataagcgacctccctagatgaatgcgtcgagaactttaacacttctattttaaaacagcagtacagttttggcatgtgtagataacaaattgtaagtgtttattgccagatgggtaaggagcccattgctattgggcaatggtagcttgaccagcagctattattgatgaatgtcggcgtgatgcgcgtgaacaaaatcaataaagtcagtcgcagcaggggactgataatggtcttttaaagtagccatgtagaatatccgctgccaagtaggaaaactaagcggaatgattttgactggcagggttttaaggattggcatattaggcaccagcgcaatgccaaacccgttggcgaccagaccagccactgcttcgtcttcttcaatcgcatacacgctgtgaggctggccgccacattcggcaaaaagttggcgaataatcggtgccagaccgcttcttttcgagaaagtaacctggtcgaaggcgagcgtttcactgagctcaatgcgctgacgagtcgctaaaggatgatccagtggcgtgatgacaacgagttcttgcgatgcaatcggaaagtaagcaatatcctcttgttcgtcaacctttgagcaaaagcaaatatcataatttttagaccgcaatccttgaataatctgtggcgataaaccattttcgttcgtgaattcaaagcggacgtcatcgtgactttgttgtagaaaactgcgaacaatgccgggaacccagcgtgtgcttagggtgcgtaaggcagctaacttaatgaccgtttgctccgtgttttgatgctgcagctgttcaatgccgctgtcaagaatggtaagcgaatgctcaacgatccgcctgaactcacggccttcaggggttaagacaatattgcgcccttgccggacaaacaaagcaaggccaagctcatcttcgagcctgtgaatggcgttgctaagactgggctgggtaatgtttaattggcgcgctgcctgggtgtaattctgtaacttagccagtgtgacgaaatagcgcaagtgaaaaaggttcatgatttgcctccagagtgtctacaaagcgaacaatagcttccagctatagacgcccccattataatgaattagaagtcgcttgtgcaaccgcatacaatttaatttgtaaacaagattgaaaaaataatcacaaacgattttgggaggcattatcatgacacttgcacatccgattacagtcagctcatggacattaggcgaccaatgcacttttgaagatcgcgtcaaagctgccgcaaatgcaggctacgacgggatcggcttacgggctgagacttacgttgacgcgttgaatgaaggcttaaccgatcaggatattctcgacattttagaccgctatcacatcaagtgcacagaggtggaatacatcgttcaatggtgtgaagaaccgcggtcttatgaacaaaaatataaagaacaaacgtgtttccacatgtgccacttgtttggcgttgaacatatcaataccggtttgatggaaagttatccggttgattttacagcgaagaaacttcaacagttggctcatcgcgcggcactcgctggcgaccttatcattgcacttgagccgatgccatatagtggcatgcctgatttaaagaagacttgggccatccttcaaggggccggggcgccaaatatcatgatgcttctggacatgtggcactgggtacgggccgatcagccatttgatctgctaaccaaggaacaggccaaacgtgtcatctcgattcagcttgatgatgcttacaaacgtccgtatgccaagagcattttacgcgacgagtcgatgcatgaccgcctcgccccgggaactgggtttgaagaccgcacggaaaaattcatcaaaatgatcaaagatgctggcgtggatccaaaggtgatcggcgttgaagttatctctgatcagtacatggccaaagggatcgactgggttgctaagtatacgtacgacaataccgttaaaactttgcaagcagtttggccggagattttaaaaccagctgtggccactcattagaactggtaggttaactactcggaatgaaagatcgtaagttttaaagcccaatgcagaggcgtttcggttctggttggtttcacagcgttaaggaggaaatttttcatggcagattggctaggtttaaaagataaagttgtggtcgtgaccggtgcagttggcggcatgggcacccgtttttgcgaggcatttgccgaacacggtgccaatgttgttttggtggatattaagaaagaagccactgaaactgctgctaaagctttaagtgaaaagtacggggttcagacgttgccactagcgactgataccacgaacgaagatgaagttgataacgcagtaaaagccgttgttgcaaagtttggacaggtcgacattctcgtgaatacagccgcaattttacgatttgccccatttgaagacttacgtttagacgaatggaagacggcattgaacattaacttgacgggctattttctgatgtcgcaacgattcgggcgccagatgattgcccaacatcatggaacgatggtgcatatttcgactgtcgcggcggttttccctgagacatacagcggtgcatacagtaccaccaaggctgcggttaacatgctatccaagcaaatggcggcagagtggggccagttcggcattcgcagcaattgcgtcatgccatgtctggtgaagacgccgatgtccgctgacttttacaaggatccgaaagtgttggatggccgcgaacggctggttgccagtcggcgaatcggcgatctggacgatatcacaaacgccgtactgtatctgagcagtgaacgctcagattacacaaatggcggcgaactgcgggtcgatggcggccttggtatcatgatgcaggatatgatccccaagccaggcggtcgccgggaatatgctattaaagcccatcaagctaaaaagtaagcgtgatggcacggaagtaacttgatcgcacagccgatcaggttcttcttttgaaaacattcgtgaaattatgaacttagtggaggcattgataatggaaacttggatttcaggaacgactggtttgttgtgtttgcttggcagtccggttggccattctggctcaccggcgatgtataactttagttttcaaaaacaaaaaatcgatgcagcttatcttgcgtttgatgtcaaaaaagaccaaatgccccaagcactggatgcgatgcgcttgttcaaaatgcgcggcgccaatatcaccatgccgtgtaagaatgtcgcggcaaccttaatggacgaactttcgccggccgccaagattatcggtgcggtcaatgtcgtggtgaatgatcatggcaaattgattggccacattacggatggcattgggtttgtccgtaacttaaaagaacaaggcgtggcaattaaagataagcgtttggttgttttgggcgcaggtggtgctgcgacggcgattcaagtgcaggcggctttagatggtgcacgtcaggtaaccatttttaaccggcaagatgagttttatccgcgcgcggaagcaactgccaaaaagttagccaaggccgcgccggatgtggaggtggtgattgagcatttggaagctgccgataagctcaaagcagccattgccgccgcggatatcctcgtcaatgcaaccacagtcggcatgaaacctaacgacggcgagtccctggttaatcccgattttctccgtcaagatttggttgttgccgacacggtttacaatccattgaaaaccaaattgatcgaggacgcagaaaaaattggtgccaaagttgcgccgggtaaaggcatgttgctctggcaaggtgctgccgggtacaaattatggacggggcaggatatgccagtgaaagcttatcaagcgtttgaagctgggcagtaaggcagcataacggaggcaagttgaacgatgaaaaccaaacataatcattttttgccaggtgcactagcactctacttttcctacgcgatgttgggcatcgcctcgtctatcctgagtcagtataaggcgcagttcgcggctaactggggtgcccagcaattgagcaatggcacgattgatgtcagtatggtggtctccgtaattgcggcgtttggattaggccgcctgattgcctatccatttgccgggccggtgtcagatcattttggccggaaagtttccggaacgattggcattgcgttgtatgtcgttttctttgtgggcatcatcatggtgcaccagttctgggcagcttatctcatcggcattcttaatgggatggcaaactcgtttctggatacttgtgtttcgccgagtctcatggagatgtttcccgagtccgcttcgattgcgaatttgttgactaagtttgcagtcgtggttgcccagtttgttttgccattctttattggtggggtggctgccgcaggactttcttttcgaacgatcttcatcatctgcggggtggcattagcggcagatgcgcttgccatcattgtcttcccgtttcccaagcgcgagaagccacagcttagttccaccggttcgcctgaaaaaatgcatttctcactaggctcggtagcggccattttaattggcttcaccagctcgaccacgttcatggtttggttaaactgcaatcaggaactgggtctggcgtatggcgtcaaaaatccggcaacgctgcaatcgttatatgcagttggcgctggcatcgccgtgttgttgaccgcccgcttaattaaatccggcctgaaggaaagcacggttttgatcctctatccggcaattgccgtggtgatgcttgtcttatgctattttgtccaaacgccaacgattctgtacattggcagtttcgtgatcggctacgctgcagctggcggcgtcttgcaacttgcgacttcaaccaccatcaatttctttcctagccacaagggaaccgcaacgtcactggtcatgattgcctcaagcattgccaattacgccgtgctttccgcagcagctggtttgaccaaggcctttggggatgcggcgccgcggatgattattcttttgaacattgggattacaatcatcggcattggtttagcgttgattgtgaaagcgcaggaaaaaagagtgctagaagttgcacgggcacactaaatatggaggcttcgggatgtcattaaaagatgaaatcgatggtcatacagcgttggcaggactattcgcccatcctgccgggcactcgttatcaccagcgatgtacaatgcaacatttgaaaaattaaggctcaacgacgcgtatctgtcttttgacgttgatgctccagagcttgcccacgccttgcaagccatgcgcagtctgcattttttaggcggtaatctgtcgatgcccaataagcaaaaggcgataccgttattggacaaactttcacctgctgcgaagttgatcggtgcagtgaataccatcgtcaatgaccatggcgtgttgatcggccatatcactgatgggacgggctttatggaagctttgcgccatgacgggttggatattcgcggtgaaaaaatgacgctagccggtgctggtggtgcgggaacagctattgcgattcaggcagccttagacggtgtcagtcaaatcaacattttcaatcgccgcgatgcttcgtggcaaaatgctcagcgcaacgttgcgattatcaatgaccagacgcatgggcacgcgatgttatttgcgcttgatgatcaagccgcgttaaaagccagcatcgccgattcagcgatttacgttgatgcaacgccagccggaatgaagccgctggagcacgttagcaatgttcctgatggcgaatggttcatgccagagacgatcgtgtttgatacggtttatgcaccacgtgagaccaaactcatgcaaatcgcgaagcaggcaggcgtcaagcacgtctacaacggcatcaatatgttaatcaatcagggggcagccgctttccatctatggaccggactgcagatgccggttgatgatattcgcgaaacggtgtttggcgagccggcggttgtcacgcacgcgtaaatggactggtatttcaatcgctatagcagaaaatcaatatattaatagaaagcttgatgcatcaaagccgatgccatcaggcttttttgcttaagatcgtcaactaatcgaataaaaagaatttacgaatatgttagcgcaaaaggttgttattagccttacatttagttagtatataagtactgaaagggaggatactatgaaaaacctcattgcatttaatcgatgttggcacggtgtgactgatcagggtatccccctgatgtgtccgggcaagtgacgacgcgcgacagtttagtccgcggtcatgcgcaaagcttcttttaaggttgagtcgttactatcatgagataggaggtgaatcttgacaaaatcgccactcaagatcggtattttaaacgtcatgcatgataaggccgataccaaaactcggctgcaacacgtcttgacgcgcactgagattccggttgaattgcatttttattaccccatgacccattacgcaggacgtgatgtgccagaggcggtcagttcgattttagatccactggatattcacgaagcggcgacaatggatgggttcatcatcacgggttcgccgattgaaaccttagagttcgatcaagtgcattacattgccgaggtacggacgcttttgaaaacgttggggcaacatgtaccgaatcaactctatctttgctggggcggcatggtagcactgaattatttttttggtgtcagtaagcttattcttccccacaaattgttcggcgtttacccacaaacgattctggaaccacatccgcttctgcaaggcttaaaagatggattcaaggcaccacatgcgcgttatgccgagatggatgttcgcgatattcgtaccgatccgcgattaacgattaatgcgaccacgacaaaaggcaaattgtttatggtgacggaaccaaccaacacccaaacctttgtcttttcgcatatcgagtacgatcggtggggactggatgcggaatatcaccgcgaaatcgccgcgcatcccgagatcgactacgcgcgcgctaaacactattaccatcacaaaaacgattatgatcatccgaagtttaattggaagaaaacgcagcgaacgatttttgacaattggattcggcatgttgccgaccatcgtaacgaagatcgttcaatgccgatatgataacgcgtgaactgtcctaaccgcggcggttcacgctcacattaacgcgttcaccggcgcaggagcctgcatgtaaggaccttggtcgcaatggcctaagcccgggccatcacgcccaaggccacttacactccggctcctgaccgcgccggttcacgctcacaatatggaggctttaatatggtcacagcagcagataatattacaggtttgattggcaacaccccgttactcaagttaaatcgcgttgtacctgaaggcgcagctgatgtttatgtaaagcttgaattcttcaatcccggtggttccgtgaaggatcggatcgcgctggcaatgattgaagatgctgaatacaaaggtgttttgaagccaggcggcacaattgtcgaaccgacttctggtaacacaggtattggccttgctttggttgcggcagctaaggggtatcatctgatcatcacgatgccagaaaccatgagtgtcgagcgccgggcgttgatgcgcggctatggggcagaattgattttgaccccaggcgcagatggcatgccgggtgcgatcaaaaaagccgaagcactcagcaaagaaaatggctacttcctgccgatgcaattccagaatcccgccaatccagacgtacacgaacgcactaccggacaggaaatcatccggtcatttgatggcggcacgccggatgcgtttgtcgcgggtgttgggacaggcggcacgttaaccggtgtcggccgtgctttgcggaaaatcaatccaaacgtccagatttacgctttggaagcagccgagtccccaatgctcaaagaaggccatggcggcaagcacaaaatccaaggcatttcagccggcttcatcccagatgtcttggatacgaacctctatcaagacatcgtcgaagtgacaagcgatcaggccatcgacatggcgcgccacgtcagccatgaagaaggcttcctgccaggtatttcagccggtgccaacattttcggcgccattgaaattgccaagaaactcggcaaaggcaagagcgtcgcaaccgttgcaccggataacggcgaacggtatctgtcgacagatttgtttaagtttgatgattaaggtcaatgaatgccgtgcctagccaaacgatgcgtaggttgtggcgttgtgggtgcaaatctttgacacttagaagaggccaaaaacgttcaatcctttgatgttaaagggattgggcgttttttgttttgggtcgatttatcgtaaacttttgagacttcggggggaacaaagtattcttaccccttaactaggcttaaatggtcaccgttaatctaaccgtcagtttttgctgaaagttatcatgttctttgcaacgtcggctgacaaaaaatgtttaataccaaataagtttcgaaaagtgataaggaggtaaggagtaactactatgatttgttaccaaaataaccgtatttaaaatgacaacataaacaacatttgaaataattaccttctgggttctgtcagatatatgtatacgaaaggaagatgatagatgatgaatctagaacaggacaggaagaaaattaaagcaattagtgttggttatatccgtgtctcgattagtgaagatcggcaaaaattgggatatgacattcaaaagcgaaaactcaaagaacgcggagttgactacatttatggtgagacacttagcggaagaaaggatgaccgcccagagtttttaaaggcgctcagtaaagctaaaacactggcggcaaagggctatcaagtgacttttgtggtttacaaacttgatagatttgctagaaaaatgagcacaatcttgaacgtgctggaagatttaaagcaggcaggtgtcaactttatgagcttaagcgagaatgttgatacatcaactgttagtggcattatgatgatgcaactcttgggagtgttcagtgaatttgaagttaacacgatacgggcaaggacgcgggaagcaatggcgcaagctaagttagaaggtaaaataattggccggccgccattaaggggcagcgttaaggaaaaagttgcagagctataccaaaagaccgctttgcctgtggaaacgattgcgctgcgatgcaatgtgtcacggcgttcagtttatcggatcgtcaagatatttggaatatcaagacgaaaagatgagtttaatggtggtaaataacaagagtgatgttataattaaaatcgtaattggacgaaccaatgatgccacaagggaacgtttttggcacttcgacttaaaaaatagtacatatcttgtaagctttgctgcgattacatttcaaaaatcgttgtaaggcttttttttgtgcctgtctttaacgttcccttgtggcacttaataatcccagcgaatcctattacaagttggaattaatactacacgactgcgcatctaaaaatagcagttagttagtcggaggaggaaatgaacaatggaaatgacccgcaaacaacgtcaaatggagatggcgctggaggaacgaatcgagcgaaaaaggcttgttcattccaagcgcctggggtggttgacacttggtatggctagcgtgacactggcagcccttggagcaaccaatacaacgggacaagtcgttagcgcatcagctaataataacatcaagacaaaccaggtgacacagacacaatcatctggtgggagagattgggttttgcgtccagtagctgatatcaaagcacaattcgaagcatcagataaaactgtctatgacattaaatggggggataccttatcgaccatcagcgaggcattgaacgaatcaggagttacgaccagtgttgatcgtttagccgagatcaatcatatcgcaaatattgatttaatttatgccggggctaaattgcgtattgctggtacaggtgataatgcaacggtcacaaccaaagattcaacaggaacgaatcaaacttataacctgaatccagccaaaccagctactgtaaacccagcagatcgggcgaagacgagtacacaaacatcgacacagccagctggcactaaaggctcgactaataaaactaacgcgcatttaaacgggtcgagtaatgccttgaactcaaagaatcaaacaaatcaggctcctggtaatggcacctatgatgccagcaaggctgtgaccaactcgacccaacccgttaagccggttggacctggaaaccaaggaaacacagatgatcccgctaagcaaacaacagttactgtaaatgctgtagttatggggaaaacagttaaacaattagcgcagttcaaagctgtaatcggaaaagaaggcacttatactgcgccggagagttttacagttgatggggttgagtatgatcgcatcggaaaggctgactggccctttgttgtgaaacctggtttggtggttaatgtgggttatattgcgattccaacgactaaggatgtcattgtcaatgcggttgacgccgacaccggtaagatgattttgagcaaacgctataccgacattaaaaacactggtcatcagaaattctcagtggcggatgcatttggggaacaactgaaagatgctggttacacgttggttggtgcggatactcaagatcttgtactcaataaggacgctcaaacggtgacctttaagtttaaaaaaaccaatccttcggcaactgccataaccattaaagcagttgatgaaagtggcaacgaaatcgggcaatttcttaaatctggtgagtcaggcaaattgctgacagtaacagctccagttattaatggttatgatgttcaaggcgacaaggaacagaccttgacagtgcatgatggggcaactataacgttcacatataaagttcatcaagcgcctgcgaagagcaccacgattcaagttaaggcagttgatgaaagcggccatcttttgaaatcagatactaaagcagccagtattggtgagcgtgtcacagtgaacgcgcctatgattgatggttatgatttgcaaggcacatcacaacaaacagttactgctaaagacgggctaacagttacttttgcttatacaaaacatgttgtagtaccggcttcagcaaatattaaagtccaggcagttgatgaaaatggtacagtactgaaaagtgagacccaaacagctcaagttgggaagcagattgccatttcagcaccaactgttgatggctatgatttacagggcgcacaacagcaaacagtgacagctcaagatggcatgactgttactttcaaatatcacaagcaagatgagcaaaagtatccgactgacatcacaattattgcagaggacgatggtcatcgtgagctgaagcgctatacccagacggccaatatcggggatgaaattacagttgatgcgcctgatattcctggctatgaggttcagggtgctaaacagcaaacagtgacggcttattccgctttgtgggtaacattcgtttataaaaaagttccgaatccaattgacattaatgtcgtcactcaaaatctgatcacattattaaatcaatatcgtgtttcaaaggggttgcccgctttacgcgtagatacacatttgatggcaggtgccaaagtccgttcagaacaagaggcggaagcgcttaacgctgggcaggaacttgatcatcaactaccggatggtgaagattttgacaaggaagcaaatttgaagcagtttgcaggattcgtagatggggaaaatgctggtgcaaattggcgtaaagatgaagataccaatttgtcacttgcccagaaactgatggatcaatggaaatccgacgcaccgcatgatgagaacatgcttgaaccgcgatatacagatgttggtattggtgtaagttctggcaatgatggaatgtacgttgctgttcaagatttcggaaccagaaagtgacttctttgattgcagcggagtttgataaaaacgatgtaattgcttttgtttattgaaggaggttatgcgaataagcttaataccccttaaacatcaacgattatgagccgaacggaaacaaaaagttttatggcagaagtatttactaaacgttgtgtaggtttacgcattggttgggagaatgtgaaaatgacagatagtttttgaagttattataagaagggggatttaattatcgcaggtggacactgggaacccgggaaaacatttcaagagcttcactgggtagaagataaccatgatggttgtggatgcatcggttggatcattttaatcgccatcctttttggggtattagctttcatcatccaatatctttgggtgattttaatcatcgcagcgcttggttttctgatctggtttttaattaagtaaagattcatggaggagaaagaaaaatgcaaatgacaagaaaagaacgtcagcttcaattagcgttggcggaaagggtagcacataaacggttagtacactccaaacatctcggctgggtggttattgggatgaccagtgctgctttgggcggtttggcctatgttacgagcggccccacccaaatcgtcggtgcccgaactagtgaaaaggaaccctcaggtcaggttaccacagcgcacgcgagaactaatcaggtttggacgttacgcccggtaagcgagataaaggcacaaatccaagcatcaaataaaaagatctatgatattaaatggggggatacactttctacaattagcgaggcactcaatgaatctgggattaccacaagcgttgagcggctagctcaaatcaaccgtattgctaatattgatctgatttacgctggcgcgaagttatatcttcaaggaagcggagagaacgcgacagtgacgaccaaaggcagtaatggtaacgcgcaaacgtataatttaaatccttctaaaccagcagttgcaagctcctcggataaagtggcggtacagacggataaaggcactaaagtggtaccctcaaagacagaagatgttaaagtggggcagacgacttctacctttggtgggggacaaaccagtacttcaatttccacaatgccaattgggaccgacaaaccaaccactccagaatcctcaacagataaggcagttaccttaacgattaaagccattggtccggatggcaaaattctgaagacgagaaatatcttggggaaagtcggttctaatgtaacagtttctgcgccacaggttgccggatatgaattagttgatggcgtgtcaacggttaagcatgtaaaacttgacaatgggaatacttctgtagaatttatgtataaacgtgtcgtgaaaaacatttctaagtctgtaataatcaataaagatgatcaaggggacacgttaccaaataagccggatttaagtaaatatcgtttattaacgtctacaagcaaaacagaagttcaaacaatgtcgaacggcgatacaatgagcaccaccacaacgacagttacgtatcataaaatcgctcggaaaacgcaaagagtgattcataacgttgacgagagcggcaatgagttggcgtccacagaaggcttaatgcttttaaagacgggaaccacttataaagatattgtggctgataatggtgatgtaacaacaattttaacgactacaaatgtttacaaaaaatcacctgtaaactcaaaaacgggcactattaccgttaagtatgtggatgctgacaccggtgatgttataaaaccaattcagacattaacaagaaatgtcggtgataactacgaggtcgctgctccccaaatagaagggtatatacttgaaggtaataatagtcagtccgtaaccgtatctgtagatggcaatacgataacctttagttataagaaaaaagctggtgtgcatgacacaagcaagtatgtgattaaaaacatcgacgaacaaggtaattcattaggcgataaacctgatgccactaaatatcataaaatctctgagtcaaaaccagagaaaactaatgttcaaaagttaccgaatggggatactgttacaacctataccagtactatcacttaccataagattgtgaatacgaataaagccgtgacaacgaatgttgatgagaccaatcacgcgctaggtaataatccagatacttccaagtacaaacggatgagttcgtctgaagcgaggaatacttctatagctagtaatggcgatacaactacgacggttacaactacctttgtgtggcataagatagtgaatgttaacaagacggtgactaagaatattgatgaagcaggtagtgatttaggacaagaagtttctacgactgattttcataagttgactacaagtacacctgttaaatcagtagcgaccgcagaaaacggcgacaccgttacaacatacacgacaactgtgacataccacaagattgcacgaacaaccaaacatgtagttattaatgttaatgaacaagggcagtcgctgcagtcgattgatggatatgacttggttaagtcatctgacacatctactaatagtgttgcggataatggtgacgtgaccacaattatcacaaccactagcgtctataaaaaatcagtagtgattccaacgactgctaaagtgactattgttgctcgggaagttgatggaggtgtactgaagacaagtgttgttgacgcagaaataggttctacctatacggtccatgcaccggcagttgacgggtacgacttgattggagagcagtctcaacaggtggtggtttcggcggaaggaaatacagtttctttcggttatgagaagcataagcccacccccgtttattcaaccgttactgttatcgaaaaaaatgctgacggtcgagtaatgggttcacattctgttcaagccgagattggtacgaactatgttgcagaagcaacgcaatacggtggatatgacttacaagggccaaacactcagacgataagagtgagtcctgatggtaatacggtcatctttgtttataagcttcatgtatacaaattagatacagatgctattgcgaaccgattagcgcaacttgtgaatgagtggcgccaacaaaatggagaattgccgctaaagcaggatccaaatttacaagccggatcagctgttagagctcaacaagaggcagatgcagctaataaaggaggaattaatgctgctgatcactacctaccaggtggacagatatttagttttgagccacatctaaaacaatatgattcttaccacatggcagaaaatcttttagtaactactggacatgatgttgagtctgttgctcagggtgcttttgcacagtggaaaaactccgctgatcacaatgcaaatatgctggggacttatacggacgagggattatcagtcgttcagctggacaatggcatgttcttggcattacaagactttggtgaaaagccaaaatttaattgggatgtcacaccgtttacttttcacggaaaacaggaacagtatttatcggttctaaagtccgcagcaggtgtgactgatcaggatgtgatagattctgctaaccggcaggggataggcaatgtctttgagggaaattactacattagcaatcacatgcttaagactaaagacgaccttgatggttggattgtttccggctatgatgaccccaatatgcaaaagtcaatttggactcaaggcaaagcaatggttggtatcgcagtgatgaaagatggaactatcataggttacgtaccagtggacagagcactttccaaaccggcaaatcaacttattgctgaaggatacattccttggtagtcgtaaatgacggtaaggagtgactatgaggaaaatatttacattatttagcttgataagcattctatttttaagcggatgcaattcatcaacatcaccgccaagcaagacaagtaaagttattgagtcaaaatccaacataatgaaagttgtggggcgcgattttgccggcgtttatgtcggcaaaggaacaaccaaggatccgacttaccgatacagcatacatttcggccaaaatggtcagtttgtgcaagatatcattgcctcgaaaggttatgcaggccgttttactgagaaaggcacttacacgatagatcggaagagcaaaaaaattgtgatgactatcaaaggagtgactgaagaacgttttgccagcgataatgccttgacagccggggaagcaccaaccgcattttatgagcgacatgactcgagttcagaaagtccactcaatgaagccgaagatcatccaattgatattaagattggagcagaacacctcattgggtcggtgaatggcgtgaagctctatccaaccaaaaaggccacggtgaactatacaaaacattatgatgctgaagaagcaaagtatagaaaatctggaggttgggtttcaggccgaacatttggaactggaggcatattaatctcctttaaggctgggaagtttatctttcagtttgcaacacttgaagaccctattcatacggtgacgtccgctgaggggacttacacgttgtcttcaagtggtcgcaaaataagcctgatcttttcatctttcacacctctgtataaaggaccaaaagctgagtattaccagtacaccacaatcgcgagaagcccatttgaaaatattaaaactgccaacttgacagttatttctgaaaatgagttacgaagcgatgctattggttctatagaacctctgagtttgggctcagaagatgcaggggatcactatccaagcttaatgaatcaatggtcagttacaaataccaaagacaaaatgaggaaggttcaaaatttaggtgtcacggatatctttcctactgaggatgattttgcaaaatgggttatttctgctgctactgaatctgatggttctgatatcgaacttacggggaaaggtactgatgttactgaggatgatgaaagagtcgacgcaacctttaagtacgaggcttcttatttacgcgctggagcagctgttccgggtatcgttggtattactgcggacggtcgactatacgcgtatataatccttacaaaaggtagatatatgcaaccttctcagttttggcaagataagtacgaggcgtatcgagatttgaaaatggataattgaagacaacgcgatacggagagactcatttatcgacatgaggggtcaacaaaagtgagttatgtatcttgtgaattcgattagaatatcaggaaaggttgattcggcaatctaaaagatagtattttaaacatggattttgttgaacagacgtctatccccaactgaaatgctatcaccgtgaaagtacgggcgattgatagacaccaaaagtagtagtgcctggtgggtaaccaccaggtgtttttttacttataaacttgaacacaaaaagtctttagatacgtacggacagactgatggcttaaagactctcttgaaaacaatgctggtaaaaacccacaccgcaaaggcaaaagcgctataataaaactcgtaagtctccatggtgcaacggatagcataatggtcctcgaaaccacagatccgggttcgaatcccggtggaggcattatttagctttctttaggttattttagctttttaaaaagcttatgtatcagcatttacagcaatttaggtatctttatagttactttgtttttatttttcgggggacaaaaaggggacaaacacaatcatagctgatccatgaataacacggccttatgtgcttcttgttttctctgtgagtctaacaaatgaccatagactttcatcgtaatagtcacgtctgaatgacccaaccgctttgaaatataatagatgtcgacgcctttgctgatcaagtagctgacgtggctatgacgcaacccgtgaaaggtgatctgcttatcttcagggatcccagctttgttctgaatgacgtgcagggctttgttacatgcgctgtctgtaatcacgttgtgacgtggatcacgcataatcatctggtcttcgtcacgatatccagtacgaagataagatgctgcttgttcctgatggatcttattaagaagctcaatgacgctgggcgatatctcaatgtcgcgaactgacgaatcagttttagttggtttgaatcctgttccatacaaatgatcccaagaacgcgtaacgtgaatgacgcagagcttagtatcgatgtcaggccaagttaaagccaacacttcagatattcgcatgccagtcatcgagccaatataaacagcaagcgccccgatattgcggtacgaagcccgttcaatagcaattgctttaaccttagcgaaatcacggctgtctagcacctttactttcccactagagcgcacgcctgatgtcttcgttccaaaggtaaaatcagaaaatagaatgcgttcattgattgccgcttttaccatcccacgaacatagctgttcatcttggtaacgatatctttcgaacgctcacgtggccgctttcgtgtggttttctccttgcgatctttgccagcagcaaaatcgttaataaatttctgccattcgataggtcgaatagaattaagctttcggccatcaaatcggctctttaggtgctttctgaaaagtttgtaacggtatacagtgttgattgacttgccattgattcggtatgcttcagcccattgatcccaataatcaagtaacagaacgtcttgttttgatggatcgccaccacgtttgaggtcatcttctacagcttccgcagcatcttgcgcagatgatttaagccgatacccgccgtgtgaagcaaccagctgtttaccggcggagtccgtatacttaacccggtattcccaatatttgccgcgtttcctaaatgttgccatgcgaattgcctccttttctggtaaaatcgagtatacaaagagccttatgactccgagtatttgttaggcgtctacccgttcactttggtcggtggggtaggcgctttttgcgctatttcctgcctgcttttttcttgttaagtgcctcgtttacgttactgagcggaatatctttgatgaatcgtttttctctaattctagaaaaggggacaacgatcttgtcgtttagttctgttttttctttatcagtgaagacttcggtgtctgaaatgtctaggagaactgagtgctcatattttttgatcggttctccttcaaaatttttccaagttttttcgccaaacttataagagattactgtaattggtttcataggctttaccccctacaatctgtgtgggtttttgtgatataattaagtgaatgaaattcatgcaaaaagaaattaggtgagtataaatcatggaaatgcaacaactaatcttagcgggtatccctgggttcttgactttcatatggctcgataagctagatgctattcatttcgatttgccagcaagacaggcagatcgtactatcgctttgattctgatatctatgctgaatgctgctggtggcctcgcaatttaccagcaaatctggggaacagttggtcacagcttctggagtgaatttggccttttcgtagttacgctgattttgtctgttccattagccttcacttactatttcttaattaagctaggaaattcatgcctgatatggatacaagaacaatttcacgttgccaccgtattgccagggtcgccgctagttgaggcattaaaaaataaagaatacagtgaggaaaagcttgtcatcattttcgactttaacgacaagcttatctctagtggttacgccaatcgcctacctggaagcgacgacccaactcaacaaatcgggttgatgacatatggacaggattggaccgtgaaattggcacagaaaaaatatgatgagtctccacaaaacagtgaacaaatcattgacttcgaccgacaattgaaaatttatattatcggaatcaatccttattcttagaagatgccgaatccggcatctttggtttggggggaacagggtctttgtgaactaatttgattgaacgattttgtacatttctgtcgaaaaagaggccggattttttatctggcaaacttttagctttatctgagttgtctttttgcaatttcttttcctccacataatctaattgctcctcgaccacagcggccgggggttttttgtatccagccaacactcagttaaactgctcgacattttgatcatcgtcttgatcactagcgcaagcggttgttgcgccagccaacaaaacaatgagtaagatggcaactatcttttttagcatgatgactcacatcctttacttggtatgtggcacaagccccactctccggcttgcacggagacgccgcttgcgttggggaagggactaaataagaccgaacagtataattattataataattggtattgtgcatcctaaagtcatcgcacaaccgaagtcgctaaaaaatttcccggttttgtcaactgattgtgaaaacttatcagcaccattggcaactttttcccatgaattgattggcataccgttctgatgttcacctggataaattattttagccccgcaggtggggcaaaagcgctcgcctttaagctgatgtttacaattcaggcaataaggctttctttttgctgcgtacatttttttgccgacttcagaccattcttcaccggaattattgttgagcgtcttagctggttgctgatcttcggcgataagttttaaagttactgggtctctataagttttgacagtaatagaaccatcgcttcgtgtacttgtttgtttatatgtccccccgtgtatagatacccacagttccactttgtcatttagatacaaggctgagaatgttttgactttgtcgttcggtatctttccaatgaagtacttagtttgcctaatttcggcatatactttcccatcaatatcgactgaaactggttgatttaaggcagcaaacttacttagttgccatatcttattttcaaaagcagtatcaataatttcggagttgccgagaccatcatatgcttgccctgcatcaacctggtcttccggtaacagattcattcattcagaaatctgagagtcttgagtatctaataatgtgcatatttttgtcataatccaacatcaacatctttctacaattaattaatgacttttccgattatactgatatcatctgcttttaccagttggttgcaagctaattcaacaatgaacagtcagtagttttcataaaaccgttcaatgcattgaacggcagaatcctctaaccattgcggtatcgctaaatcattcatgaattggtcaatgtttgctgattcttctggaatgtctgcgaaatacattggaacgataattgatagcgcacgttggttggctccattctctgtacggcttttagtgtattgatttgtgtatcgaagcttaccgttatccccgttgagaatatgtgcacattcatgagctgcttgaaatggcaactcatttgcattcggccatttgttgttaagaataattaggcgagcttctgtatcaaccaaagggccttggtcctcgtgtaaggggatagtcgagcagcctatattgtgatcccaagcatagtcaatcacctgattcaacaagtcctctatatgatcattcatgacgatcacgctttttgctgctattattgcgtcgttccaaaatagcttgaatgatttcccaatcgtcttggcgaacaggctgtccttgataggtaaagatgtttgttcctgacagatcaacaggtttagaaccttcattgtcaggattggggttatccgtattgccaagtaaataatccacagaaacttgaagaacatcagcaactttctgaacattctcggtagatggggtcatctttttccatcgatagatgctgttaatgcctatacctgctttcagagctaatttttggagtgaccaccctcgatttgaagctagtgtttttattctgtcgtaagtactcatgagacgagttctcccggtcatgacgaattatttatcacaagtggtttacaatttatcacgtgtggtttactatgaattcatcaagtaattaagcaaacatcaacaagctaatccatccatgtctttggcgataacggtggataagtagatcatctgtcttatttgctatgccattaatttaccactcgtgataaattaatgcaacaacttgattgattctttaaatgtaagggaggtgagtacatggtaaacgttcagctcaattggactgctaatcgtaatgactggaaaggctacttattacatttgaatttgtcacagctcgacattgcgaaatttctcggtatcagtgatcaggtaatggcaattctggttaaaaagatgactgacggtcagggattaactgctaatcagatcgacaaagaccgttggaagcgagctattgaatacgtcaaatataagcagtcacagcaaaagaagatgacggtatgaacgggctaatcaaacttcatgtggaatagggaggaagataaatgatcaagccgattgatgcaattcgcaatgagcttccagtggttacgtccaaaacgttagatctatttgagtctgctgttagtcaagaactacaaaaaagaaacccaaaagccacattccaagttagcatccttgggatggcggtattgggccttctggtggcaacaaggctagaggaagtctctgacattaacaactgaatcaagcattgtctgtgctgcggacatgataacaaacgcttggacagcatcatcgacactggagggatcgtaaatcttaggggtgtgggctttgggatttcgataaagaaatattacggttctaagaaggttacgtaatccggaatatatgtctctgtcggtttccgttgcaagcatgttgcccttaataacgagtattggttgcttgtccgaaaacacggtgcttaccaaactattgccatctttttgtatgcctgaaagttgctgaattcgattaacgacacccttgcttgcttcgaagatggcgtgaaagtagtcgccttgaagaaattgttcgttgcagaatttcatcactagagggtgaacattgagttctgtaagtcgagcgctaagagtttttaagcgtagctgggcttcagaaaacgtagtcgcggtttttgctgatgcgattcttccactgtcatccaaacaataaccataaaaaataaggcattcatttatctcatatcgtaggcggccccattcttctggctttgaaataaagtcttgaggtcgagcaatgtactggatggctctaaaaaaggggcgactattgtgtgaagcattacactcgtgcctaattatttcgtctaaacgacgccatttggtagacgctttgaaccattgattgtcagtttgtctttgaagatcataatcgaaaaatccaagcaaagaaaacattttggtgattttgggcccagtcgtatattctcccaagattttagatatattttcaacagctacggcatcaattggtttggacattacattccctccttatgaactattatcccactgacggagggcagcaaactatgaaaattcatgaaagaaggaaacgcattgaatgaaccacaaccaattgaacaaaacggccagcgtgtactgacaaccgaacaacttgcagaattgtacggaacgactgttggagtcgttcaaatgaactttaaacgaaactcgaataagttcattgaaggaaagcacttcttcaagctggaaggggagcaacttcgggcattcaagaacgaaccgacaaattgtgggttcgttgggaaaaatgcaagtgctctatatctctggactcgccgctgcgccgcacgtcactcaaaaatgcttggtacagatcaggcttgggatatgttcgacagtctggaggagaactactttaatccgaaaacacggcttccacagacgccagaagaaaagcttgctttaaccatggaagttgctactcgaactgtaaaacggattgaaaagcttgatggtcgtgtaactgatctggaagagaaggctttgctggcaccaggtgaatataactacatcagcaaacaagtcaatcgagctgttgcaaattatctggacgtacatcactgcaaacttaacgcaaaacagcgcagcctcttttatcgcgatattaaccacggactaaatgactacatcggaatcaagatacgtacacagttacgtaagaaagacttcgataaggctgatgactttatccagaattggacgccatcaacagcaactctcatgaaagcacgcgagatttcattattggaggaccaacaacaggaggctatctaaatgaatgaacgcccaaaggaaaagttaaccaatgtcgttaaagtacaggacaaagatgttgaagaccaagtaactggaatggtcattgatcttctcaaacaaaaaggcttcacatttgccaactttgaatcagttgtagcacgtgtgaagtctcactatcagaacaacgcaactatttagaccaggtgtaacggtattgttcgcctgacccattttcggcaatcagataccaacggccagctccagaaacccgaattgtaactggggactcatcatagtgacctccgaaatatgtaaagtggtcaccacgttggtgagcgttgaagtttgcgtgatccaccaagtaaacgttcgcagcgtgcggaagttcgactgtaacagctagagctccgcccggattgtcataataagggacttgcaccatgaagattcacctcctttcggtttcattatccgtcaggaggcgatcacaggaaaggagaaaatgccatgccgttgttgcaggttgttgaagatgatcagatttcaagcaaaaagtatttagcggttgaagaagaagaactggcaaagatgattgaggagaaccaagagttaaaacgcaagctagcagcacgaggcatgtggacgctcaccaccgcaacaagctatgtcgaaggacataacaacacgtgggtagttaacaatatcttgaacgtcccacgcttccacaagttcttgcaagataccgtggtttcatatccaccgcctggcaaaaaggggtatctgtttcatccgaaaccatggctcgacttcttagacaaatggttctcagagatttcaaggtcgcttagagagaagggtaaataatgattggttatttactaattgctggtggcttcggcgtgatcgttggccactgcttaggccacagcggaaattggaggaagtggattgaatagcccggagaccaaattgaacaaaaaatattctccaatatttggcgatggtattagtgtttcggccaatgatgttcaaatggcagttgatggtattgtcgcgactttgagtaggcatacgagcaatcttgcggaagcaaaagcaattttagacttgatagatcttgatcaatacgctgaattaaaactgattaaatagtctttccgcgctcgttatgtaaatggatttcgctacttcatctgtttttgttggtaccggcgtgatgtggtcgaaggacgtggccacatcagcgttaagcaaaaagtcttttgtttcttttttaccaaactcatctgaataagttatggacaaagaaaactttctggtttttaactcaatttctgagtttttgactgaaataacggctgcataggtctggtcgggtgctatcagctgattagaaaataattcaaaagggttgttttcaaactttagttgcccactgtcaatagccggatcagccttgactgataagattgttgctcctgttcggccaaagttcttgatcattaggtaaattattgtagtttgcgaagatctgacaactttaagaaaagaaacgatgtacggcttgtttgcatcacgttctgatttagaacttcgtattaaagcgattgttgatagaacaacagccactatcgaagtcagagcttgtacgacgctggaaaagagttcgtatttattcattctaatcacctcttcgtgattatcgcacaaaagggagcaaacaatatgctctattcacagcttaatcaacgaaataattggcaaaacaaaaaccgctaagcgctagcacacttaacggccaaaaatgaggtttcacattgattgacctcattatatcacagaaagaaatgaggtaaaacaatggccagagaaattggcaagcaacttgaccgtcttgaatcacttgcatacaaagtaagaactgatcagtaccttttggattatttgagagaatgggcagaaaccaagtgcgatctattcagggatgatgatcctcacatgaccgatggtgagaagattcaagaccggctgttcctaaaagacaactttaaaaaatacatggatatcttgggtcaaacatcactcgatatgatcaaattcgaagcagacttaatggatgttcgccaaaacattgccgatcaatgctttcatgaaggcggtgtcgatcatgaatgagaagcctggttactatgcaatcatcccagcaggtgtgcgctatgacaaacagctgccacaaggagccaagctcttgtatggcgagatcacggcactcaccaataagaacggttactgctgggcatcgaatgactattttgcaaagctctattcggttagcatcggcactatcaaaagttggctaaagtgtctcgaagacaattcatatatccgcagagtcatcaaatataaaagtggaagtaaggaggttgaacaaagatttattagtttagcccctcggtcagaaaacttacccccctcggtcagaaaattgacccacccccggtcagaaaactgtccagagaataatacaagtattaataatacaacaacattaggggaaccggagctcattaatttttgggagaaaaacggttttggttttatcagcccaaagaaccgtgaagacctcatgtactgggtagatgatttcaagaagattggctcaactgacgagcaggcagttcaggtagtcaaacaggccatgagcaacgcaattgacaataacgtgcgtcgttatagctatgtcaatgccattttaaaaaattgggaatccttaaggcttactagtttagaggcagtgacggcctatgaagcccaacgaacacaacgccaaaagtcaaaatcaacgtcacggcaagcatctacagacgtttatcaaaaccaaggggatgtccaagatgaagacttaccttggtagagaagaggcgtgtgatgagcaatcttgaaactaatcaaggacgtttagcagcgatcgaaacatttgctgaacgttgtcccgattgtggcagcctcttgtatcgcccgaagggattgagcaaagtaaccggtaaaaaaatggccggagtgtgcatgaattgtggctataaacagccacccacggagcctaaaaacgtcacgccagatatggaaaaagaggcccgcaagaaccgcaccgttggatactacctagcttattcggtatttagtacagacgcgattattgcaaaggatttcaacaacttccatacagatggcagccttggacagcagcagttgaaactcttcgctgtcggtttgtctaacaaaatatgccgtaacgaggttgtacacgcattgattatcggtgacacaggagttggcaagtcacatattgctaacggcatattaattgatactcaggccaagaccggttatcgcaaaacatgcctttttattgactggaacgctttaatgcagagactcaagtctggcatgagtgctaatgcacaagatgtgcgaatgaagaacgagaaaattatgcatgagattggcaaggctgatgtggttgtgatcgatgatctaggctccgagcgtggtagtgattttgaccgccagacggctgatgatgttttcagaatgcgggaagacaaagcaactatcgtgacaaccaatttgcacggacaagatctgaataagaggtacggcgagcgaactatgtcccgtatggccaagcacggccaaggaaatagctttggcgttaaaggaatcctagatcagcgaaaagaggcgttgccttgatgaaagaatacgtgattatggacacggagtttaactcaaccagtaatcgagcaattcaaatatcagcagtcagaattcgagacggtctgcacattgcagatcagttcaaccgattcattccatcaccagataaatttgatcagcttcacatcattaggacaagtaacatgcgatacagcgactatttagctttaccaagcctgcagcaaacagtgcgtgactacgtggcctggatgagaactacgattgacattgtgggctggtcgattgaaggcgatgcgggccgcatcagagaaacatttaaaaaggggtcacatggcatccccaagaactggaagtttatcgacatcgcagacatcgttgaaaagcggtatagctttaatgctacgcctccgctgcaaggactggcgaatgttctaggcataccagtaaaccgtactcacaacgcgctagatgactgtttaaggacatttggagttatcaaggcattggagtcacgagacggaaagctattttgaggagaacaagcttgaatttagcaaagaaaaagtaggaggaaatactatggataaattaaatttgaatctgaacgaactggctgatggggccattaaagaaaagttgacaaaggcattggcccaggttgccaataacattcttgatcctaatactgatcagagcaaagcacgaaaagttaccattgcgcttaactttaagcctgacgatagcggagtcgttaagcttacaaccgatgtcaaaacaacgctagtaccagacatcagtgtcaccaccaatgtattgcttggacgtggcgaggacggatatatggaaatgaacgagttaaagtcaggtacacgagggcaggaatacttcgacccagatgatagtacgctaaaagacgacaaaggtatcccaattaaagacgataaggtaacagacgcaccgattgatttccgaaaaatcaagaacgccaaggaggccaactaatatgacaacagaagcagatgcacttaaattcacagcagaacaggcagttactgcaaatggtaaacgaattatcgaaacaaaaaatcgtcaatttttgattaatggtaacggtgatataagggaatttagaccaaatgatggagcaaacgaagcgttacaagttcacacattgactgcagttgtcgattatatcgggaaggtcagcgaacgttctgccagtcccttaattgtgcaagtagtcgatgagaacagcgtattcgtattaggagagctcgatgattttggcaaccgggaagtcttgatcaaggccaaggcaatgcatccctgctacccatacggtcaatggctggattcggaatcattcatcatcgcactgcaggcacaattcatgaccactgaggatggcaaagtgttgcttaaatttgttggtaatcttaaagacgaatctgcacagacgatggttgatgacggtgtaagccaagttgcaaccgcacgcagtggtgtggcatccgttggcaaggtagttgtcccgaatccaatctcactacggccatatcgtacatttctggaagttgagcaacaggaaagtgattttgtctttcggatgcatgaaggtccaaaattggcgctctttagtgctgacggtgatgcgtggcggaacacagcaattgatcttgttgccgaataccttagtgagaagcttgtaaaatttagcaagcacgtgacagtacttgcgtaaggagacataacatggctaataaagtggaaagggagtcgaattcgacccccttaaccaagaaacagaaaagctgtcagtattgccaagagccgcataaacctattgaagcagaagatggtagttttctgcgaataggtatgtctggtgggaactgttgggacggagttcatcctgaaaaaataaatggtgcggcaatacacacctgcaccgcagtcggatttgataatgctgaggttgatgaaccgattgcaatcaattattgtccgatgtgcggacgtaggctggaagcaaagcaatgattgccgtcatcttgctcatcgcagttgcttcaatatgggcgtgggctaactgggaaagaggaaaatgaaatgaattcgttattaataaagctacttatttgcgcggttattactgtagtcatatgtgcatacttcttttggctgctttttgatcattttgttagcaataggcgcagcaagacggttcaaattggcagcacggtcttcatcgtcagaattggcaaaaagcaatatgtatcttacttcagcaaatgtagcaaggaatttaagacatcaagcgaaattgattcatctaaactatttgtgctaaggcatgacgctgaagctgctgcagaagtttctggcgggattgtattaaccttgccaatcaacattgacgatccaaacgaacttaaatattagcaggaataatcctgattcaatgtaaataaaaagcgcgcctgatgagggacgcgctggaggccagacgtacgattgagagtaaatgaaatcaaagattaggagttggcctccaatgacagtatagcaaacgcacatgttgaaagtacatttaaaagcatcaaaaaagcgcgccgggtgttgacgcgctctggaggccaaacgtacacgtgattgatagcaaatggaatcatttaaaaggagttggcctccgtatgcagtataccaaaaagcgcgtcacataagcaacgcgcgggaggtgcttgaatcagattgttcccccaacttataaggttaacacgcataagaaagcatctccaaaggtagtatagcaaaagtcgccctggattaacaggacgactcagtctaacaaatcgaattatttgaacagcaggtatatcacaaaaaacaaaagcgcaccacgaaggcacgcttatcctacaaacccaaccaaatcataccataaggagtggacgcagtggtgcgagcaacgagatattttagcccaattgatcatgataaaacaattgaaaacgccaaagaggtcttggggaactactggcatcacaagcggctcgctcaacgcaccaaaatagcgctcagaagtcccgtgatggacggcatgcctaagtcacctagctatggaaataaagccgaggacaagctcgtatcgcacgctgacgagctgtactatatagcgtgctgtgaaggcgctattgaatctatagagaatgaagactaccggatcattttagttgagagctatctgactccaaagacgacacgtaaatccagccttcagttagccgctcacttgcatgttgaccgaacgaccctttggcgacaaacacaagaagctctctatgcttttgctgaaatatgtccgctagtgaaactagatgcaacatccgtgcaacaatgatgcaacaaaaaacacgcttttctgccttattatgttattgtgccaaaggtgagaaacctgagacaccgcttttttcctccgagcctcagtgatgataaagctgtggcaaggcgtggcaaatggactggctgagatagtcaggcgggttcgattcccgcatgccacattgccaaactaaggcgtaaaatctgaactttggcaacccgacctgataaagaagtgccgcttaaaatatcaggaggtgcgttaaaagactaatgctaggatacccaaatgtgtgatatggcatttgtcgtctatgtctagcggcttggcatagaacgaggccgaagaaacgagatgttgtgggaccaaatcccaccggcctcattgtccagtttagcgaccggacacagcttgcgatgaccccatctgacactgtgagagcgagcagcagacatatgaagcacagatatcacctcaatgtagtattccagttcacgctggggtactattttttgaggtgattagaaatgagctttatttctggatttttgactaaagacttttgctcaattgtggcagatagaagaatgtctcaaggagcaaaaacggttggggaaaactataaaaaatttatgttagccgaatcaaacattttgattgcaactacaggaaacgctcaagttgctgacataataaaggacttcataaagcgattacatgttcaaagcaacggagctcagttaaactggcaactttacgtaaatgtgatccaacagtttgttaaggaaacgttaaaggaggcaaaagacatagatggaaattgtgtaaatcaaattgttgttatttgcggagttaatggtaacaaaatcatggctttggcatttggacaaactgacgcaggttatattcaacgtgagtacttgcctgaggaaaatgagcaaaagttctttactatgactcctccaggtgtgaatccagatgccgtcactaaggagttcatctcgattaccaacaaaatcgagattagaacatatagtgacatagttatagttcaaagcaaattgcaagattatgtggcagaaatcgattcgggaaaatcagttaatacacataagatggggatgggggcgaggatagacggaatcaacggaagatttaaagaatggtcctctggtaattaaactacccgagtttttagactcggccggggatcaatgcccagagatttcgggtgggaaagttgatattatttggctttgacgcttcggcgtctttttatttacacgagcactccgccaaacggtgaggtgctatttttatgcgacggatttacaattcaagtgcaacaaactagtcaaatagaaaagactcatagcctgagtccttgtaaaatggaatcaccataagaccaactacaaggagaactcgactatgagtccgtacacccatcttaccttaaaagaccgtgaatcgatactgcttggtatctctacaggcaaaactcttgataccatcgccaaagagataggtcgttccaagagtacagtcagccgtgaaattgcacgtaacggcggctggcggagctattcggcagccaccgctcaggaccgctaccggcgggttcgcttggctagcaggcgtcctcggatcctcgatcgaccggggactcgtgacgctgtcattcgatatatcacggtgctacattggtcgcctgagcagattgccggtcgcttgtcactagaaggcagtcctattcgcatcagctattcgactatctacagatgtatctacctagataatctcggcgttccattgaagagccatggtgctcgcgggctaccaaggctgcttcgacaccgaggcaagacgcgcaaaatcaaaggcaccataaatgaacgccgggggcgcttcaatgacgtgccatcaattcacgaccgaccccggtcggcagaaaatcgcagctggtttggtcactgggaaggcgatacagtacgcggtaaaacaggacactctgcattagtaacattagttgaccgtaaatcacgctatctgctttcgaagcgaacggccaacgcaaaagctgacactgttagagacgtcatgattgagctgcttggtgccttaccagctaaccgagtaagaacagtgactcctgaccgtggaagggagtttgcccggtacagggagctggcagaacgcctgaatacaaaggtcttctttcctgacccacacgcgcctcaacaacgaggaactaacgaaaacaccaggactgattagagaatactttcccaagaacacagacctagaccttcagagcgaccaggaaattgagacttacattgaacaactgaataatcgaccacgcaaggtcttaggctggaagacgccatcagaagtcttcatgggtaaaaagttgcacttgagttgacaattcgtcgcaacaaaaaacctccagctacccaggctgaaggcatgcatgagggaagtaaatgtgattgcaagggtggcttgccttgcacgatcagtatagcagatgagtttatcaaatacgtaaagctctggtaccggatttgtacaggtttaaaaaagcaacaaaaaagccgacactttgccggccagttaattagtcttttttatctgtgctgagcttgcttttcacatcatctactgtgtctttaacagcatctttggcatcatcaagcttttccttggctttaccaagtatgccttctgctttgccctgtgtttcgcgagctttatcacctgttactttgccttcaacttcttttgctttaccggagatcttgtccttggtgctgtcgactttaccatctaaactcatagatattacctccttttaacatcaattatcatataagcttatacaaagtgcaacaaaaaagccctcagagaccagtccaagggccaaaaggatgaaaaaacgaaacgtatgtgtgaatagtagcaattgacttggaggagaacggctactgctcacgactacataatagcacattccttgtataagtatactaaaaaagccctcggttgggggccgagagctagaagattagggtagtaccgaggagtgaaaatgagtatttatctggaacaatttaattttagcttattgaaatcttttaagcaacaaaaaagctctcggggccgaatccgagagccacaggaacaacggaagttctttatcagaaagtagagcagcgtcatcaaactgctcacggccattatatttcgggaggcgagtagatgcaatggacagatgaacagatcggtgacattaggaagctcgcctctgaaggctttacaagacgcgagacagccgacaaacttggaattagctatgatgcgcttcagggaaaagcaagacggcttgggatcgagttccagaagccactgaaaaatgaatacgattcagacggcacaaatagggagacaccgtccgctgacagaaaagtcgctcttaatgctgatggtagtcaaacagtcacggccttaatgagactcaagcatgagccaaataaagacccacgaactttgatggagttgtgtggatacgatcctgataagttcgagatggtcttaggcgactacaaagtgtatgagcagcatagtaccgaagacggcacagttccgcagtatagcattcatattcgcgtaaagccgaaacaaggcttatcgataaatgaaatggctgaagcgttcaacgacaaaatcattccggtcaattacggcatgaagaaatcgggcgatcgcaacttagtcatcccattgcctgacctgcattttggctggacaacattcgccgatctaaaagacatggtgagtcaacttagagagataatcatggacggctacaacgagattgtgatcgagcaattgggagatctattccatagtgatcagattcatgtaacacaaacggttagaggaacgcaactagatcacgcaaacatgcgtcaggcattccatgatgctgtgaagttgtttgatcagattattccgctggcaattgaatatagcaatcacgtctcaatcaagagcgtgttcggtaaccattcaggtgatctcgaatacgcttttctttatgcactgatagatcgctatccacaagtacacgttgatctcaatgacagcaatttggcaaccgactggcgctgtgcatacttgctagggcatgttggcattatgctcgcacacggagatgtagccaagaacaactgacaggactttttccatttgagtacaaaaagatattcaatatggcaaaaacatacgaacttcactcaggccactatcatagcgagcggtttaaagatgatcgtggcattatgtggcgccagcttggaacagcaaagccaaatgatccctatgagattaagaatggcttcaccacgggcaaacatctgctgtatgcgttcgtttatgacgacacgcgattgaggtgtacttatgaactcaactaatgcgatgaagcgagtcgggtacggatatgtaagccacacagagcaagcaatcattgagaaactatcgagagaagagaaacacatgcaagcaatcatctacacaaagccacactgccaaaagtgtcggcgaacagtattcaagctgtcacgagtcatgccagtgcaaaccatcacagcagacgcggacgactacgagcggttccgcaagctaggctatcgttcaatgccagtcgtaacaatctacgaagcagacggcacacacgatgaatggtgcgatttaagggttgataagatcaagcagtacacggagggaaacatatgaacggaaaattaatttacttggttgataaggatgagtatatattcataacaactattaattggcaagaatgtcaatggtccggacaaaaattgtccggttctgccgaatgcgtatggtggctcctatgctgtaattacggacaaaaatagtttgtgcgataattgacagatgaggaatattttatgaccaatacagctattcgctaca

SEQ ID NO: 299 - DNA, 57058 bp, Lactobacillus casei
tttcttgtttagctagcactaacaagaataggtcttcatggcctttatggtctagtcgtcagggtgttgcacttgaattgtaaactggggagattaaacgctgataaaagatctgataatgcgtgaatttaagtgacaaccatacgcattcggcagaaccggacaatttttgtccgaccattgacattcttgccaattgccagtgcaaaggcagcaagaaaacgtgtgcatagctacatctggtatggtgttggtgcaagtagccagttgggattagaagcacttgaccgttatatgcctcgtatcaaagcgcagacaccaaagggaagcatcgttgctttggactacgaagatggtgcttctggcaatatggcagctaatacggatgccattttagctggcatgcggcgcattcgttcagaaggctacacgcccatgtattacagttacaagccatatacattggcacacgtcgattatcagcgtattctgaaagaatttcctaacagcctttggatagctgcttaccgtgattatctgccaactaccaaaccagactacggttattttccaagtatggatggggtagctatttggcagtacacgagtgcatttgggttgtcacaaggcctcgatggtaacattgatctgcttggtgtcaccgataatggatactcgaagcagccagtaacacctatcaccccagcaccaagcaaaccagcgcaatcaaccgcagccactgataccgattatgcgcaaactggtgttttcaagccttccacgactgttaacatccgcactggtgccggcaccggctatgcatccgttggtagctatgcacccggtgaaagtgtgatttatgatcacgtgtatatccgtggcacatatgtttgggcgcgttatctcagctactcaggcaggtatcattatgttgccttgggcgtaaatggtggtgagagctatggttcgcgcagttcaaatgcgcaaacctattcgcacacgtattatacagtccgctctggtgacagcttctggagcattgctaacaagtacggcattagcatgtacacgttagccgccaacaatggcaagtcaatctacagcctgatctatccgggcgagagcctgtacatcaggtaacaaaaaagtcctctgctcgctaacgcgggtggagggcttatttttgttgctttgaagcacgggcataatgctgtaaaataagatacgtaagcaactaaatattttagtcagcctgtaataccttgtcgttctgcctcccttgctcagggaggcttatttttgtgcacagagttgacagaatcgactcaaaaaggcaaaaggtttacatatgccggattaggtaacttactatgagcaaattgtttgcatacccagcatagccatgcgatactgacggtgaaggagcaaaactccaatagctaggagtaaaaagctccttaggagttggcaagctaagctgctacccaccccaagaataatcgcgcatacggactgtatactgttaggaacctgcccccctcggcgggtcttccagataaaagcaattccttgccaactccgccccatcctatatggatggggtttgcgttttgattgcttttgtgcgctaaattatcagccacagcaaggccgttgaaacacgatttaataacttgcttctggatgcttctagatttgtcagtcaaaggggacaaaaaggggacaaggatacctcaaatgttgatacatagctatcagttatgcccggtggaggcatccgtgttaactatcgaacgctgacaaaatcgcataaggggtctttgatatgcaacctgtgctactagccactgtccatcacccaaatgtctctttgcctcagctacaacaggttgttgcgagtgtcggcaaaatattttcggccatctacgtcacaatcagttctgtcactactaacgagatcgcgcgtttactagacgaagcaccgaaatttcattgccgcattattgagccgcatggtgctgccgatgcccgccgaaaagtacttgagtttggtttgcgggatgtccatgatgtggcaccatttttttactgcgattttgacaaagtcgtggtagcggtagaacgagcggagcctgcgctagaagcatttatgaaacgacttcaggcggttgacgggtatcagattgtcggtcgtgattcagtggtgatgcgcagttatccggcaacttggcgcgaaaccgaggctattaccaataaagcggcttctgcggtgttgggattgcctgatttggacataacggctggatgctgtgcttttagccaagaagcggctaggtatattttagctaactcaaaaggcttactgacagatacggaatggccgttgatttgcaaagcagcgaaattaacaatcacggcaataaaagtcagctttttaccttatgatcaggcggtcaatgctggacggaacgatgataattggcgtggctatgcatcaaggttgaggcttgcttatcaagcactgcagtcattggagcaaggtgtggataggcttgaccaaactgatacgcccaaacaagttaaagttggctggccatataatggtcactgagattttgacagttttccatttttgatcggcgagcataaaaaacatcctttgagcgtaatgaagctcaaaggatgtttttttgtaccacctatttcttttccgccgccaccaacgcctgcgctagatcatcaatcaaatcctgctgatcttccaagccaatcgcgatgcggacgtgctgcggggttaaaccggaatctgcgcgtttttcttccggtagtttgaaccatggcagtttgactaagctggagacggtgcctagtgaatcggcgaagtcaaagaccttggtactgttgacgaatttcagcggatcaatgttgtcggcgagcttaatggacaacaggccgctggcgccggtggtttcctgttgggccagcgcgtagccggggtcgcttggcagtccgggatagtagacatgggcaacatcgggatgctggtttaaaaattcagctactgcctgggcgttggctgtttctcgatcgaggcgaacggcgagggttgcgatgccgcgtgacaccaggctacagtccagtgggcttaagatagcgccgatcgtgttttgcaagagggccaacttttcactgaggtcagggtgggcggagacgaccagtccggcaattaggtcgccgtggccgccaaggtatttggtggcgctgtgtagcacaatgtcagcacccaggtcgagcggccgttggtaataaggggtcaggaacgtattgtccacaattgtgatgaggctgtgtgctttcgcaagcgcgctaattgccttcacgctgctgacttttagcagcggattggaaaaggtttcaaagaagatggccttggtttcaggacggatcgccgcttccactgcggccaagtcgcgcgtgtcgaccgcagtaaaggtcagaccgtgctgagcaaagtattggttaatcagccgatcggtcccgctgtaaagcgaatctccgatgatgaagtgactgccgttgggaaagatggctaagacagtagcaatggcagcaaccccactggaaaaggcaaagccggcgtcgccattttccaatgttgcaatctgccgttccaaatattcgcgggtcgggttgccgctgcgcgcgtagtcccagtgggtttcctgtccatcaggggcaaaccggaacatggcgctttgataaagcggcggcacgatggcaccagcctgatcagtctgtagttgcggtccatgaactaatttcgtattgaattgagtcataaaaacccgacctccctttgatgaacatgttgactatgtatggccgcgaatttcgaacattcgcggcttgaaagtttaaaagcaatcctacaagttattttgtcgtcaagtcggcaccgaagtatttttgcgacaacttcttcagagtgccgtctttgcgaagttctttgatacctttagaaagagcagcttggagcttaggtgatttcttgctgaccattccagcaatgtcgtcgggctttgctgcgctgactttaagcgtttgactttttaggcccgcggttgagttactcttggcataagcataccaagcagcgctggagttaatggtgccgtcagcacgcttttctttgacgaggtttaatgaaaccgtgaagtcacctgatggcgtgatggtcgcgccgtactttttcgctaaggcggcgtttggggtgccagtaccttcaacgaatttcttgcctttaatatcactcaactgcttaatcgaagtatcgtcgctgcgtgtaatcaaggcataacgcgagtacatatacggtgtcgtgaaggcataaactttcttacgttgtggcgtttcggcaatgttgttgagcaccagatcgaacttttggctgccaagaccggcgatcagggaatcccattgagtagggacgaacttagccttaacgccgacttttttggctaaagccttgccgagctcaacttcgaacccctgcagcttaccgtctttgcgataggaaaacggggcataggttccttcaagaccgatcgtgagttcattcttattaatcagttcgcttttgacgtcgctgcttttagacgtgctggacgatccgctgctgcaggccgtcagggtgaaggcaacgagcgccatgattggcaacatgaaccacaactttttcttcaacatcatatttcttccttccatagatgaggttgtgcattcaccggcttctgcgccagtgaacgcgcgatggtaaacaccttacaactgagtcgactgcgtgtttgccgtatagcgtgaggtgactttttcgaggtaacgctgaccccaggataaaacggtgcagacaatcgcatagagcaaggctaccagtgagtacatcaacaatggctggtaattttccgccgcgatctgctgactgacctgaaacatttcgacgatggtgattgatgccgccaaagaggtatccttgacgaggctgatgaaactatttgacagcggcggaaccgcggttcgcagcgcctgagggatgatgatttcccgtaaaaccaggcggcgcggcaatcccacagcatacgcggcttcccactgaccggaatcgatggataaaagcgccgcccgaatcgtttcggcacagtaagcgccagtattcagcgaaaaggtaatgattcccgccacaaccggatcgagcttaatgccatgcgggaaaatacccggaatgactaggctcggcaagccaaagaaaacgataaacaattgaaccaacaaaggggttgaccggaaaagccagacgtaaaacgatgcaacgcccttagcgatgctgattaacacccctttacgtgccgagatccgtgttaaggcggtgattaaagcgatgatgaggccaatggcaaatgaaacaattgcgatcggaatggtgtatttaattccggcggcgaccatttgcggcacggcgtcagcgatgattttccacataatgttcctcctcttaagatacatgccggtactttccgctaaatgtcaagcagactgcatgctctcaagctacttttcttaacggcatgctctagacgaacgggcaaataaaaaagcatttccgcctctgtccatttttcatagacaaggacgaaaatgttccgcgttaccaccttgattagccgaactgatccggctccctttaagtacaacacaccacctcatgtgcgaataccctgactcaataacgggagcacccgtcagctgcttgcggtgaacgttcacaactgaatgcatgaaaagaccatcttcgccagaacccaatcattgtcttccaccaactgacaactcgctgcggatcttcgcctggctactcatctctctgccgctaagatattgacattacattaggctaaaaaacaggtgttgtcaatagggaacaacgcacaaactagacaattaagtaacgctttcgcttcgtaatcgtctggtaaatagcttgcgggaaaggccttatgtttcctgccaaaaggaagatggatcaattcactccccctacataaaacaacgaacgtaattgcaaatgcacaaattacgtccgttgtttgctaagtcaagaggaatcttcctagattatttttttatgaacgtaaggacgttcttcttatctgatttcatgcttccagccaagaacgcaatgatgacggcaatcgcagaaagcacaaactcaaagactgaccacttaaaaactaatgttaaaactaacagcatgatggctgcaattaacaaaacgccatccctggggcctaaattaatataaggatacatcatcatggaaaaccactcctttcgctgcccaactgaattagtcaacgttaatttagttataatttttagttacaatttcatcggcttacaaaagtctgggtgagctctttttcggtcaaagttttcgtgaatgcctccacactctcgtatcaacaattacaacctgagtgtaggcgtgttaacataatcagtcaacatttttatatgaagccgtttttgaaattccatttagcaatttaaaaaagcgctattccagactggaacttattttcaatatctcttgctttgtcctccgcgtctagaagtacattgcgttgttctgaagtgagctgatagtcatggtcacgcacctcgtctctgataaaataccctagtgcgattacttgaggggggaatgtttgcaccttgtattcgcttactagctaatttatcaacggcttgttttattcttgagataatttctttggatatctcatctgtttgcttctcaaaaagatgctgtagttccaacatttcagcaataatggcttgcttttcatccattctaagtcgccccttagaaacttactgaatagtgatagtgagaagatctaatctgcgtggagcaaattagttttataaaagtcttcattctagcgagatcgacatcacttggagtcaaaatcgtacttaggcgaggattatatcgtgatccgggacaggaacaagaggaggtgggaggaagccactgatatcgttactaaaccggcttgtggtagtaattgttcatagttcagcagcatcgtgtgctttcctcgtagctctttaaaagaaacgtttgaaagaatgactcttataaaagagggagtacgaggcgcttgagaacactaaacaaacacgtggtaagcgtttacccagttatccaagtaagtcatgctccctcatcttttctctgtcaagagaagacactcattaatacagatacggatgctatagtgcatcaatgacctggtgcatagtttttaattagtcgtcgatggtcggtttagcctttagatgatgcctgtacaaaaagataatagctagtagagcaccggttagaccgccaccaaaatgagtgtacgatgcaaggtctaaccatggatttgtcgaaagattttggtatgcacccaagatctgtgaaagtattaccaagacgagaagacctagtttgaatttgactttgctgaaccgtccaagattagttagtaagaatactattgtcgcaaagaagaacaaaccctcaatagccgtggacatgccaatactcccatctgtgtatccgaatgtcgtcaaaaatgaccaaatgtgaccgtttaatttgtacagacgggtaatgaagatgtctgccaataagtttccaataaccccggaaaagaaaagcaccatcaaatattgaagtctggtgatactggcagagatgatccacgttagaagtgctaatgggatcatatttcctgcaaagtggaaaatgtcttgatgtaaaaaaagagcagtaaataatcggtaatactgccccgaaagaacttcagtaggagagttgccacagtttgcagccaagaaaaccgatatagaggaactgaaaaactccagatatatcattccggaacagatgcctataatccagaaaagggggcttgtaagtataagtattgctttatttttcggttttctcatacttgttcacaccttctttcagcttttcattggcatacgttgtagacgaaaatagaagctagccgtctacctttttgagattgcgtcaggcttctttgtttgcttaagtttgagctttagggggttgatctactcgttagtttccgctttgaaaaatagaggtaaagtattcccaaaattccgccgaccaatcctccgccgaagtgtacgtaagcggttagtgtgaaccactggcccgcaataaagcctagaatcacggaaagaaacccgataaaagacaccaaggtgagggcaactagtctgaatattcttttaggaacgtcttttgttcctataaacgcaaaggtgagaaaagtaaaagtgaataatcctgttatggaagtagagaacccgacaattccatatgaatagcctatcgtcgttagaaattcccagtagttgccatttgaattattcaaaaaggtgatgaacaggtctgctaatagatttccaaatatacccgaaagaaataagactattaaatatagacctttgccaattattggggaaataatccaagtcaatacaactaatagtatcatattggagatcaggtgggagatgccagtgtgaagaaacaaggaggatagtaacctgtaatattgaccagacaatacaagagcagggacatttgttgcaaaattgcttatcaaaaaggcgttaaatgagctgctttcttctatataggtgatactggaacaaaaaagaacaatccagaaaagtggacttaagattatgcggcgcataagttgtatggcttgcttcatcatagctatctcctgtaagtaaaggtctgaagacgttgttataactaaaaagcagaatggacatttttttatacagggcaactcaggttttttaaaatcttgtggaatcaatgaaccataaatttccagagcaacacacgtaggggatgaagaatagcatcaagccagtagcgctcatgggagtgttacttccagcattataaagctgagtaggctgaattctgcctgtttctttgcttcatcaatggataagatgctgaagtcttcaattttttcgtaggtttaataataataccaattataattgtggctcttggcggcaggatacagcgcttttttagcaaagtcaagaattattaatcgttgaggtcctcctttttaaggggctaattcaccaataaataatttctgaaataatgctgaattagcatacgcctacagtgctagaatcatgatatattcagcaactgatccgttaaaaccttcattaagttttcatatcggtgataatagaagcttccatagctaagtaatgaattctattatgtcgttaaggagcaccatgagcgccaaggctactttcttttggcgctgtagaaccatgtagacgtgctgctattgtggccaccaatcctagtagtagaccaaccacacttccagctatgtgactataatcgctcaagttgaacggatctccgcctaagaatggatatgcccaagggattaagccgacaaataaccaaaacgtaaggttgaaaagatcagctttgcttttaactcgatctttttgcgtaataatataccgcactagtgtataaaacagaagaccgaataaagcggtggacatgcccactacatagccatttgctccgtcactcgtcaaataacttggaatcgtcatctggctgttaaccaagtaaataatgaacgtatttgctaacaggttaccaaccataccactgatgatgaagataatcagaaactcactgtatgtcgttacttttcgagtaacaagactaagcactataagcatgatgctgttagaaattaattccggaaagccgtagttgcttaagaataaacatgttaaagcacgataccattgtataggcgaggacatcgtgatgtttggaacgttggtaaagtttgcgatgctgaattcattaaaatcgttaagacgggtagtgagcccaaacactaaccacgcaataacaagaattagaagtgcaggattggcaacagttttcttcgtcattctttaaggcttcctctctaagctgatctattcggctcgttaaattctcgcattcagcatagcggttgacaacttagtcaaacagctttgcacgcgttgtgttaactcgccaatctgttcttcgacgtgaaattaatcatctcaacggcgatgttgggacgctcaacttacgcgctctctagttctaaagtccagtgactttatttcataaatgaggtatattaaatgcggagaagttatgtaagatgttaatgttttagtggaggataagatgaaaaaggcatgggtttacggcttagctgccatgcttggcttgggtgtatcaacggtgattggtaatcaggcgttgacgtttgcagcttcagcgccaccagttgcggtacaggcatcagcaccaagttgcagtagcacacaaccaaaagaagacagcgtgaagacaacggaagacgccaccgaaaagacgaccgatgatcagcaaccggtcatcacagtagctgacacggatgaaccgactgacagcaaggaagcttcaaaaagttccgtggtgacttctgacagtcaggacgacaaaaagtcatccacaagcaccgaagcaatcagcgggggctcagtaccaagcagcaaagtatcggaaacatcggcagacaagccaagcaaggtttccgaaaaaacagtcagttcaacaccgacgattaaaaccgagcaggaagtcaattcgctggccagtcagtcagtgacaaagccgacagcagaagaacaaaaagaacaggctgtggttgcagtagcgcaagcggcaacgcacgatgacgttaaagttgaccacgcggtgccggttgcttccagtgatggcaactactttaagccatctacatcaaatcggaaacatccacgtaccgctgtcgaactcatttggcaggcgttgatcgacacgttttcccagcggcagcaatgtccaagcaatatcagtgaccggctggttgtccatgaaccgaccgacgatcagggtattgtcaaaacatcattggcgctcatgaccaaagagctccacaagacgttttctgtcaaggaactagcgcaaaattttcaaaaggatattctgacgccagcgaatcgaacgatcaaagatgtcatcggtttacttaatcaggttctactgaagcacctgatcaatgccgattatcggtgaatctttgctaggctataatatagaagaaaacgtataaaaataaaggtgccgatcgcgcaaaacgtgatcggtaccttttcgattgcgacgaaacgtctgatcaagcagcttttgggtagctggcttttgggatgatcagtaagagcattgccgcttaattttgttcagcttgaaccttggctaaagccgttgcccgccgtgttttaacggtgtgggcgaccaagccgataaccagaccgacagcagccggaaccaaccagcccagacccattgcggcgaatggcaggtaatgtaattggaaactgtgcaaagccaggccaactgcgctttggctcacaactgccgggaatgcagcaaacatgtccaaaacagccggtactgcggtgaaggcaacgacgacgcggtaaacgaccggatcgtgatggaaggctttgccgaaaacagacatgaggatgaggaccattgagaatggatataggaacatcaacattggcacggaccaagcgatgatttgttcaagtccgaagttagcggtcaggaaggacagaaaactcgtcagtgccagccatgcccgataactaaccttaggaaaatgccggtggaagtcttgcgcgaatgcggcaactaagcccacagcagttgtcaggcaggtcagcgttagcaaggtagctaaaaccgcgtggccagcggtaccaaagtaataagtgaccacctgattgaaggcagtgccaccttcaggactcagtttgaaatgtgccagtgacatactgccaagcacgatcaatgcaacatagatcaaaccgataaaactggttgccatgacgccggccttggcggttgctttggcgacatggtcatcatttttcagccccaagccgcgaaccgccgtgacaacggtgaccccgaatgctaacgcagcaagtgcatccatcgtgttatagccttgcaggaagccattcataaagctgccgtttttgtatgcggcggtgacggtttgcgcagccggattgcccattggatgcaggtagccgacgaagaagacgaagaataagagcactagaaaaatcgggttcaaaactttaccgacagccgtggtgatcttccgttccttataggacaggaagaacgctgcgccgaagaacaaggcggagaaaacaaggaggccaccttgctgccagtcttttggcaacattggtaaaacgccggtggtgaatgagacggtcgcagtccgcggggtgccgaacataggaccgatcgttgcgtggatcagcaccatgaagacgagggcaaagacgccaccaagcggtcgtccgatatcataaacgccttccgcatgcgtggcggcgatggctaaaacgcctagtagcggcaatgcaaccgcggtgactaaaaagcccagcatggccgggaaccagttagccccagcgagttgaccaaggtgtaatgggaaaattagattgccggcgccaaagaagaggccgaacaaaagtgatgcaatgacgacataatcgcgggttgaaagttttttttcaggtaattccatttgagttcctccaataagtttaagtcaggcgttaattcattcataaagcgactaatgtgggtaatgtcagattccaattgcatcacatccttaattggtttgttgatctagttgctacgcgaaaatgcggacagattacggagatacaaaaagtcgcccttagatttaatctaagggcgactttgcgcggtaccaccttaattcaccaaagcatagagccttggccttcatcgcatacggtccgtagacgatatgctagcactgtaatgggtgctcccatgacacgttactgaaggttcggtgtcctgcttgaaagggatcttcatcatgtcctgaatgcttcctcacaccaaccgaagctcgctgaatccatgaacatcactacttgtctttcgcgttgcatttgtatttgattatgagtttaacacgctttgcttccttgtcaacaactaatctaaatttaatgttgctagctgggtcaaagaaaaactcggtggcattcaaaatagtgctcggtaaatctcgtgcgaagcgaaaattataatttttatataatgcaatcaatagatagctttggtaaaagttcattggtgcacaaattatactggttaaccgacgttcaaaatgaccaccacaaaaaatatcttttaatgggtttaataacgctgatttgatgaactggttaaaaacaaattgctaatgttgcttataaactcacgttaatgtaaatggcctaattttataaaaaacaaaatttcaaaaattccgtaatattgcccgtctgacggggctgattggctgatcgtattgtttgattaccgattcggcaaggtgctatattgatattagtaacacaggtaaagaaacttttcacaacacccatggaggtaaaatcgatgaggaaaattaattatattgtaactggtatttcggctttgacgttggcaggttgtctggtaccaacaggaagtgtgtttgctgcaaatgacacaaagacttctgtggcagaagttaatatccttcctggtgatattaacttggacaaggtgcctgatcttcactttggcacaatcaacatcggtcagatcacggcaggcaacgttgatctaaagcttgataacaatacgattgacgcaacaggtccggttaaagacggtaccaatgccatggacggtaatgctgacggcgaactaactgtgtctgataatcgtggtaccagtgcaggttgggctctgaccgcccaattaggcgatatgaaagactctgccggtagaacgttgaatgggtcactgacactcaaaactgctgacgtcacgacagataacccgaccctcaatgccgttaacccaacagctggaacgacccttgatttcggtggcggttcacttccgatctggaaggctgatgctttggcaacaggcacaaatgggcaagggcaaggtaagaacacagccttattaaagaagggcagtgaaacggttcttcaccttctcaaagatccaacagcaagcgccggccgataccaagcagcaattacttggacgctggctgatgcacctttgtaatttagtgttcaagctaaagggcggcggggcatccgctgtccttttttggcaaattgccgcgttttccggcgcaggagcttgcgtgtaaggaccttggccgcaatgaccaagttcgggtcatcacgcccaaggccgcttacactccagctcctaagcgcgccagctcacgctcagcttattaacgcgttcaccggcgcaagagcctacgtataaggaccttggtcgcaatggcctaagttcgggccatcacggccaaggccgcttatactccggctcctaagcgcgccggttcacgctcggagaggggtaagcatgaaacgaaaaattctatttggccttattgcactgctgggcatgttttggcttggcaatctgcatcaggttcaggcggctgaaggcgcaggtttcacgattagccccgctctgccgcaaaatcagattgacaaatccacgtatttcaatttactggtcaaaccaggcgaaacgcagcgattgctcatttacgtgaagaatacgagtgatcaggccaagaagctaaaggtcagcccagtcagtgcgttcacgcaaaataacggaacgttaggctactatcctaataacaaaaaggacaactcggccgaatacacatttgcccagttggcaagtgagccgcagaccatcgacgttccagccaatggccaagtgccggtgacttttgatgtcaaaattccggaacaaggctttacgggccaaattctcggcagtttgtacgttgaagacccgaatgtgcataaaagcggcggtggcggcatggcgattaataacaaatttgccatgctgatcggggtggttttgcaaacttcggaaaccgaagtggcgcctgatcttaagctcatgcaggttaagccgggcttgcaggacaaccaagcaggcgtattagcgaccattcaaaactttaagccgcgactgtttggtgacatgacgttagacggtaaggtgtaccggcagggatcgaatgaaccttatttaacccgacatgaaaaaggctggtcgtttgcccctaactcacattttgactatgccatttttaccaaagaggcgctcgctcccggaacctacaccttggatttgactgccaaggctgtcgggaaaacctggcattggcgccgtaacttcacgattacccgacaacagtcgaacgccatcgaagaaaaactaggccggacaccgcaaaaaacaccttgggtatggatcatcattgcgatcatccttgccgtggtgattctgatcctgctttggcttatttggcggcaacgacaagagagaggaagggagactgatggcgaaaagaaagcgtaacttttggttcttgatgctcatgatggtcggtctcacggcaggcggagccgcagcccataaggtgcacgccgaaacatcagtggcgcaagtcgagctcgtcggcgaattgccgtcaacgggaccggatccgacgccaccaccgaccccaaaacccgatccaaaacccgacccaggaaccgatccaagcggaaagccgagcggtggtgatccgagtgatacgaccgacccaaccgatccggctggcgcaaccgatccatccaatgcaggcgatccgcatggtgatcaatatggaaaaggacggtcaattctggactacagccgcctcccacaaacaggggacgctgttcaaccatggctgatcgtaatcggcgtcgaagttctgttgattgttatcttaagtgctgtgcttgtgcatggacgttcgcggcaaggaggtaaaaaatgaagaaaaagactttaatcatgatttgcctcgccgcagtgttcagcgtgatgcttggtccaatacaatccgcggcggcggcagctacttggccggttccgagcacttatccgtcaccgggcgaaggaaattttacgagtttgaacggtgttttttcaccagtcagcacgcaatctcatatgatttcaaatggtccagatgaagttggtcttgagctgaatgcaaatatagcaagtcagacagggagcatttggagtaaccacccctttgtcgatttagataaaagtagttttaagttggacatgcgaatctatttgggcaacaccacgagtggcgcggatggccttgcttttgcgctggcaggggataggccaaccaaagtgttgtcaggtggcgcgtcactcggcatctgggggattactggtaagaacggtggaaagccgattgatattgctacaaccggtttgccaaacagttttgcaatcgtggttgacaccaagagaagccgtgatggcctgattgtcacaacaggtatggatcaaagggttagttacccttggccgagttcatcagatcaatatattggctctgggtatcctggccaggcaagtatgtatgcaatcggttaccccaattataaaactgagcttgaattcaataacccggaatttccaaatgaagccaaagttttaagtggtaaaattactaacggcctatggcaggatttgagtgtggagtggcataagactgctacgggtgggaatttgatttatagattaagcgggacaggttttaatactgtcacgcgctcactcacatggaccaatcaacaaatcaatgacatttttggctataagcgccagttgtacctgggcttcacaagcgccacaggtgacgcctttgaaccgcacgtggtcgcaattaagagtttggccgattttatcaccgtcaagcctgaggtcacgttaaagcgtgaaggtcaggtcgtcggagaaaccacgatcctgcaacctggcgatcagttaacctatgattacaatcttaatgtcgataatcttgatggtagcccttggccaatgccgacaatcaccttaccaaaaggcgagtactttgattatctgaaagctgacggaaagccggcccaacctggcgacgagttggaagtgacattaaccgttgacggcgtcgcgggtccgaaagttaaagcgattgttcaggctgatcaaaagtcagccgtcatcactaacatgccggagttaccaaaaaataaaaacacgacggtaacgtttagcttacccgcccaggtaaagctgtataatctctccgctaatcaagcttttagtgatgatgccggaaccatcaatggtggctcgccagctaaggattacaagttgatcaatacggctgatagctcaaataagattaagtatgtccttggtgcccacaccggcgacctgtttttgacacatgtaccgggattcgttttcaagaagtatacgggcgggtttagcgatccgactgtcgcggatattattcgcggtatacccggagacaattcgctgccgtcaagccccgaagacttcaaaaagtggttgaacacgcttgaaggtggcggcaccgaggactatctcgaagtgcttgatacccgtcccgatcaaccggggtggcacctgcaaatgaagctttcaccgtttaaactggacggtggcgattatgttctaggcgacaacggcagtcaaaccggtggtaaggccgaaatcgtgctgatagattcaaacggcaccagtgaagttgcacgtgtgaaggataacaacgatacagtgaccgtcaaaaacatgccaagtgggggcggtacctggcaaattggtgatggtgcgcaacatgcacaagctttaatgaccgttaaagggacaccatccgtccgcgctggaaaataccacgcaaccgccacatggacccttgcagacgcgccagaatgatgcattaacggacaaacaatttcctaaaaccgcaaaaatgagttgaactattccgaaaatgagaatatgatatggacaattcttatttttaaatgttgagttgtcaggattgcggttatagaggggtctgctaatgaaaaaacatgttacacgttctcatttactgccggtcgtagttttgggcacactggccttcctgctagagttgcccattcacgttttgattgccagtttcaccggcttcctttagtcgatactggttctggtcaatcaacgaacaaaaaagagatgctgaaagtttcgggattttccctagacttttagcatctctttttgatgttcaggatttcgatttttgcaagagttgatgaatcaatcgtttttgcacgctctgaatttttttgaacggcagcgcctgcaacaaggtgttcaagacaatgaggaggccgccgagccattctgccggaccaaaggcgatgtgtaggcgagtgacggcgagggtagtggcggttaacggttcaaacgcgcttaacatgccggttgccacgggtgatatgtagttgaggctgccgagtaccagcagataagcgagcatggtgccgaagatgacgacaaacccaatcgcgcctagatctggtaacgtgagcattgggttaggatgcagcacgtactgaggcaaaaatggtaagctgccgagcaacatggaccagcccgtgaccgcccgcgcatcatatttggccagcaaggttcgcggcagcaacgtataaagtgcctgactcacgccggccataattccccagaagatagcggcaggggcgagctgtaaactggtgagatggccgcgcgtgacgagtaaataggtgccgatcagggctaaggtgatgctgataaaatcgatccgccgcggcatttgccgggttgtcagcgccatgtaaagcaaaataaatactgggcctaagaactgcaaaatggttgcagttgcagcattgccggcattaatggcaagaaaataagtcaactgggatggcaccatgccgaagaaggcaaacaaaatcataagaccagcatctcgccgatttttccaaagggccaaaaacgattgcggatcgcgcagagcactccacaatactagtaacatcccggcaaaaaagaggcgaatacccacaagccaaagcggcttaacgccggcattggtaaaaagcgtttgcgtaaaaataccgctggcaccccaaaaaatggcgccaacaacggcaaatgtaacaccttttatttttcgattcgaatcgttcgtaagatgagcttcagtgcgtggcatagcagtattcctttcaaattaagacatccagactactatacgcaaaaagaacctggttggctagttcgtgttattttgatcaaacttgacgtgtatgcatgcatgtctgccggcattttgctcgataaatccaaatcgcccctaaagacaaattgcgtctcaaggagcgattccagagtgatgttcatttttggaatgttaagaggttattctggctcggtgttgattcttaattcataatgcagattggtgcgataaaaatggcctagtagcaaaccgaacgtcaaacctaagagtgtcaaagccagtgggaaaatccagccggaaagaaagccgccaacgaaaataactatggccccgatgatcatgccgccgatgatgctgatcataccgatcgaaccgccgtgcacgttggcgttagctgaataaacgctggcaaatggaaactgtccgccaaccagtggccagcccataattaacgtgatgccatagatgagaacgatgatggcaacgccagccagaaatgcatccaagccgccaatagcggtcgtgacgatcgtaatcaacaccagtggcaacaggaataagcgggcaaacatggcctttacgacaccacgcagtaataatccgtgtgtggtaaatggcacatattgaaaaatcgccatggcttgtggttggcttgaaaaccgcagattaaccagcgccggtgccaacgcgacaacgattccgataccggcataagcaacataatggctcgcgtttgtaaaactcatctggcgtaattcattgctgacgatgaccaaaggcaagatcaatccataagccagctgtggataaacgcgcagcttgtagtcgcgttcattacctaaaacgcgccaacctaaagtgaaataagtccgctcttcgcctggtcgcgtcattaaggcgctgatgccacggaaccaccaaccgagtttgcgagttcgatcgttgccttgatttaatttttccaaataggtttcaaacgaaccggagaaatggaggaagactagggtcaagacgattggcatcacaatacttaagccagccaatgtcatacttaaggcggtcacttgtccagcaaacaacattggcaagccagcaaaccatgaaggaaatgccggtatgaaaatccaattaaacgaatcgctaagagataaaccaaaaaatgacatcgagcgcggcagtatattaggtaattggctgccaacatagatcccgatcattagcaaaatctgtaccaggtttaacatgtttcgcaaacgctcgccatcaaagaatcgcaaaactagcaggtaaacaaacaatgccatcatcagactcaacacgccgctaaacaccagcgcaattaagccgccaagcgctaccactggcccataatgcaagccgctgatgatgattcccgggccacccacggcgagcagcgtcatccccagatagtagcaaatgtttagaagacgggcaaaactaagcgtacggtcattgacgccgcgtgcagcaaagaccgtgcgatcacgcggatccaggatcaggctggagtaagtggttaaaatgactaggaaactgtttagaagctggatcgtcatgaacatggtaaaagttgtcaggatggaggtagggataagcagcaccaaacctaaaatggcgccaaccaaagcattccacaagaaagcatttttgaggcgtgtttccttccggcgtctgttgctcctaaacatgctgcctaagccgtttgtttcacgggcggctagcaagcctttactagcaagaatcagccgtagttggtcaaactgaatgccgcgtttttccaacgtcgggcggagacgcgtcaaccatccgaacgcttttggtaacggcagagcggctgaatcagttgtttcagaaacatcaggagttggttttttaagcatcttcatgcgagtcaccgcctgtcacgatatccacgaagctttgggctttttgaccatgttccgcaaaaccggtcagatcattgaagagctgttgcaaattggtgtcggcttccttggcaatggctttgaacggcccatctgccaccactgtcccggcgtttaaaacgatgatccggtccgacagtttttggacaacatcaagaatgtgactggaatagaagatcgttttgccttgatcgcgcaagtcctgaagcacttcttcaatgaccagcacagtgttagcgtcaagcccgttcaatggttcatcccagaataaaatgtccggattgtgcagcaaactggcaataatcagaatcagttgccgcatcccttttgaataggatgaaattcgccgatcaaaagcatcgcgcaagttaaccagttccgccagcgcgaaggccttttgctcggcatcggtggcgctcaagccgtaaagctggccaatgaggctcagatattcccgagctgttaacgcatcgaaaacatcggcactttccggcacatagccgattcgccgtttgtaactgggatctttagggctaatcggttggccaaataattcgagtgtgccgtcatctggctcaagtaggccgagcatcatcttaaccgttgtacttttgccagcaccgttgggaccgatgtaaccaacaatgctgccaggggtgatcgagaagttaagatctttcaatacttctttgggtccgaaactttttcgaatgtgactgagggtcacgatgggttctgtcataaaaatggcctcctcttgaccgagttatcaacatactgcgttgggccgattatgacagaaaatattattgttgtatagggaaatgcttgttgtataacgccgctaaaaaagcccataaaaaaacaccaagcgttctgcttagtgttaaactagtctgctgttcgccggactagtccaaaagaaattgcaataaaaaaacgaaagaaattgttcagctcgtgaaccgcttgaagagcggacgaaggataaaatacaatatcggcacgataaaggcagttgcaattgagttgatgacagttgccggaagactcaaaaaggcgccgacaatcgcggttttaaagattgtcccgaccatgagtgcttcaacgatgccagtgagataagaggtaacgattttcgttaacccggcaacgatgccaatgataatgatgttacgcggctgatcatcatgtttaaacgccttgacaagcgcactgacaacgattgccatcacgatcgcttccaagactgtcagccaagaggtggcggcatagccatttagcaagtcgaatccacccaagccaatcgctgctgctaagccgcctagccgtccgcctaaaaagagaattgccagcaccatcaagggattgccaaagtgaataaacggccgaccaaccatcgccggaatcggaatgcgcaatagtgaaatcccaatgtaaataattgcggcgaataagccggtgaaaatgatgtttttcaaagtgttatgtgatgtttgcatgttttaacctccaaaaatgagcgtgagcccgcgcggtcagaagccggagtgtaagtgggcttgggcgggatggcccgggcttaggccattgcgaccaaggtccttacatgcaggcttctgcgcgggggaacgcgttaagatgagcgtgagtccgcgcggtcagaagccggcagcacgctagcgtatttgtatgatctaaggcagttgcttactcaatgccggaatcaccccagcgagatttaacccgtatttcggatcagcatcagcagccaacgtggctttaattgccaagcgcgcggctaccatggcagttgccgctgcttgccgcaagcgctggcctttcagcaagccagttgccaaggccgcagcgaaaagatcgccagtgccaaaataatgcccgggttcttttggctgggccagtgccagcgtttctccagacgcatctatcccgacaacggcaatctgcttatggaacgggacaccagtgattaaaaccgcattgtggaactgggcatgcagccgcttggccaacgccatcacggctgacggttccgtcagtgccaccaatggttcgtctaaaagcagttgtgcttcggtgacgttcggcgtcaagaccgttgcgcggtaggctaactgctgcaacgtttcgacgtaggcggcatcaaaacctttataaagcttgccgtcatctgccataaccggatcgatcaggaccagcggcgcggaaaattttggcagccagcgttgccattgaagcgcggcattttggccaagatagccgagataaatgccgtcgggttgcagttgcagtcgttgccaatgggtcagaattcctgacatctcggaactcaggtcaagataagtattagcgcccagaccgccagtgtgacttgacagtaaggcggtcggcaacacatacggcgtcaaccccagaccggccgctaacggcaaagccacgcccatggaaacctggccgacaccgcacaaatcctgactaatgatcagacttttcgtgttcaaagtatgaatcctttctaaaagtataggtgcttaacaaagagcatgcgcaatttttaacgaactgtcaatgagcttttttatatattggcacaaactgccttctgtgcaaactaaaatggccctggcaccgcgccgggaccattcatattgaaggtatcaaaatcagttaagcattccgaattgtctttgtcgctgtggcaattcgtttaacaaccgtgggattgtccatggtataaatgtggatgccatcgacaccatgcactaataaatcaataatttgatcaatggcataagcaatccccgcatcgcgcatggcttctttgttgccggaaaaatgctgcatcatggcgacaaattttggcggtaaattgacgccagccattgtcgccatgcgttcgatttgatgctcgttgatcactggcatgatcccggcttcgatgggcacatgaatccccgcaagctcggtccgttcgcggaagcggtagaaaacctgattgtcaaagaaaagttggctaatcaactgactggctccggcatcgactttttccttaaggtggcggatgtcgctgaccacatctggtgattcgggatgtttttccgggtaacaggctgccacgacgttgaaatcgccgcgttggtgaatgtgctcgattaaatcgcaggcataagggaagtcgttgctgacgcggccgcttttgggaatatcaccgcgcaaggcgagaatgttatcaatgccggcttcttgaaaaccgcgcaattctgcatcgacctgcgcgcgggtgagctgggcagccggtaagtgggcgaccggttccagatcaaactcgtctttgatcagcttggcaacctccagcgtgcccatgtgtggcttattgccattcgcgccgaatgtgacggagacaaaatcgggatcggcttcttttactgcatcaagggtgttgagaattggtgtcagcgcaacgttgctggcatttttgcgcgggggaaagacttcaaatgaaatgacttgatgatctttaaagcactggttgattttcatgagtgagttccttacgtacttgtttagccgctgcaaccatgttgatcaagctggccttggtttccgggacgtcgcgcgttttaagtccgcaatcagggttgatccaaacatgatcagccggcaaccgtttcagaatttcgtggatgatgtgaacgatttcgtctttggaagggatgcgcggcgagtgaatatcataaacgccggggccaacatgggtttggaaatgagtggctttgagaatgtccaagaggctaaaatcggagcgcgcagcttcaaacgaaatcacatcggcatcgaggttatcaatcgccttaatgatgtcgccgaactgcgaataacacatatgcgtgtggatctgggtctccggtttcactttgctggcaacgaggcggaaggccggcactgcccagtctagatacttgggataccagtctttcttacgcagcggcagattttcccgtaacgccggctcgtcgatttgaatgattttgatgccatgcttttcaagatccagcacttcatcttccaacgccagtgcaatctgctcaacgctggttttttggctcaaatcttcacgcgggaacgaccagttgtagatggtgaccggtccggtgagcatgcctttgacgaggtgatcggtttgactttgggcaaaaaccgtttccgccactgtaatcggcttggtgcgcacgacatcgccccaaatgatcggaggtttcacaccgcgagtcccgtaactttgtacccagccattgtcggtgaagcggaagccaccgaagttttcgccaaaatattcaaccatgtcgttgcgttcaaattcgccgtgaaccaaaacatccaagccgattttttcctggaatctgatccagtcgacttcttcttgatgattgaatgccgtatattcggcttccgtaatttcatggcggcggaacttagcccgattgcgccgaacttctgcggtttgcgggaacgagccgatggtggttgtcggcagtagtggcaggttgaattccttagcctgaatcgccagccgggttttgcgatcaggcgtccgcttatagtcttccggcgttagggcagcaattttggcgtttaaggctttattttcctcgtaacgtggcttgctgaataaggcgacgttggcctgataagcttcatgatcggcaccggtatgaaaaatagcgtccagttcgtgcaactcatttagtttttcttcagcgaaagccaaatattgcttttcttccggcttgagatgcgtttcgttgcgtagggtataagggacgtgcaatagcgatgtggaggtgctcaacacaagcttgtccgtgatggttgacagctgcttaatcgttgccaaagcatcagcatagtgcgtccgccagatattcttgccgttgacaataccggcaaacaaggtgacgtgcgccgggaagccgtgctttttcagcagatcgaggttcgcatagccttccacaaaatccaggccgaagccatcaaatggcagttcggaaatttgttcaaacgaatcggttaaatcaccgaaataagtctgcaccagaattttggcggtgttcttttgcgcgagaatcggcgtataaagccgttcaaacaatgccaagtcagcatcggtctggtcataaaccagtgccggttcatcaagctgaatccattcggcaccggctgcgtgtagccgctgaatgaccgtgctataagcagcgattaagtcggccacgaagtcatccggagtgacatcaatgaagcgcgacagtttcaacaatgtgtacgggccgattaaagtcggccgcgccgcgatgcccaaatccttggcttcttgatattgttcaaaaagttgccagtccgtcacttgaatgtgcgtgtcgtggtcaaattcgggcaccagatagtggtaattggtgttgaaccatttcttcatggcaagtgccttaacatcaccggcatcgccttgataaccccgcgcctgggcaaaataggtatcgagaggcgacaggttcaagtccaaataccgctttggcacaatattcaaaaggttggcaacatccaaggtgttatcgaagaaagaaaaatcgccggtaggaatttgatcaatgcccgccgcctgaatggtttcccagtgctgctgacgtaatgctttggctttttcctgcagctcctgtgccgtaatctggtgcttgaaatacttctgagtggcaaactttaattcgcgatgttcgccaattcgtggatagccgatgatggttgttgtcataataaaacctcctgttttaggcataatgtcaatcagtccaatgatgaattgaagaacacttgctaatgatcgaaatgaactgtcgaaagacgtggcttgtatttgcacgcggagatggaaaccaaaaaagccgtccttgacccagacaaaaaatgtctaggccaaggacggcttaccgtggtaccaccttggtttaaaagtcgctcacacgactttcctcaatcagtccgacagccatgctgtgagacctaacgcaataatgggcgtccccatgtgtgctttgctcgcgctcgacacacctgcatcaccaagaccatattcgtcgtcgtttccagatgcccttgcaccaaaatggacactctctaggcaggaaatcgccaactactcatctttccgcatttcaatgttgcgactagcatactgacaattatggcagctgtcaagatatttattaaattaagatgaagccttctgtggctgttaactcttagcctgttgcgaaaacacctgttttattctcattatttcgtaaataatggcgcaggtttgttaagatgacaataccagcgtcatgcttacccttaagattgcgcagccgcggcatgaacaagaaaagtcaaagagcgttaacactgacttgtttcaaattttagggtaagctattagcacaagtcatcggaggaagaatgctatgaaagttttggttccatacattaagaaatatcgctgggacgtgatctggtcaatcctggctatttttgtggtagcgttcgcgacactttggcagccgcatctgcttcaggtgatcatgaatgccattatgaaaaatgacaaacagaccgtctggaccaatgggctgtatttgattggcctcgcggtgatcgggattgttggcgggattatcaataccatctattcggcgcgggtcgcattaggtgtggccacggatttgcgagctgatgaatatgccaaaattcaaagtctggcttatgccgacatcgaaaaattctcgccatcaaatctggttgtgcgcatgaccaatgatattaatcaggtgcaacagattgtcatgggcttttttcagcaagtcacgcgtatcccgattctgtttgtcggcgccgtgattcttgcgatcgtgaccttgcctgagttgtggtgggtgattgcggtcatgatggtgctgctgctgggggtcagtcttttttcgtttagtcgcatgggcaaatattttggccggatgcaacagctgattgaaaaagtgaacaccttggcgcgtgagaatttaatgggcatgcgggtggtaaagtcgtttgttcaaggcgccaatcagacaaaaaactttgcagaatcaagcgacgagatgcgggatgtcagtgtcaaaatcggtaatttgtttgccttgttgatgccggcgtttttcctgattgccaatttagcgattgccttaagtatctggctgatcggccagaacattacgagccatccaagtaacttggcggcgattaccagttttatcaactacttgatgcagattctgttcgcgattattaacggaagctttatgctgacattcgcgtcgcgggcgctggtttctttacggcggatccatgaagtcatggacactaagccgagcatgacctttgtgagtggcccgcatcgggatctggacggtggcgttgaattcaatgacgtgacattcacctatccgggggatgaaaagccgacgattcgcgatatcagttttgcggttaagccaggtgaaatgattggcattgtcggggcgaccggcagtggcaagaccacattggcgcaactgattccgcggctgtttgacccagacaccgggatcgtcaaggttggtgggcatgatgtccgcgctgtcactgaagctgatttgcggcagacggttggttttgtcttgcaacgatccacgcttttttccggcactattgcggaaaacttgcagcaaggcaatccggatgctgatttagcttctatgaagtgggcagctcggatcgctcagtcagctgagtttattgaacgtttgccgcacacctaccacgcagaagtagaagaacgatcgtcaaacttttcaggcggccaaaagcagcggctttcgattacacgcggggtcatcgggcagccgaagatcctgattctcgatgatgccacctcggcgttggatgcccgttcggaaaaattggttcaagaagctttagcgcatgaattgaaaaacacgacgaccattatcatcgccgaaaaaatcagttcgattatcaaggccgatcgcattctagtacttgatgaaggtcggttggtcggtagcggcacacatcatgaattggcgcaacataatgatgtttatcgcgaaatttatgcaacccaaaaagcattggaagagggggtgtagctcatgaaagacttaaaaaatgcgggtaaattttatgcccattatttacggccttattggctagagtttttgatcacgaccattttgatcgcgatttccacatgggcgattgttgttgcaccgacgtatatgggccgcgccattgaggaactgactgtctacgttcagcaatgggcgaacccggcaacgcgtgggcaagcctcttttacggcgtttaaccacaccctagccatttttgtcctgctgtatttgatcgatgcctccagtattttgatctcgagcctgctgctgtcaaaagtcagcggttattcgactggcaccatgcgggtgggtttgtttcggaaaatgcagcgcatgaaagtgcagtattttgacagtcatagtgacggcgatattctgtcgcggtttaccagcgatttggataacatttttaatgccatgaaccaggcgctgatcgaaatattcttaagcggtgcccagtttattgggattatctggatgatgttcacccagaatgccacgttggcgtggatcaccatggcctcgaccccggtggcgattggcttggccgcgtttgtgatgcaccaggcaagtgtgtcggttgatcgccagcaggacgacatcggccgacttaatggttacatcaacgagcaaattaccggccagaagatgttgattaccaatggcttgcagcaggaaagtgttgccggcttccaaccgtataacaatgcggtacgcaaatctaacctgcgtgggcagatttggagtggcattttaaatccgttactcatggggctgtcgttgctgaatacggcgattgtgatctttgccggttcctggctggcgctaaacggctcactgagtcaaggcgcggctttggctttggtggttgtgttcgttaactatgcgcagcagtactatcagccaattgtgcagctgaccagcctgtttaacatgattcagctagccattaccggtgctcgccgaattaccgaagtgcgagaacagccggatgaagtcgatccgaaaaatggtcgcaccctcgatggtctgaaacacgagctcgtgattgataacgtacattttagctatattccgggtaaggagattctacacggcgttacgatccatgttgaaaaaggcgaaatggtggcgctggttggcccgactggcagcgggaaaaccacggttatgaacctgatgaatcgtttctacgatgttgattccggctcgattacctttgacggtgttgatgtgcgtgaatttaaactcgcatcgctacggcaaaatgtcggcattgttctgcaggatccgcaactattttccggtacaatccgtgataacattcgcttcggtgatccggaagccgatcaagcgcgggttgaagccgccgccaaacaggccaacattcatgactttattgtgagtctgccggatgggtatgatacgttggtttcggatgagcaaagcgtcttttcagccggccaaaaacagctcatgtcgattgcccggaccattttgaccgatccgcggttgctgattcttgatgaggcgaccagtaacgtggatacggtcactgaagccaagattcaagcagcaatggataacgtgattcagggacggacgagttttgtcattgcccaccggttgaagacgattttgaatgccgataaaattgtcgtcctccgcgatggcagaattattgaagaaggcaatcacgaacagttactggcgcaaaatggcttttatgccgagctataccataaccaaatggtgtttgaatagcggtccaatagattacgaactatttcgggacattttttaatataattcgtatataaagcgatttagaggcctttctaaagcttaaaacttgtgatagtctttctatatcagaacaatgctgatcattgttttgatcaataaagacttcgtggaggtagcgatgagcaaacgtaggtatttggtcgctttaggcggtattttgctgcatttgatgattggttctgtttatgcatggagcgtgtttaccggtccgattgccaaacagacaggatgggcgttgtcctcggtcacagtcgcgtttagtattgccattttctttctgggcatgagtgctgccttcatggggcgggtggttgagcgctttggcccgcggttgaccgggacagttgccgcgattttatacggctcaggtattttattaaccggcttggcggttcaaatcgattcgttgccgttgctatatctgggttacggcgtgatcggcgggttaggtttgggtgctggctatgtgacgccggtttcaacgattattgcgtggttcccggataatcgcggactcgcgaccggaatggcgatcatgggctttggctttgccgccatgttgactggcccggttgcccagcaattgatcgccgctatcggtttggtcgccaccatgtatgtgttgggtgcggtttatatggtgatcatgttgggagccgcccaagtgatccgcaagccgcgtccggatgaagtgccggctgccgatcttgccaaaagcgtgagtttgaccggtaaggcgatgaccgccagtgaagcagttaaaacgccagcattccgctacttatggctgatgttctttatcaacatcacctgtggtatcgggcttgtggcggttgcgtcgccgatggcccagcagcaaaccggtatgtccgccgcgaccgccgctatgatggttggggttgtgggtttgtttaatggttttggccgcttggcttgggcaacgttgtctgatttgattggccggccgctcacctatacgttgatttttgtggtcgacgtcatcatgctggtcggcattttgaccgtgggctccccgttactctttggcattgcgttatgcctgattatgtcttgctatggcgccgggttctcggtcattcctgcttatcttggggatgtctttggcaccaaacagcttggggcgattcatggttatgtgctgacggcctgggccgctgcgggaatcgttggcccgacgctgctgagttttagcgaagaatattttcacaattatactgttagcttgatcctctttgttcttctcgaattgctggctctagggctgtcgattcgcattcggcgggaattcaaagcaactgcgcaggatgcgaagcatgtgaccgactaacggttttgtctgcgaaaagatcgacagagagactttaggatgaatgaaaaacattttgacgttgatgttttgctggtgatataaacgccgtctaatgtggatattaatatatcagaaccccgtatttaggtacgggatttttttatgtctcaaaatgctgatatgacaacatttttagtttatgtcacatattattgaccaaatccaagcttcttttgttgacaaacctgtacgtacaggtaaaataagctctgtaagtgaaatcgctttctggagggggaagaaatgcgtaagtacgatgtcatttatcaggatctgaaggacaagattgaagcagagatttatgtaacgggatcgttgctaccaagtgaacggacgttgcaggaaatgtaccaggcgtcgcgcgacacggtacgaaaagcattgcagctgctcaaagacgacgggtttatccagtcgcaaaaaggtaaaggttcaacggtgattaatcggcaggaatacgtttttcccgtttcaggagttgtgagttatgccgaactggccaaacaatttcacttacagacgcgaaccgtcattttggccaatcattttgcaacgttaccagccaagtcgtttaaggacgtggatccacatgtgacgactaaacagatgcggtttttgaagcgggtgcggtatttgaaaggcgagccggacatcatcgatatcgattaccttgatcctaaggtggtgccgccgattccggagtcggcagccaaggattcgttgtatgcctatcttgaaggtcaggtgggattgaccattgcctatgcgaccaaggaaatcacggtggaaacagcaaccgaagaagatcggcggtacctgaagttaccccaagccgcagtggtcgtcgtggttcgcagttgcagcagtctggtggatacgacaaagtttcaatacacggagtcgcggcaccgggcggatcggtttaagtttcatgattttgcgcggcgaatgcggccgtgaatggtggcaggtcgagcttcagttaaaggtgaagattaaggaggtgcatgatgggatttcataagaaagtcatttatcagctgtatcccaagtcattttatgacagcaatggcgacggggtcggcgatttgcgtggcattattgacaagattgattatcttaagtcattgcacgtcgacatgatctggttcaatccatttttcgtgtcaccacaatacgataacggttatgatgttgccgattatcgcaacattgatccgcggttcggtacgatggcggattttgacgaattggctaagaaactcaaagaagctggtatcgatatcatgttggacatggtgttgaatcataccagcacggaacatgaatggttccagaaggcattggctggcgacaagcattatcaggcctattattatattcgcccgccaaagccggatggcagcttgccgactaactgggaaagcaaattcggcgggccggcgtgggcaccgtttggcgacaccggcaattattatctgcatttatatgaacgccgccaagctgatttggattggcacaatccagcggttcggcaagaagccgcagcgattattaacttttggcgtgccaagggtgtccacgggttccggttcgacgtgttgaacgtgatcggcaaggcagaaaaactggtcgatgcaccgccagaggttgccagcaaaacgctgtacacggatacgccgatcgttcaggactatttgaaggaattggctgctaacagcttccgccaagaccctaacagcgtcacggtgggcgaaatgagttcgacaactgttaagaactcaatcgcctacacgaagccggaaaatcatgagttatccatggtctttcagttccaccacttgaagacggattacaagaacggtgaaaagtggacgaaagaaccgtatgacttcaatgcattgcgggacattttgcatacctggggtcaacagttggatcaaggtggcggctggcaggcgctgttctggaataaccacgatcagccacgagcactcaatcgttttggcaacgttgacaagtatcgggttaaaagtgccgaaatgcttgctgcggcgattcatctcagtcgcggcactccatatatctatatgggtgaggaaatcggcatgaccgatccgcactaccattcaatggctgattatgtggatatcgaagccaagaatgcttacaaggcattgctcaaggaaggtaagtcggaaaaagaggcgtttgccatcattttggcgaaggcccgcgataacagtcggacgccgatgcagtgggatgattcggcgaatgccggttttaccaccggcacgccttggttgcggccgacgaatcaaaaagacatcaacgtcaaagatgagttggcgcacggtgaaattttcgaattttatcaaaagctgattgcgttgcggaaagaatacgacgtgattagtgacggcagttatgaaccgtttggaaccgacattgatcgcttgtatgcctatgaacgggttgctggtgcggatcacctgctggtcctgaataacttcagtgacaaggcgatcacagtaccgctgccaaatcgattccaatccgcaaaagtgcttattaccaacgaatcaggattaataccaactgcaacgatgacattgccgccgtacgcgacgattgcattgttgacatcggaagagaattaaggaggaaccaaaaatggctgatgaaaagaagctacacattttggcgcctgtttcagggcttgccatggcgattacagacgtctccgatccggtcttttcacagaaaatgatgggtgatggctttggcattgaaccatcggatggtcagattgctgcgccggttgacggacgcatcatgatgattgccgataccaagcatgcaatcgggattaaagccgatgacggcgccgagttgttgattcacttgggcattgatacggttgagttgaaaggtgcaccgtttgaaatcgatacggcaatggatgccaaagtcaaagccggcgacgtgattggctccatggatttggatgcaatcaagaaagccggcaaaaagaccacggtcattgttgcgattaccaataccaatgacgtggttgatcatcttgatgtcaccccgggcgaagttaaggttggtgaagaagttgccgtgatgacacctaaggcagcggcggctacatcaacaaccgcggccacgccaaataagaaggaaagcaagtatgcggcgactgcccgccagattattgccgatgtcggcggggcgcagaacgtcaatagtttgattcactgtatcacccggttgcggttttatctgaaagatgaacaaaagccggacgatgacacagtacgcaacattccgggcgtcattgatgttgcccgagcaaacggccagtatcaagtggtcattgggcaagccgtcactgacgtttatgatgaagtcattaaacagttaggccccggctactctaatgctgaaggtactgcggaagccattaaaaaaacccaagcagaggctaaagataccagcttctggggcacaatcaaacgttggacccaggcgttgatcgggacgataaccggatccatgattccggttatcggactgttggccgccagtgggatgctcaaaggtgttctcaacattatgactacctggttccatctttcaacaacggatccgacatacgtgattattaatgcgatgggcgatgcagccttttacttcctgcctgtgatcgtcggtttcacggccgcgcaaaaactcggttcggatccggttatcgttggcattatcggtgcgttcctgatttatccatcaattgctaagattgcaacggccggtaaagttagtggtacgttactgggcatgggggtcaatgccagtttcttcggcttacctgtccacattgcgaattacacgtattcgattttcccgatgatttttgcggcatggatggcagccaagcttgaaccgtggatcaagagctggatgccgctggttctgcggatgattttcacgccgctggttgaaatcttcttagtcggcatgacggttgtcttggttgtcggtccactgatcacggtgctgtctggtgcgatcacatccgggattcaggcattactcagcttgacgccaatgatttccgacgccattattgccggtctgtatcaggttctggttatcttcggattgcactgggcggttatcccggttattaccgcacaattgtcttcggcacacccagagtccgtgcttaacggcatcgtctccatttctatgattgcccaaggtgccggcgcgttggctgtctgggttaagaccaagcacaacccagcactgaaaggtttgtctatttccgcgttcatcagcgcatgctgcggcatcaccgaacctgcgatgtatggtgttaacttgaagtatggccgggtcttcgtctttgctagtatcggtgccgcaatcggtggcgttgtcaatggcctgttaggtgtttcgatgtacggattcactggcagcttcattggttttccatcatttgctgctccgggttgggcacacaatccaggcaactttgccggattctggattgcttcggttgtgaccttggttgccgcctttctcttggtttacttcttcggttataaagatgccgatgccaatgcggctaaggcagcacctaagaagaagcgcttaggaaagacagttgaataatgagttaaggcttcactgaaaagtggttcaaaatgataatcgtgtcattttggcgaagaatcaaagtctagaagtctagtagttaaaacaccgatgtcgttgggcatcggtgtttttgcttggcaaaaaagcgaggccgatcatgattggagaaacgccacaaaaatttgtgccaatttcgataaaaataacttgcagttgcggcagaattagggcacactaaaaagtgttctcattaaacactaatttttcatggaggagggccagatatgtataaacggtacaaagatgtgtcgctgattctgaaaattgtcatcggaatcgttgttggggcagtgttaggggtattggtaccctcctggtcctttatcgatattttagggaagttatttgttggggcgttaaaagcaatcgcgccattactggtatttctgctgattatgtcggcaatttcaaaataccgatccggctcgaagaaccactttggcaccgtgattgtgctttacttaagtgccacgttgctttcgtccattgcggcggtcgcggtttcttatcttttcccgatcaagcttgtgttgccgggtgcgatgaaaattgccgaaagtgcaccgaaggacttaggcacggttgtttccgacttgctgaccaatgcagtggctaatccgatttctgcgctggttgaaggcaattacctggcgattctgttttggtcattgctgattggggcggggttgcgtttggcgagtggcacaaccaaaaaagcggtgaccgagtttgcagaaaccgtcagcagcgtggcccaaacggtgatccagtttgcaccgttcgggattgtcggtttgctgcatgaatcactgagtaagacaggtgttaaaggcgtcatggcgtatgggcagttgctcatcttgttggtcgcaacgatggtatttgtctatctgatcgtgtatccatttatggtatggctgctaactcatcagaacccttatccgttgacgttttggacgttaaaagtcagcggcattccggcgttctttacgcgtagtggcgcggtgaatattccgatcaatttacaagcttgcgaagacttaggcttgaacaaagaaagctatgcgatttcgattccgctaggcggttcggctaactccggtggtgctgcgatcacggtgtcgattatgacgctggcaactgccaacactatgggcgtgcacgtcagcattttcctagcgttgctactgtgcttcctgtcagccatttcggcaaccggggtgtcgggaattgccggtgggtcgctgttattaattccaatggcggcatcgctgtttggcatctccaatgacatcgcgatgcaggtggtcggtatcggcttcatcatcggggttgttcaggactctgtggaaacggcggttaattcggcttctgatctgttgtttaccgccactgccgagtatgccgatgatcgccgtgacggccacccgatcgatatgcgcgcggcggttagagccgcgggtaaagtgaaagctaaagctgctaagccagttgaagaagagggcgaacagatttaatttgcttctgtacttccggtttgatgcacggtgccacgtatcaacttagtcacttaataaactaatgaaaactgcccaagagacgaaagaagtcgcttgggcagtttttgccttttaaagttggtgcattttttagctgtgaaatgttgatttaacaagcaaattgtctagcttaaaaaattgtaaggttatttttcctatgataactgatgtcattaaaaacacagcgctttccagctttgctaaaatgtgctaacctagttttcatggattttttattaacacattgaaaagacagcattaactgtttaatggaggtaccgatgggcaaagtgtggcaacgactgtttcgaaaagaggatccaagtgtttacgaagataaagattcgcatctgccgcgggtgttgcgggtacgtgactttctcgctttaggggtcgggaccattgtgtcggcgtctattttcacgttaccaggggtggttgcagccaaacatgctggtcccgcagtctcgatttcctttttagtcgctgcgattgtagcagggttggtggcgtttgcgtacgcggaaatgtcggccgcgatgccgtttgctggctcggcttattcgtggattaatgtggtgttcggcgagttcttcggctggattgccggctgggctttgttggccgagtactttattgccgttgcgttcgttgcttcagggttatccgccaattttcgcggcttgctggcgacgatcggcctgaattttccggcggcgttggccaatccgtttggcactgacggcggggttgtcgatctggtcgccgtggtggtgatgttgatggttggcgttttgctgtcacgcggcgtttcaagtgctgcgcgggtcgaaaacattttagtggtcatgaaggttttggcaattttgctgttccttgtagtcggcttgaccgcgattcatccggaaaactttcatccattcttcccgaagtatcacctgaatgctgatggaacaccttttgggggctggcaaggcatttacgccggcgtttccatgattttcctggcctatatcgggtttgattcgattgccgcgaattcggctgaagcgatcgatccggagaaaacgatgccgcgggggattcttggctcgctgttaattgcggttttcctgtttgtctcggtcggcctcgttttgttgggtatgttcccgtatcaggattacgccaacaacgccgaaccggttggctgggcgcttcggcactccggtcatgcggtggtcgcgacggtggtcgaaagcattgcggtgttggggatgttcacggccttaatcggcatggccatggcgggatcccggttactttacagctttggccgcgacggcatgttgccgcacggtttgggcaagttgaacagccgcaagttgccgaacattgccttggcagtcttaatcacgatcggtgtcattatcggggcattcttcccatttgcgttcctggcacaactgatttccgccggcacgctgattgccttcatgttcgtcacgcttggcatttatcgcctccgtccgcgtgaaggcaaggacatcgccaagccacgcttccaaatgccgttgtatccggtattgccagccgtagctttcctcggctcgctggtggttttcctgggtctggacattcaagccaaaatgtactctggcgtctggttcctgatcggatgcgccatctacttcttgtatggcatgcggcattcagcactgacaaaagggtcggttgttgagcaggaaaccgaagcattggagcagtcaaaagaagactgagtggtttaaagacacggtctaaattaacaagaagcttcggaaatgactttctccgaagcttttttgatatcatcccaggcatttcaatttttgagtttttagatcactgaaaattatagtatcggagtggatcaaagggagattttcgcaggagcaaagacctggtttttcattgctgctatctgtgctcacaagctagtactgatcaataagctagcttagatttgacatcccatccgcttaatttcaacgataatttttcccccgtgtagtctttaatggcagttgagtctgggaagcaattttgttaagctgtcagagaattggcaagtaaattgccacacagaaaggacaaattttatgatggatattgtcatcagcgttgctacgtcacaggaggactacgcacgctagttctccgcgtttttaggaggacatttaatttgacacttagcagttatggttcacaacaaaccacccaacctgaacgcggcttgaccttagcccgtgtgataaccacaagtcatttaagatacacaatcgtcaccgatagtgggagatatagcgctcaagttgccggacggcttgccaacatggccatcgcaccggaagattttccaacagttggtgattgggtccaagtcagactccctgataatagtgaagatgtggcgattattgagcgtttgaacgagagaaagaccgtctttttaagaaaatcagccggaagaaaatcagacgctcagctggtcgcagctaatgttgactggttatttttatgtatggcgttagacggtaacttcaacgttcgcagaatggagcggtatctagccgttgccgcggcatcaggcgctcattttgcaattgttttgacgaaagccgacaagtcaattgggtttgaagaccaattaacggcgatatcggaaattagtggggctcaccggatcattgtctgtgatgcaaccacccctgatggtctatctgagctgagagcgtttatggaaccaagggaaacctatgcttttctcggatcgtcaggtgttgggaagacaacgctgatcaatcacttacttggtagtcagaaattagaaactaacgcagtgcgccaaagtgacgctcacgggagacacacgacaacttctcggcaattaatgttgctgccaaacgggagtatcgtgatcgatactccaggaatgcgagaactcgggctactggacgccgatgttgaatcagcatttgccgatattcaggagttatctaagcactgccggtttaacgactgttctcatcaaaaggagcctggatgtgcggtccaacaagcagttgcagaaggcaagctatcggcaatcagagtagctagttatctttcgcttcaacaagagaaatctgagcataatgacttacgtggcagagaaagagaaaatgcaaaagttaagcgaatgtttggtagcaaaaatcaattgaaaaaattcagaagaagtgtcaagaaacgctaacgttgtgcttgatttagttcattgagcagatcggtggttgacacctatcggacaacttggaaacaggctgtgatgggagttcaaagtaacgccaaaagcttcggaagtttcattaaaaacgcccgcaaagattttgtctttgtgagcgtttttaatttgcgttgatttatgagtggttactaagcttcctgagccttctggagattctcttttaaaatcgccgcagaatctgctaggcgcttatgatcttcggcattcagatcaagttcgataatgcgctccaaaccgttggcgccaagaatgacaggaacaccgatcgaaacgccgcttaagccatactcaccttcgagatgaacggacatagcaaatgctgcgcggtcgtcatttaagaaggcactggttaaccgggtcagcgaagcagcaatgccgtagaaggtggcgcctttcttttcgatgatcccgtaagccgcagttttcacgcgctcactgatttcggcaaggtcgctttcctgacgattcttaggaatccagtcaagaattggcttgccaccaatattggtgtaatcccaaaccggaaattcagaatcaccgtgttcgcccatgatatagccgtgaacgatgcgggcatcgatgttgtagcgcaagccgatttctgctcgtagtcgcgccgaatccaacgcggtgccggagccgagtacttgattgcgcggtaaaccggattcctgcaaaaccaattctgccagcacatcaaccgggttggaagccaccaaaatgaaaccattgaagccgcttgccatgatattgtgggtgatttctttcataatcttggcgttaatcgctagcaactcaagtcgtgtctgtcccggcttttgcgcgatccccgcagtaatcacaataatgtcggcatatttgcagtcttcataactagccgcataaatattcttttgcgatgtgtaaggcagtgcgtccgaaagatcttcgacgtcgccttgtacccgtttttcattaacatcgatgatgcccagactctggccgacaccggttgtgagacagttaaacgcgtaacttgacccaatggcgccgtcaccaatcaaaataatattgccgcgattttgcattccaaaattcctcctcataatgatattgacaccaacgtagctatccgaagctgaacaatgaccgtcacccaacaatggtcatggtcagctgtttttcatgtatccgatttcattgtaacagatgacagttgcgataacttgataaacgtgattgatgagttgaaaattagttcgcgctcgcgcggtaacacgttcgccagcccagaaacctgcacataaggacctcaagtaggaatgaccaaagcccagccattcctacttgaggccacttatgctccggtttctaaccgggctggctcacgctcaaaaaattcttatcattttgccatttttctgttaaccttaaaacaacgtccgttacgttttttgagaaaggtggtttcccatgtcagcagcatcttatgtgcagtcagtgcttgcaacgcttaagcaacgtgatcctaaccaaccggaattttttgaggcggcctcaacgcttttaaacacgattacgccggtgtttgagaagcatccggagtatgtgaaggccaatattcttggacaattggttgaaccggagcgggcgattcaatttgccgttccgtggcaggatgaccaaggaaatattcaagtcaatcgcggatttcgcgttcagtttaattcagcgattggtccttacaaaggcggcctgcgactacatccttccgtcaatcttagtattgtgaagtttttaggctttgaacagatcttcaaaaacagtctgaccactttgccgatcgggggagccaaaggtggttccgattttgatccgaaagggaagtcggatgccgaagtaatgcgtttttgtcaaagtttcatgaccgaactgagtaagtatatcgggccggatttggatgtgccggctggggacattggtgtcggtgcccgcgagattgggtatctatacggtcaatacaaacggttaaaaggggcgcaacgtggcgttttaaccggtaaagggctcagttatggtggttcgttggcgcgtacggaagcgactggctatggtttgatttactacaccgatgaattattgaaagccaacggggaaacgctaactggcaagcgtgcggtcatttccggtgccggcaacgtcgcggttcatgctgctgagaaagctgaagcactgggtgtcaaggtgcttaccgtttccgattcgaatggttatgtggttgatgaaaacgggattgatgttgcggtggtcaagcagatcaaggaagtcgaacgcggtcgtattaaagcttatgcggatcgagtggctggagccgaatatcatgaaggttcagtctgggatgccaccgatcttaagtttgatctggcattgccttgcgccacgcaaaacgaaattgatggtcaacaggcggcgcggtttaaggcagctggcgtgattgcggttgctgaaggcgccaatatgccgagcaatccggacgcgatcgctgcctatgcaaacgctggaattttatacgggccggcaaaagctgccaatgcagggggcgtcgctgtttcagcgctggaaatgggtcaaaactcccgccgcgaaagtgacagttttgaaaaagtcgatagccaactgcatgaaatcatgcaacacatttttaaggcgagtgccgatgctgctgacgaatacggcatgcccggtaactacgaagcgggagcgaacatcgccggtttcctgaaagtggcagatgctatgtatgcgcaagggatgtaggcaattcgttacgatgacaagaggtgaaatagtggatttaaagcgctgagtttccgcatgcctctccattgacgagatcaaaagcacgaaaacaacggcggtcggataattatgaggttatctgatcgccgtttgttttatatgtgagcgtgagtcaaaaaattatcaacagagcagccgtctataaaacggtacttggcatcaaaccctgttctttttctacatcaaaagccgcgccactgacggatcaagttcaatcagttgcatgagccgacgagctggcccatttggtttactgcggttcgtttcccaagcctgaacggtacgaggagaagccgccataatttgggcgaagacgagttgcgttgccgggatttgctgccgaattttcttgatttcttcgccggtaaactcaggcggtgttggtagatgtcgctcatgccgttcaacgccaggatcatttccgtctaatagctgattgagctcttcaacacttttttcgagtgtacttttagtcatgttattcaccttttttgagacgttgaacaacttttttcaacgctgctgcttgcagaaataaggcggatcatgaaatcaacgccattactctacgttgctacgtttttatagtatacgattttatggtatgtgtcgactcatattatccattttgcgatgcttaagcacgacgcacgatgaagccacaatgacaaattcctagaaagagatgacggcatcaaaaaaaggctcggaatttcgagcctttttgctacggtgacaactaaaccaccatattggttaattcgatggcaacctagacgcgactaatcgtgatagacgccctcggcccatttttcgttttcttcatcaaaaaagtgcggattatctttttgatcagggtttggtttggcaatgtggtcaatttctttgatcagttccgcattttccggcgtttctctgtaggtggcatccagataggccttgatgatatcgtatgccagatgttcaccaatgctggcaccgccgaagcccaatacgttcgcatttaattgttcgcgagcatatttggctgctgcggcgtcgttcaccatggcagcgcgaataccttcgtttttattggcggccatggtaatgccgctgccatcgccacacagaacgatccctagatcagcacgaccatcggcgacatcttcagcaaccttcttgccataaattggatagtgcgtccggacggtgtcgtaggtgccttcatcaataacttgatagccagcatgctttaaaaaattcgagatcttaatcttcatgtaagtcacaatatgatcattacctaaagaaataatcatggggtcagacttcctttcttccagagttagatcattttcgcgagcatatcgagccgaacttggtggcggccgtcaacgtattccgcgtccaggtaacgttgaatcaggccaagcgcccgatctaggccgataagtccagtaccgatcgcaatggctttggcaccattatgttcagcagtttgatgcgcagcggtttcgtcaccgacattggttgcgaccatacccttgactttggtagaagccattgttgagccaacgccgtaacggtcaaacatcaagcctttatgcgccttacctgccatcacttctttggtcacagccaaagcagactcgacaaagttcttcgctggttgcggcgttacatcaatgacatggtagtcgcgctgcttgagatagtccttgacctgttccttcatggcaaaaccgtcttgatcagcaccaatcacaacatccaaaattgtcactcctttgttttaatgaatagcatttgtgactcagatactggcggggcaagctgatcgttttgaagaaagtcagtgggggagagcacccgaagaaaaaagttacaagcaattttttgcggaatgtttatatttgtttctgtgtgttcacttatgtttcattcgtcaaccacaatgtagcatcgaatctttttagtgtaaaggcctaaaatacagtttctagttagaagaggaagttttagcacgtcttaagttgatggaaaaattgaattgggctacacgtaaaagtgtgatgtggtttgattcgtttactgggtaaaacattgtcatcagagtgatcggtaatttgccaactaataaaatcaagttgctatgcgcattggtctaggctaatcgctgtgctgacaagcctaattttcttgtaagtgagcgctttcagcaaattaattgcggttaatttgcaaaaaaaattagtttttttttgccggacgtgttatagtctattcatggtaatacttgaacgggaaacatcatgtaacatgaatttcctttttaggattacggttgtctgttgttgttagttttgaaaaggagattcactttcatgcaaaaaggtacagttaaatggttcaacgctgataagggttacggcttcatcactggtgaagacggccaagacgtctttgtacatttcagcgccatcaacggcgaaggctacaagagtcttgacgaaggtcaggctgtttcctacgatgtagaacaatctgatcgtggccctcaggctgctaacgttaccaagctttaattcttcttggttcgttaaaaaagagatccgctcgggaaactgggtgggtctttttttgtgagcgtgaaccagcgcggttagaagccggagtgtaagtggtcttgggcgtgatggcggtctttgccattgcgaccaaggtccttacacgtaggcttctgcgctggtgaacgcgttatagaacgcaacagtcaataaaatgccattgccaccaatagaaaaccctgcgccttactcaaagctccatgacacaaactcaccgctccaacgtcaaccgccacacactcgtcaaaacccagcaagcaaaaggcattgccgcaaaaaacaaaccaatgaaaataatccctggagcatcgccacttttcgcccacgcataagaaagcgacagactgatgacggccacaataatcgtgatcacgccgagaagccactgcaaccgccggaccaaatgacgagccgcttgcggtgcccggactaattgccatagggtgacaacgcaggcgaagataccggcaagcgtcacccacccgccgatcaaggtgatgatgagtgcagccgtgattcgggacgtgagcactaataaaatggtggcccagacgccagtcgccagaaaagcgatgctgcctaaccacatacaaagcaccaatcctaaatgatgcgttgtttgtccgttgccttgcttgatcatccttaccatctccacttatggtcaagtgtaacgcgcacggtggattaaggttttgagatacaggattcttgacggaaaaataaaaaaagtacgccagaagtctcggaagattcggcgtacttttttgcttaagcgaatgtagacgaggaacaaccgttaccgctcattattcacctaacgtcggctcatcggtgaactcgtcaacaattcggaagctgacattttcgttttcttttaacagtttagcgactgggcactcatctaatgcctgggtcacaattttttgcgcttcttcgcgtgtgtgacttggcatgagaatttgcgcgtcgacaatgaacttgtagccgattttgtcgcgctcaatgtccacccgggtgcgtagttgcgaatcttctgcagtaccttcacgatgctggacgatgcgaatcgttgcgttgaaacaagtggacagggcaaatgcaataaattgctctggattggtaccaggagcgtccagaagcgaactggaaacaccaagagctaacccttgattgccttcgacataactttcaccgactaaaccattttcgttgcggacataggtatgatacaaagatcgttctgccatgctatccatcctttcttgttttgaagctttcaccgtgagtataccatggaaccgcttaatttgcgggcaatgtgtctcggatatcatgccgggcggctccgtttctgattaggttagtggcgtcaggcggacaactttcgtggcaattttattgataaaatgctcatcgtgttccacaaacagcatcgttggttgataacgggtgatcgcggccatgatctggtcttgattataagtgtccagataattgagcggctcgtcccaaatatacaaggaggctggtgttgcaagcgaacgcgcaacttcgactttcttttgctggcccatactaaggtgttcgatcggcgtggcaaaatcggcgcgcggcatcccgagcttacgcaagttgttaagcaaaatttcgaggttgaggtgccgcttttcggcaaagtccggcagtaacccgcgattgtcagggtattgctggcgtaccagactcaaagcaaccggcgccaaggtcagaagcccggtttgattgccggtaaaatggcccagcaaagcacggatcaacattgatttaccgctgccgttttcaccgacgatcgccactcggtcgccgggttgcaacgtaaatgaaattggttggaaaagcggctgatcataaccgacctgaacattttcggccacaatcaaatggtgatgatgggttggttgtggcgccatggtgagtggatcgactttctccaaatttttaagcaactgttcttttgccgcaatttccttatccatgcggtgttccaggtttttgctttttttcatggttcttgctgcccgggcgctgatgaagccgcgggtattattgtgcccgctatctttctcgtggcgattgccgtaaacgctgcgttctttgttttccgcccaaacttttttgtcatgggcggtttgtttcaatcgattaatttcattttttagctgagcattttgcgcgagttcggtttgatcctgccgctgcttttccgtggtaaaggtggtgtagttaccttggtaaagcgtgattttctggcgttcgatagccagtgtgtggtcggtgacggcgtcaagaaaatctcggtcgtgactgaccacgatgaagccggatttttgttttaggtaggcagcgacttggcgacgactgcgcaagtcgaggtgattcgtcggctcgtcaatgagtgcaaagccatcgtcttggatgaagagcaaggcgaggcggaccttggtttgctcaccgccagatagatctcgaaacggccgccacaagatatcagggtcggcatgcagcaaattaagttcgcgttccagttgccattgcgccacgtcttgaaaggcttgtgctgcgtgaagtgtcagttggctctcgtccagcgcttgcggaaaatagcgcaaaggcacgggaaccgtaatcgttccgcggtaatccagttgctgctgcaataaccgcagcaacgtggttttaccgcgtccattacggccaaccaagccaaggtgccagccagtatcgaggttaaacccggcatcgctgaaaagtggcgcctggccgtcataggcaaaataaaggtgtttgatttgaatcgttgacatacagccacgtcctttcgcggatatgcctgtgctatcagaagaaagatcagctgactttttgagttttcgggattacagcggtgggaagcgacatcgtaactgacaacgcttggcaattcattcccaactttccgtaacgcgttcaccggcgcagaagcttgcgtgtaaggagcttggtcagtgcatcacgcccaaggccacttacactccagctcctgagcgcgccgtttcacgctcataaaaaaacagccccaaaagaatctagggctgaccaaaataagcggagaatccaccattgatcaagcccaattgtcaaaaagtccgcactgaccccgttgctgagaacaggacttggacattttcaacaattggcttacttcaatggacagacctcactttcggtttaacgttgcttttaaattagcacggctgattcggttcgtcaacttttaacggcttcagcgattggcgtgttgccactggcgattttgatcgtttcgcgatggcggttgctgtctaaagcagcgacgaggacatcagcgacatcggctcgcggaatggtcgatggccgttgcggttgcagcgtgatggtgccttgcgccggatcgttggtgagagcggttggctggacaatgacatagtccagatcagtgttatgaatcagccactcatcagcgtaatacttggcgatgtaataatcgtgcagctcttccggccatcttgcgggatcctcggcgtctaacgcgcttaacatgatgaagcggccaacatcatcggcttcggccgctttcatggttttaattgcaccgtcgagatccacgccgagcaaatcctttccccgtgacccggcagcaaagataacggcatcgtggccggcaaaaagttcagtcaaacgtgagaccggccatgcaagattaagttcgactgcccgaaaatttttctgcggatcaggcgtctgggtgagcggatcgcgataaccgccagttacggtatcgccgcgatccaatagtttgtgcaccaaaagctggccaatctgaccatgggcaccgacaacaaagattttcacaacaaaggtcctttcctggaaaatagttgttatcagtataacgttttttattgaggcatgaaagcgctcgccgaattttttagactaagcgacgctcaagaccggcagtgtgctaggtttaaattatttcaagcggaatatggtgacgcggtgccgggaacgcttggtcaaacagcgctagttcatccggcgtaaatgtaacgtcggcagctgcgatattttcggccatgtggctcgcttcgccggtacgcgggatcgacagcacatcaccattacgcagtacccacgccagcataagctgatgggttgaaacgcccttggctttggccagatccacgagctccggggtcaacttgattgacttaccactgccggaaccataaggcgagtagccaatcgtcgtgatgccggcttgcttttggcgtggtaggaggtcatattcaatgccgcgtgattgcaaattgtataacacttcgttagcgacaacttgatcgccaccgggttccatcgtgagctgatccatgtcgtcaacatcaaaattggaaacaccgtattggcgaatcaggccttcttttttcagttcctgcaggccttccagggtttctgctaacggggtcgccccacgccaatgcagcaagtagagatcgaggtaatcggttttaaggcgggacaggctattggtcagcgccgtccgcatttgctttttgtctgcatgggacgggtagaacttggaaatcaaataaatctcactccggttgtaatcacccagaaaaccgccgatcagggattccgcagcgccattcccgtacatttccgcagtatcaatcacgttcaagccgtgatccagcccgtattttaaggcttcggtttcacgagcactctgcgcagcgttgccttcgcctagataccaagtacccatgcccacaattggtaccgtgacgtcgccaatattgatcgttttcataaaagcaaccttcctttcttcctacaagtccattatacaaactagtgaagaaataaaaacatgatcggaaaaatggaacaaaagatgagaacgcggcttcttttaaaagtgaaaaaatgcaaatttttcactgcctaaatcgcactaattcttagcgatgatcgttatcatgctcggctggcggaagttttttcgccccggtgcgatagtggaaaaagtagtgcaggcagacgagcgtcaagaagatgacaccgactaacaacgaaatgctggtttcgggattgagcaacatgaaaaataaagcgaacgcgaggaaaataagtgtgagataattgctgtaaggtgcgaatggcattttaaaaggatggtcaggcattttatcggcgtgaaccttgcggaagcgcgtttcgctgacgagaatgacgacccacggcaccatgcctggtaaaacgctggagctatagaccagcacgaaaacattcttggcggcaggggccacacaaggcaataaggcgtttaagatgacgccaagtaaaatgccggcgccaacggaaacgaccgggtaaaacggcacgccatgacgattcagtttggtgaaaattcgcggcaattgtttggcatcagccaaggtatacagcatccggctggcagaatagatgcctgaattcgaaccagacaaggcggccgtgatcacgacgaaattaatgagggatgccgcaaacgtaatgccgattttggcgaaggtctgcacaaacggtgatcctagtgtattgagctgatcccacgggtaaatggccacgatgacgaaaatcgcgcccacgtagaagatgaggattcggccaattgtatctttgaccgccttaacaatcgtcggcttgggattagccgcttcgcctgccgtgatcccaatgagttccacgccttggtaagaaccgagcacaattgacaaggcgaagcagaaacccttaaagccgccggtgaagaagccgccgtgggtccacagattactgatacccacgggatggccgccattgccaagaccgaataaaatgacgccgagtccggcaacgatcatcaaaataatggtaacaactttgatgagtgcaaaccaaaactccaattcaccaaacattcgcaccgaaatcagattggctaaaacaaggaaggtgatcgctacgagcccaggaagccatcccggcagcccgggccaccagaatttaaaatattcaccaatggcaatcatttctgacatgcccacgaccacaaattggaaaatattactccaggcggtcagatagccgaaaagcgggtgcatgtattcgctggcaaacttggcaaacgagccggttgccggatcgacatacagcatctcacccaaggcccgcatgatgagatagagaaaaagaccggcaacaatatacgcaatcagaactgatggcccggtccatttaatcgttgcgccggcacccatgaacaggcctacgccgatggtgccgccaagcgcaatcatttgcatatggcgtccgctaagttttcgttgcatgttgatccccatttctttcatctagtggcatacagaaaaagactatacaagaaaagtctagtttgcgcaaacaggtgaacgcaaaatgcagacatttttgaaaccggcatgtactacatttgtaagtataacgcttgctgttccaaatcatgttcgttcgtcctcgtttgcgttaaactagtaccgaatcatttaaatttaagtaggatatgaggaaatattttggataaagataataagttaaaaacatcattaaatgcttatatggcaaagcaccaactgaacaccaacgccacatccgttgccatcggcgtatccgtgccgacgttacgcaaagccttgcgtggtgaaaaagtcagccgcaagacgactgctaagattgagagcatcattgcatcaggcaaagtgccagcaggtgcagctacttccaaaacgacaaaaaaaactgttgccaagaaaccagcagctaaagtagcaacccgtaagaccgctgcaaagacgccagctacgccaaaagcagcagctaagcgaacttcaaccggaaccgttggacgtccggcacacagccaagccaactcaacaagcgcatcggcaaccaatcacagccagtcaacgacccaatcggctgctaacgcgcaggaaaatgcggcaagcgcccaaccaaagcgtcggacgacaacgcgggtcaatcgggcaactgtgacagcgcgccaaaataaccgaacaaacaatcagcatcaaaaccaggcaactaactcagaagcatcaaccgagcagccgacaacaaacaaacggccgtcaacccggaatcatcgttttaccattcgtcagcagccggatgtggcaacacaagaggctcaggctgaagcaaagaagcgtcagacgcaaacgaacagccagtctgctgcggcttcggtgaaaccggccgaaagcgatgaacggcacgaaacaacggcgcggcatactaaacagcacacgccaaccggtaaaactgagacgttccggcgtaatggcaagtctgaacgtgaaccggttcgcaacgaacggcgtaatgtgcggaccgatcgtaacaagccaaatagcacccgacatccggggcggcctaagcagaagcggtttgcggctaatgccgatccgcaaaactggcagccaatgacgcaatcggcttctaccagtgcctcgcagtcaatgaccagtcaagacgcaaccaagcaacatgtgccggctgtggtcaataaagttgaaacccatacgccaagtgtcatccgctcttcgtcaaatgagcgcaatggtgtaaatggtgcaaccgcaagtagtacgagcaacaacacctctgcgaccaacgccaccagtcagcggaatcagcgtgccagttacggcatgcacactgaagcaccattggtcaccgggaagcagttgcagctgttcatcgatgaaagttttgaagaacggcggccggatccacggatgatgcatatggggattgcagccgttttcccggaaggtgacgatgaaagtcttgccggttttcgggatgcgctttacccgtatggttgggaacccggcgatgaagtcaaggcacgcggcaaacaagtcgatgcactgacgcagttaattaaagcagcgcaacatgagcatatggggatgtacacggtcttttcacgcaaaacgacttatcctgattttgcgccgtcaatggaatatctctatccgtatatcggggcaacgattcatgtgctgcgggatgtggataccacttttgacagtatcgtgattatgattgatcatcgtaacgagctggaaggcaatcagctcgtgatgggggccgatattgtcagccgctatctgacgttgtcactggagcggccgatcaaagtgcgcttcgagtttgctgattcgcgtgaacatcttggcttgcagttgtctgattttgttgccaatgcagctttgcgcttgagtcacgatgaacttagcctgattggaattaatccgatgcctgagcttggtgtttcgcagcatgatcaacttgtgcgcctgacattgcttggattgcagcaagtcgtcatgggcgttcgcgcagagcgggccgcaaccccgtcgaagcactcacagcctgatcgatttatgcaactgattttcgatgccacgtatgcggactcggatcgggttcgtggggcgttgccggtggtaaaaaatgctttggaacagttgatcgatgttttgcctaatgctcgtgtcggtcagatttccggcatgccgaatcagagttggtacgacatgacggcacgaatggctggcctgttgcggtatatcaataaggatccgaagccgtatggtaaagttttggcgaaaattgaaagtgttgccaagaccgctgcggatgaactcgaaatggcgttggattctgactcaaaagctaagcgttaaagttaggctaggagttttatgccgtgccaaactacgcaatctccggccagctggggtggcgacgcgaagctagaggagtgggcacgacttagagcctctgcaaaagcggcagagtctctaagctcggccttgttgtaggcggggcaaaaggcgccccaccaacaacaattttctaccagaagtcaagtctcattcattaggtttttcagtgttcttgcggttttcttgtggcgtatcgataacgccatgatcta

SEQ ID NO: 300 - DNA, 128195 bp, Lactobacillus casei
ggcgttggcttcacgctcactctaacaaaaaaagtgatagatattgatctggcctgatcaatatctatcaactaagttagtctatttcactcctgagccccatctggcctacgattgctccgctttggcactacaaaagtgttcagtcgcctttatatttcgattgtgaatatagaccttgaatcatttcgtagttacgataacaattcacagtcaccacaacagcaaaacggtttcggaaagatgatgataacctcatctttccggaaccgtttttgtgtacgcgcagtcacacgatgaaactatcctgatttttcagataggtaatttcgtcaaatgtgatgcgggtttgcaggcgttgcatgatgtcgcggcttagcttgccgtctgcgaatgcttgctggatgaattcatattcggcgtggaaggctttgagaaacatggcatagagaatgtcgccgtcgaaggagtcggagtgaacccgacggtggcgatcgcggtagaagcggcggatggtattgacggcgctgcggttttgcgcgttttcgatatgcgtcagatatttcatcaccgcatcataccccgcctgctcaattggcagaagatcctcaccatgcgcggtaaattgccgcttccaaaagattggctcaaggttaagcggcgtggtcaaaaaggcgttctgggcttcattaaacgccttgtacatgcgccccatgttaaaggaaaagcgaatccgcaaaaagagatttttccatagccgctgatcagccgtgaaatcattgaggtcgataaatcggttataataatgtgcctcgtcctgcgtgatcgttccattggcacgtaaggcttcaatcgccgttttttccgccgtaatggtgccttcaaaaatgcttcgctgcagccggcgcgatgggttgtcgtttagaatcatttcctgcgacaaggcatcagcgacgatctgggcctcactgtgatgttcggtttcgtcgcgcatggcatcgatgccagccgacaacatgcggcgcaaccagatatattggcgattgcgcttcggctgttttggcacgcagaacggtaacaccaccaccggcacgatcaggctcagcaggataaccaccgctgcaatcaggattaacccctggcgcaacgcaaattcgtgaccgttaatcgttcgtggcattgaaaaagccaatgataacgtgatggttccgtttgcgccgcctagcatcatgatcaaggcattgcgccaccgatttttcttgccgatgcgtaacagcgtgcggctccagaagaagcgaaccagtgattttgccgcgtaaatgaaaacaccgattcccacgagcaaactgaataagccggcttggccgcgtaaggcttcgatgacaacattcggtaacgataagcctaacaggacaaacaccaacccggacaaaaccgccgcaatcatttcccagacattggcgctgatgatctgcatgcgggcgctggtcagccgtaatcggtcacgctcaacaccttgcgcaattccggccgccaccactgccaaaatgccggaaagtgccagctcttcagccaaaaaataaaccaataacggggtcagcaactgaatgccgaccataatgagcggttcgtcgtcaccgatccggattaaccacgcccggagattgacgatcagggtgccaataatcgcgccaactaaaataccgccaaaaaagacaaacagaaaatccaataacgcatcggttgccgagaacctgccggaaacataggcggaaagggccaggtcaaaggcaacaatgcccgctgcatcgttgaacagactttcattatttaacagctgcatctggctgtcactcaaaggattcgtctgcgcaacggcactgactgccgatgcgtcggtaggcgtgacaatggcgatcaaggcaaatgccaggctgagtggaataaccgggaaaagggcgtggacgctaaagcctaaaatgatgaccgaaaacaacaccaaaccaaccgctagcgacacaatgtttgttaaagaccggccaatctggagccgtgatgcgttttgaccttcgttaaacagcaatggggcaatgatggcgaaggagaaaaccgatggatcaatggcaaagttccgcaacgacggcatgacggccaacgctgcaccaaggccaatcaggaagaagggtagagggatcttagggatatggcgggcaagcagattgccaacaatcacggtagccaacataatgccgaaaataacaacctgactcaaagcaatccccccttagagcgtgaactggcgcagcgaacgcgtttcaccggttgacccgattcgatgcctcaattctaacaccaaatttataaaaacactgactgctagctcgttgcagtggatgtcggatatcaggtaaacaaaaactgcagtatcttagcgtcaatataaggattttggtgcaaactactgtggtaagctccgatcggcgttccgcggtaaatgtaaagtgatgtgggaacgccggctgctttaagctcctgttcgtaccgcttgacaccggcaaggcttaccgcccagtcgccttttgccccgaaaatctggctgccaatgacgagggtttgaacggatttaggaaaatgtgccagttgcgacgtgggatcacgataaaattcgctggcaaacgagatatatttgaccacttgcggttggacatcggtgtgttgcgtcgtcagataccgaaagctgaggttactgcccatggaatggccgacgaggttaactcgcttaacctggtgtttggtacgcagccaatgtagtaaggcggtgagttgccgggtttctttgaccggcgccttggcatcttcaaagacaacgctgataagcggattttttccgtcatagcgcttggcacctgtcaccgtgcgttttccggtggcactaattttaatggtcgtgacttgattagtggcgtgatccttctgaaaccggctgaccatgggcccaaatgtcaggctattactcccgtagcccggtatgaaaaccgtgacgacgttggtattgcgataagttcgggcgtggatcggtcggctgccaatttgccaccagaaccaataaccgccagcggccaacaagaataagacgagcacagtttttcctaaccaatgatgacgtttcttcgattgtttgcgcttcatgatgcaccagcctcctgagcgttagcatggcgagtgaactttaataaaaaagttgagtatcgcaattttacaatgacggtaccaagctatttcgatccttgcaaaaatggaccatgtaaaaccggacgatcgttgcgggcctgaagctgtcgatgattgtccgggaaaagttgctgaaaacgttggcgttgttgaggactgatcgtgacggcggtttgatcgatgacataccaagtgacgccttcagttagcggtggtgtggtcagtgaaccgaggtaacgaaagaccgtcccttttggcggcaataaactgtcgagttgcagtgccactggctgcgagctttgggccacaaaatgatcaagtacactgtccattaccggcatgccatcgcccaacggtaataaaaccgccacgacgcaaagtgcgccaatggccgactggtgtacaaaatgccattctgcggcacgttgatttgcgattcggtgttctgccggcacatgcagatgcgcctgaacaaagcgccactgggtccggtcgatctgcgtaagcccatgtccggctaagcggatggtaacgtggtcgtcaatttcctgatccaccagccaaggctcctcaatggttaacgttgaaggatccgcagcggttgcgtcacgcaggtcaatcggggactgttgctggccaaaaccattcggccaagtatcctgatggtgatagtctaacggtggcatttcgcgataattcctttcgtcgcatcgaatagatgaatggtttcaaaaacaggccctgccaaagcaaaacctgtttttcctcgtgagcgaggtgagttggattgttagtgagaggtcagactagtcgagcagcttaaccgccgtaccatacgccacaacgctttgcatgtcgccgccgattgacccggagtcaaaccgcatcatgacaacggcatcaccgccaactttgcggacttcatcgcgcaaccgctcgatcgacttttcccgtgactcatgcagcatgttgctataagctttgatttcaccgccgacaatattctttagccctgcgccgatgttgctaatcacgtttttagactgggtggttaagccgaaaacctcgccaataatttcgtaatgcttaccgggaatgttctcggtcgttgtaatcagaatatcttgtgccacaataaaacccgctttccttattgaaatgaatgtcagaagattcgttttagacagttacgatttaagtacatcgttatgctgtcgagtgtccataaccagcatcagattaccacccgtgtatggagatcacaagtaaaatagccgtttaagcagcgtagcagacattatggtaaagaacgatgcttagatgctaattaacaaggtcactatcgtttaatgctaaaaatacattatttagtgagaaacaagttttaaaaaaatgaaaagtttaaatgttaatcaaggaaaatggcgttgtatcgaaccttaaaagcacctttatatagtaaatagtaatgattactagttcgcaaaagggctttttaattgactttagaaaaacgataatgatataaaatgagtgtcgatgaaaatactaaggtaatgaaagaggaggacttttaatggcacatacgattgcagaagtagatgctcaacatcatcacagccttgcttgtggccacaccaaactattgcacggtgatcacgttgattatctcgaaaatggccatcttcatcacccccatgaagaccattttgatgaggctgtgattcccgtatccgccactaatcctgatggtgaaagtccgattgttgaaggcgagttgcatgatcaatattgcggccatgaacaagtaccgcatggcgatcacattgattatttggtgaatggtcgattgcaacatgttcacggcgaccatgttgacgatcatgggccggtggatgttgtcaattgatatcaggttcaaacaagttgcatactaaaaaccgcggtttgtgtgaccgcggtttttttaatattcgctcgtctggatgatctaagcaccacttctaagttaacggtttgatcatcaggacaaaaccgagctggattatttagaaaccttaatgacaattcgaccctcatggcgcggatcatctagcagttgatggcctttgataaaaccttcgcgggtaaatggtaacacgtagccgacttggacggtcaatttgtcttgcgccattaaatcaacgagcgtttgcagcgcccgaccaacttcggagccgccaagtggtcgcgtgtgtacgaaccgaacgccgcgacttaacaagggttcagtgtggctaaccgaaacgatcagcccaccatccttggccatttcaacatcatcatcaccgccaagaccgttcatcgccgcattgatgacgacatcagctgttttgcgcagctcatcgacggggttgccgcgatcatatgcgacaaaatgttcgaccccgaggcggttgacctcggcttcatgccgactggcggcgatgccgatcacggaggcaccacgcgcaaccgccagttgaatcgcggctgagccgacgccgccggaagcacccttcacaattaccgtatcgcccgccttgattttaccgagttcgaccatgcgataaccagtgacgccaggagtaatcaacgcaacaccggtttccggagtgatggtagctggtaacaagacactcatgtcagctgctgccgtcacgatttctgcatacgcgctggtggttcgggcaatgacgcgatcgccttggctaaattgcgtaacccgactgccaattgcgcttacgacgccagcaacatcatagcccggcacagtcaagccgctgccgcccatttgccgtgcgatccgatcacggttgttaaggccgattgcttcggttttgatttgaatttcccgcggacccggttgcggtgtcggcaattcaatcgcatcaatgacttccggaccgcctgcctcgctaaatccatatccgatcatatttttccctccatcatgttggtgagcgtgagccggcgcggttagaagtcggagtgtaagtggccttgggcgtgatggcccgggcttaggccattgcgaccaaggtccttacacgcagacttctgcgccggtaagcgcgttatgccaatgttaaactagcggcattttaaccatgattagggaaaaagacaattaaagtgccttgaagtcgtggaggaaaagtgaacggttacagctggtgtcctcttagtcaaccttttaatcgtaattcaattagcgatcatcttgatgcggccgcggatcaaagccatggagttgtcccttaaactcatccggaaatgaactaaccggcgtgtggtgttcccagctagccgcaacttcttcatcaactggctcggcgtgctcactgtagtccaagcccattttttcggcggcaggggatacgcggatactgacaaatcgggataatataacagtaatgatggtgaccattgccccgaccaggacgatgacaatcaacgtgccggctaactggatcagcagcagatgccagccaccgttataggccagaccggcgtgggagatgttcggcgcgacctgcttacttgcaaaaacaccggtcaggatgctgccgacaatgcctgccacaccatgacagccgaatgcatccaaggtgtcatcgatcccgaggcggggcttgattttgctaataaaccagtagctagctaacgttgccaaaaccccgatgcaagcagcgccaaaactcgtgacatagccagttgccggcgtgatgccgaccaatccgcacaaagcgcccgtacacgtgccaatcaaggttggatgcccagtttgccagatgtcgagacacatccaagtgaccagtgcagccgccgcgccgaccgaggtggtcaaggcagcggtcatggcagcttgattgacgcccagcgcagacccggcattaaagccataccagccaatccataaaatcgcggttcccagcaacacccatggtcgattataaggaaccgtgtgctcgtcagtccggcgcccgagaaacgcggagagggtcagtgcggtgatccccgcattgatatggatcaccgtcccgccggcaaaatcgagaacgccgagacccgccagcaaaccatcaggactccaaatcaaatgcaccagcggataataaaccagcaatgaccacaaaacgatgaagcaagtcagaaatttaaaatgcatccgcccgaccaccgcaccgacaaacaaagccggcgtgatgatcgcaaacatcatctggaaaagaatataaactccggtcggaatccgcgcagccgtgaccgcgccaagcgaaatatcactcaggaaaaaatggtgcacctgaccgatgacgccaaatagattaccgttaaaactcagttcgtaaccaacggcgacccacaataaaatggcaatgccggtgatataaaaaaccgaaagcatggtattaatcacgttgcgtttagaaacaagcccaccataaaagaaggctaggcctggcgtcataaaccaaaccagcacacttgcaatgatcacaaaccctgtatcggctaaattcatctgtgccaccccgttcatcttgaatggtggtattgtagcacgggtttttaccgaagcagggtttcaccggctagtatttatctagaccaatgttcgattaaattatatgtttgccgatgttaaaggttttttcgggttgcaaaaaattattttctgcgttaggttatgtgacaccagaacttgacggttgatggggacaattgattttcgacacattggtctatataaatttgaggtaaaagaacgaaattgctaggaaagtggctgggacataatttaaaatggcaatataaaacgaacatactccattggtgagctgtgagtatgttcgttatttgtttcactaagagtaattcgttagggacatcgctatgtcagcgccaaagcggagcaatcgtaggccagagggggctcagctgtgaaattggccttaaacgggtggttttcccgttttaggccaaggccgagctttgaaaccgcggtttttgcgggttcaaagtcgtgcccacagcgttccagccccctctggccggagattgcggagtttggcacggcaagaattaaaaaattcagatttttaaagctcaccatccgcaatctgcccaagcacggacttagacggaataaagaacagttcaccggtcaatggcgtcgagaagtcgagcaggcggtcggagttgtcgaacatcccttgcaacatccgcttggtgacggcccagtgacgggcatagccgatgaaataagtaccgttgattttttcggcaggattgctgaaggggacgttcatgcgtacgatcttatgctccacgccgccttcgttgtcttgagacacaacgttgtgcgagttgaccagtttctcttcatcggctaactcaaaatcattgaacttcttacgaccgatggctttttcctggtcttcggttttgagtttgttccaggcatccagtttatggtggtatttctgggcgaaggcatacgaaccattttcaaacgccggatcttcatcgccgatcaccgcgtattccggtgtgtccagtgcgctgggattttccgtgccgtcaacaaagccgatgatggcgcggccttcaaagtagcggaagccatgcgtttcatcgagcgtgacggtgttgttgccgatgatttccatgatttcggacatcaattcaaatggcacggcggagttttgtgaccggatatggaagaatagatccgccggggtggcaacagcggtgtatttaggtcccacgattggctggaatgcttctaactcttttggtcgttcggcatcgggaaaaagataatcccacgccttccgcgaaaagccgaaagccgttgccagttttgcatcagggtaacgaatattcagactattaatgaacgcaggcagatggtccgctaaatcggcaatcatttctttgtcgcttgcaacgtcctgccgtttaagatcaaacgttgcaaaaataatgtctgaccctgcatctttatacacatcctgtacatcccgtaaatcaattgccattctttctcctccaaactagaatcattttaatctggttttagtttagcatagcaggtagggattgcaacgattttcacctggacaggatgatttagttaagaagctgtattggcaggcgtgaagactgtcagcagccgctatcgttggatttttttcgttaaccgttcacgcatagtcggggttctcattagtgcgttttaaaccgttgccatgggtggtaaagtaagaacaaaggttgtgatgttttgacaatgacaataatggatcaagtcgaactcgtcattcgactgctggtcgcagcgttttgcgggtttgccattgggtttgaacgcaaaaatcgctttaaaaatgccggtatccgaacgcacatgattgtcgcgctggggtcggcactgattatgattgtttctaagtatggtttctttgatattttgaatttgaaaaatattgcgttggatccgtctcgtgtcgcggcgcagatcgtgagtggggtcagttttcttggcgccggtgcgattttggtgcggcacaacaacgttaatggcttgacgacagcagccggtgtctggaccacggctgctgtcgggatggcgattggtgccaaactgtatattctgggtttgtcggcgacggcgctcgtcttgggcattcaggtagtcctgcatcaccattatcgttggctgccaagtggcgacaatggcgttttgacgattcgaattcgcaatgaaggctttgatatggaacacatgcgccaaacgcttggcaagtatcatatcaaagtcttgaatgtctccatcaagcacgaaggcgatgaagtgaaaatgagtttacatgtcgaaagcagggccaacgaagatatgcggcgactgctgatgttctatgctgacaaccctaatattatttccatcgagttttagccagttggccgaactgataacgtttggcgaaacagcgttatttgtgaaacccgcgataatctgataatatatgtagaaatcttttaagcgaggtatgaaattgctcacagtaaacaatgtttcgatgacgttctcggatcggaagctgtacgaagacgttaacctgaaattcacgcccggtaattgttatggcattattggtgccaacggggcgggaaaatcgacttttctcaaaattcttgaaggcgagctgacgccgacgactggatctgtcagtctatcacctaacgagcgcatgagcagcctgaaacaggatcactttgcgttcgatgatcagaccgtcatgaacacggttttacagggatgggaacgtctgtatcaagtgatgacggaaaaagacgcgctatacgctaaggcggacttcagtgaagcagacgggaacaaggctgccgaacttgaaggcgagttcgcggaaatggacggctggaacgcggaaagtgatgcgtcacagctgttgcagtcgctgggcattcgggaaagcgaacatcaaaaactcatggccgatctgcctgaaggggagaaggtcaaggtgcttttggcgcaagcgctgttcggtaagccggacgtgctgttgctggacgagccgacaaatggtcttgatccacaggcgattagctggctggaagactttttggcggactatgagcataccgtgttggtcgtttcacatgaccggcattttctgaatgcggtttgtaccatgatgtgtgatgtcgattttggtaagatcgaactttacgtcggcaactatgacttttggaagcagagttccgagttggcattgcagctgcagagtcaggccaacgccaaaaaagaagaacagatcaaacagctgcaggaattcgtggcccgtttttcggccaatgcatccaagtcgaagcaggccacttcgcgtaagaagcagcttgaaaagattaccttggacgatattcggccgagctcccgtaagtacccgtatatcaagtttgaacctgagcgggcgatcgggaacgacttgttgcgggtggagaatgtttccaagacgattgacggccagcaggtgctgaaagatgtcagtttcattttgcggccgggcgataaaaccggcattatcagccgcagcgatgtgaccgcgacggtgttgatgcagttgctggcaggtgaattggagccggatagcggcaccattacctggggggtcacgactagccgcgcggcgatgcctaaggatttaaaccccgaatttgatcacgctgacctcaacattctggattggttgcgccaatttgcgccgcaagatgagcaggataatacgttcttgcgcgggttcctcgggcggatgcttttctccggcgatgaggtgcttaagcagttgaacgttctgtctggtggcgaaaaggtgcggtcgtatctggcgaagatgatgctgagtaaagccaatgtgttgatcatggacgatccgaccaaccatcttgacttggaaagtattactagcctgaatgatgcgttgattgattttaagggttccgtgatttttaccagtcatgatcatcagttcatccagaccattgcggatcatatcatcgaagtcgggccattgggtgttgttgatcgggctgacacgagctatgacgagtttatgcagcatgaaactgcgcagaagcaagtggaagccatttatccggagtcgttgcggcaggcttaggcaatttgttccgggacgtgccaaactccgcaatctccggccagctgagcctggaacgtggtgggcacgactttaagcctcagcaaaaaacgctgagtcttaaagctcggccttgttgtaggcggggcaaagagcgccccaccaacaacaatgtcaccactgaggctcatctggcctccgattgctccgctttggcactgggttttccaagaacacaacgaaatgttcccccgactcttctttagaaacagacgaattaatcttccacataatatcgctggaagttgattcgtctatttttttgtcttttatctttgcacgcgagataatgtcattagatttgtgtgataaatggccagcattaacccgtgacctggtgcataagaagggatgatcgatatgacccaacccgtgataattttgcttggtgttggcggctttgctgttgccgtcgttgtgcttaatctgctgttggcgtggcggcgtcaggcgaagttgaagcagcagctgcttgctgactgggggacgttgccggttaagcgtggtggtagcgagcgttatttgaaggcggcgtatctcgatcatgaggcgcaggttgatcatgattgtctcattgacgacttgacatggcgggatttggacatgtttgaggtgttcaaacaactcaacgccacgcagagcagcgttggtgcggagcgcgtgtacgctcagttgcgggcttacgacttgggcaagcctgatgttaacgaaacgttgattgacttttttcgcacgcacgccgaggagcggcttaaagttcagcttgcgtttgccggtttgggcacggaagcggcgaataatagtcagcattatctccgcaccacgacacaagcggccctgcctcatgcttggcgctttaaggttttaggcgggttgccggttgtgggcttgctcctgatttcgttgttgccagcaattggggtggcactggcgacgttgagcctcatggtgaatcttttttattacgttttgaaaagagaggcactggacgccgaagtgatggcgatggggtatctggtgcgcacgattgtgacggccgagcatctcgttaaaattgcccaaccaacgcaggcggctttgcgcaccgcgttgaagccgatgcgcggaatcacgcggcttgcctttgttttccgcacgcgcgataacagcagtgctgatatgatgaccgaatattttagtagcatgtttatgctggggtttatcgcctataacaacgtgctgacgcgcttgcacaatcggcatgccgaggcgttaactttgtggcaggcgttaggcgacttggagctggcgattgcgattgctaattttcgcgaggcgcatgctaacagcagtcaaccggtttttgcggatggcgggctgacggcgaaggagctggttcatccgttgctcaagcatccggtagctaatcctgtcgactggcagaagaacgccttgattaccggtgccaacgcgtctggtaaatcaacgtatgtcaaaagcatcgccgtcaatgcaattctggcgcaaacaatcaacacggttttggcgaaggacatgtcgattcaaccagggctagtgattacggccatggcgatccgggatgatttaagcgaaggcgacagttattttgtggccgaaattaaggcgattcatcggctcttagatgcggttgccactaacaagcgaatttacggcttcattgatgaaattctgaagggcaccaatacggtcgaacgaattgctgcatcggccagtgtcatcaactggttgagccactatcccagtctggtggtggttgcgacgcatgataacgagctgaccgatatcatgggcgaacaatgcgtcaactggcattttcaggaaaaggtgaccaaaaaagatggcgttgtctttgactacttgctgcatcaaggcccggcgacgtcgcataatgcaatcaccttgttggccacaatggcgtatccggagacgttgatcaaagacgcgcggacgcttgcggctgattttgaacggactaaggcatggccaaggtatcgacaaggaggcattaaggcgtgacaacagccaatcagatttttgaagcaatccggcgtgatccggccaacgcagacttcactgcgcaagggtgggatccgctttaccacatcgagccagatgcgaccatcctgattgcaagtcaggcgccaggacggaaagcgcaaaccacgaaaacttattggaatgatccaagcggtgatcgtttgcgcacttggatgggtgtgacgaacgaccagttttatcacagcggcaaaatcgccgtcctgccgctggacttttattatccgggaaaaggcaagtcaggagatttaccgccacgtaaagattttgcggctaagtggcatccccctttgttggcactgatgccacacatccagttgaccattgtgatcggtgcctatgcgcagaagtactacctaggcaaacgccgggaaaagacgctgacggcaacggtcaaaaatttccgggcatatttgccgacctactttcccattgttcatccttcgccgttgaactacggctgggtgaatcgcaatccgtggttcatggatgaggtcgtgccggcgctgcaggagcgggtggcgcggttgatgaagtgattcggaactcaaaaaatgacagcaagtaccgaaaaggataatgtgtttttagagtaaagtataagtgccatttgaagatcaccgcggcttagtcacccgcaatgttgacaagatcgttcgaacggttggcggctcccttctaggaagccgttttttagtgccaaaaacaagattgtaatgtggtcagactagttgcctaatattatttttcgccattgaggaacatagctaaatgcctagaaccgatttttagtggccgtaacacgcttcattcacagatgtggggcagaagaatcgtttaaaaatacggcagtttcattttcaatcggctttttcctcatcaatgcggaaaaagctgatatggtcgtgtaaccggttacatattatgctggttcatgtaagaacaagaggaggaggttcaaacatgacaacaggattacctaaaaactttttatggggcggtgcagttgctgcccatcaattggaaggtgcctggcaggaagacggcaaaggtgtcagtgttgccgacgttatgacggtaggcggtccggaaaaagcgcgaacgatcacagacggcgtggttccgggagaatactatccaaaccatgatgggatcgatttctatcatcgctacaaggaagacatcgctttgttcaaggaaatgggcttcaacagttttcgaacctcgattgcgtggacgcgaatttatccaaatggagacgagactcagccaaacgaagcgggcttacagttttacgatgatctctttgatgaactactgaggaacggcattgaaccggttgtcaccttgtcacattttgaattaccgtaccaccttgtgactgaatatggcggattcagaaaccgtaagttgattgaattttttgttcgattcgctactacctgtttcgaacggtataagaacaaggttaagtactggatgacatttaacgaaatcaataaccaagcaaattttatcgatgattttgcaccattcaccaactcgggtttacgttatcaacctggtgatgatcgggaggccatcatgtatcaggcggcccacaatgaattggttgccagtgcagaggccgttcaaatcggtcacgcgatcaatccaacgatgcaaatcggctgcatgatcgcgatgggtccgatttatccatacagcatgaatcctgaagacgtgttgttggcgcaaaaagcaatggaacacaattacttttttgctgacgtacacgtgcatggtgactatccggcaacgttgctcaagtattgggagcgcaaaggcattacgcctgagatcagtgctgaagaccgccagattctgaaaaatggcacagtcgactatattgggcttagttattacatgtcgcacgctgttaaaaaggatcctgctagatcttttgatgatctcgatttaaagcaagtggtcaaaaataattacctgaaggctagtgattggggttggcaaattgatccgcgcgggttgcgttacgcgctgaattggctgacagatcggtatcgcaaaccgctgttcattgttgagaatggcttcggcgcgtatgacaaagttgaagcgaatggtcagattcacgattcatatcgcatcaattatttacgcgcacatattgaacaaatgaaactggcagtgacggaagatggcgtcgatttaatcggttacttaccgtggggcccgattgacctagtttctgccggaaccggcgaaatggacaaacgttatggcttcatttacgttgataaggacaaccaaggcgaaggaacgcttgctcgtagccgtaaagattcatttttctggtacaaacaggttatcgcgtcaaacggtgagaatctgaattaaggtaatggcggtcggcagtgtgatcgctggccgtcaagtaggaaaggaaggctgtatcgtgaaaaaagcattgatcatctgtgcagcaggaatgtcgtcatccatgatggcaaagaaaaccacagattactttaaggcacacagcaaagacattcagttagatgctgtcacagcgactgaaggtgaagatgaaatccgcaacggcgacttcgatcttttcctaatttcaccgcagactaacatgtatctggacaacttccagaaagtcggtaaagaggtaggcaagccggtcgttagcattccatttgatgcttacattccaattccgatggggatcgagaaaatggccaaattggtcgaaaaaaatctctaaagttatctttccttcaggtcggcaacgacaacatgcttatgtaaaaagccgcgaagcaaagactggattgaggaggcgtcagtatgaaacagaaagagcgcgagttattgctttatctcgttgagaatcaggatcaatatgtcacgagtaaagacttggcaaacacacttttgatgacgcctaggacggtccgaagctatgttaaaagtttaaaagccatgattgagaaatatggtgcgagtcttgaagcgaagccgagtttcggttatcgcttacatattctccacccggtcgcgtttgatctgtttttaaatcagcataaggtgttaagtccaaaagtcaatgatactgtgacggcctccgagtcgattgatcgccagaattatattctcaataagctgctaatcgaagacgaggcattactcatggatgatctcgctgaacggctattcgtcagtcgctcgacgctttcaaaagacatgatttctgttcgtgaaaagttggagccttatgcgctgcatcttgagagtagggcgaacaagggcttttatgttgtcggaacggaacgcaatcgccggcatttcattctggattatttctttagccatggccagaataactttcaacggtttatggaaaataagtctttctttgccgatgtcagttttgaacagctgacgatcgtcgtgatcgatgaatgtcgcgaagccagtctacggctatcggatttcatcattcaaaatattgttttatacctggcactcagcatcgagcgggtccgaaaagggaacagtttgcctcctgtaaaggttgaacaagcgccagaacatcaacggcattatgcggtggctgagcggatcatggaacggatcgccagaagtaccgggttgcagttttcagaaagtgaagttgcctatttagcgattcagcttgttgcgatggcaaagggaagcccgcaagactcgaacgaccaggctctttggaaggacatggatcaagtgctcagacgaatcgaagccgagacaggttatccggtgagcacggattatgcattaagaaagagtctggccgaacacatcaagccgatgttagtacgactgcagcaaggcattcagctaaaaaatccattgttaaaagaaatcaagacccattatccgcaatattttgctgacaccaagcgctttctaggaatgtcaaaaatattgtctgcgtacacgattaacgatgacgaaacggcctatatggcaatgcatctcatggcagcagtcgaaaagtatcataatgctcataaactacggaccttgattatctgtgccaccggttatggcagtgcggagttacttaacaatcgcgtgcaaaaggagtttggcgagacgctgaatattgtcggggtcaaaggttattacgaagtcgatgacgaaagtttggctgacgttgatctgatcatttcagcgattgatctgtcgacccaggtgctgcgtgtcccagtcattcaggtcagtgtcttcttgggtgaaatggatgttcgggcgattcgtcaattcttggagacgcataaccgcccacatgggaaagcggcttcaaaagtcgaggctattgctgctgtcgataaaagcatttttgatcagtttactgattctagtcgatttgtacgttggacagagccagttaatcgagaaactgttttaaatcgactctgcgcccaagtagcgcttcttgagccggctaattttgcagacgagttaaaagctcaagtacatcaacgcgaacagatgagcagcattacatttagtcaaaaaatcgttgttcctcatccggcgatgccaatcggccaatttacccaaattgccattggcgtcattcctgcgggattaaaatggtccgaaagcttcccagctgtccagctcgtgtttcttctgtcaccttcttatttggggaatcgagggctgacctcaatcacccagacaattgttgcgttgactgaccatgcggattggcaagcgtcattagtggcagcctcagatttcaaaagttttcgtcaccgctttttacaaatgatggaggaggaataagtgccgatgaattcagacgatattcaattaattgcatttgaaattattttgcatagcggtaattcacggaccatgattcatgaggcgttcgcggctatgcgtgttggtaattttgacaaagccgatgaacgattgaaggcttcaaatgacgaattattactagcacaccaatcacaaagcgatctcttaaagaaatatgccggtggcacaaagatcgagatggagatcattttagttcatgcccaggatcacttgatgaccacgatgacattacgcgaagttgcgttggaaatggagcatctttatcgcaatcaggctgctgcaggggagttgaaaagcaatgaaccggaagataaaggcaagtgagaacgtacaaacacaaacaacaacgactattgataaaaatcgccaagcacttagtttgcaaagtatgcggttcaatcgatttttgggtattcgctatctaaccgctgtgttcttctttgctaatctttggtgggcaatcattgctaacaatctttggagcaagtggctgccagtggggttgataattcttgcaattccggtgatttatgaacaaattaaactctttggaacccctacgcatcacttgccatacaccacgctttatttctggtgccaaacatgggtgaacattggcctcagtattttgatcgtgacgccactatttaatgcgttataccccttcattcgcgatacgaataataatcgcggtgttgttcttttgattttgatgatcggtattggccttggtgtctggtctttacgccgactgcatttgattagacaggacaaggatcgattttatagtcgattgctggcttatcaagcaacacttcacaagtaacaaactttgcggcgcagaagcttttcaacacaaaatggttaaatgtcggtcatgagatttaggaccattaggtgtcattcttgatgtcatctcaagtattaccgcgctggcccgctcataaaagtaggagggaacagtaatggaaaataacggacgctttttcaattttatgacgaagaccttgcttaaacccatgtcgaaggtagcccagtatcggattgtacgtgcggtcatggcagccggcatggcaagtattcctttcacaattgtcggctcaatggtattggttcttaatgttattcctttagtttggccggtgacagccggtttttggaacgccacctttatgaagttcagtgatctttatatggttatcaacacagcgaccatgggcatcttagcaatgtactttgcgctggcgatcggctatgagctgaccagaatcattcaaacagaggataagctgaaagttgcaccgctaaacggcgcgttcttgtcactctttgcctttttcatgtgtttacctgaactggttgtcaagggcggaaagatcattctactcaactctattacttcaaaagagaaagtgatcaatgggtttagaatgacggcaacgatcgatcgtttgggaacttcaggcattttcacagcaattattatggcgattgtggctgtctatttatacaagttttgtgtcaagcataattggacgattagaatgccggaagctgtccctgaaggtgtttcccgttctttcactgctttgattccaaccgctgtcattgcccttgttgtgatggtcatcaatggttcgcttgtcttgttggggacggatattttcaaaatgatttcaattccgtttagttttgtcaccaatctgacgagtacatggatcggcgtcatcatcatcgaattcttgatccatgccctgtggattgtcggtattcatggtgcaaacattatcagtgcctttatcactccaattttattgacgaatatggccgctaatgcaaaaggtgcacatattccgtttgccggggaattcaacaactcatttgccattatgggtggctccggtgccacactcggcctttgccttttcattgcctttgctgcacgctcggaacagctgaaggttttggggagagcgtctttggcaccagcatttttcaacatcaacgaaccgctgattttcggcttgccaattgtttataatccatacctggcgattccatttttcttggcaccgatggcaagtgcttcattggcctacgccgccttttatttccgattaatcaatccgatcatcacacaggcaccatggccatcaccaattggcttcggcgcattgatcagtaccgttgatatacgagcggtgattgtagccatcttgtgcggcatcgtggcatttctcatttggtttccgtttattaaactgtacgatgctaaattggtcaatgacgaaaagcaggttgctgctggaaaagaggctgaagcatagcactctcaatcgcatgactatcgttgtatagccaaaaggaagctgttcgcaagatgctggaacagtttcagcttattaggagcttgctttttagatgattcaaaggtatacaaaaaaccgacatcaatcgcgatgtcggtttttgtggttcaaatcaagtgatagattatggcaaagctgcaaagatcagcgcgccagccacaccgcctgccagtgggcctaaaaccggtacccaggcatagggccagtcggagtcgcctttgttggcaattggcaaaatggcatgcgccagccgcgggccaagatctcgggccgggttaatggcataaccggtggtgccgccaagtgataagccaatcgcggtgatcaggatgccgacgccgattggattcaggccgtctgtccatttgcctttagtgaaggccaacagtccgaaaatcaagacagcagtgccgatgaattcggaaatgaagttggccgcgtaactgcgaatggctgggccagtagcaaagacgcctaaggttgctgcaggatctttggtagctgcccagtgcgggtagtaatgcagccagacagcagctgctccgagcaacgcacccagtaactgggcgataatgaagggcagtacccacgcccaagggaagcggccaatcgccgcaaacgctacggtgactgccggattaaggtgtgccggtcctaagaaggcggcggtataaacgcccatggttacggccaatccccatcctagggtaatggcaacccaaccggccccattggctttggacttgttcagcgacacgcctgcgaccacaccatcgccaaggaggatcaaaacgaaggtaccaatgaattcacctaatgcttgtgtccacatatgggtgcccctttctaggcttgaggagccgaagccggcgccttcttcaagtcatccaaccgactctcactgatcgcttgttccaaatcagccaattgttgtgcctttgtggcttcgtcccaacccaagatgcgggccatttcgtctaccaccggctgtttcaagtcagccagcgtttcggcatggaaaagaatggcattggtccggcgcaacaggtaatcaaccggcgtcagcgtcatttcttcattgattgaatagcgcagactcatggtttccttgagactcagacccggtgccggctggccgtcagcatacgtgaccacgcgactgatgttggagccgtagcgattggcaaggtcggccgcatccttttcaggcatgccagcgtcaatcccgatccgggtgtagaacgcaatcgtatcgtcaacgttggtcggatcaaaatgaccgccggagacttgaagctttttggagtcaacggtgcgggtttcggtcgcaaatttttcagccaagacacgacgaatcaaggcgagggcgccagccgccattttccggtagtcagtgatcttcccaccggacagcgtgatcatgccatcatcggcttggcgcagcgaactaccgcgagaaatctgggatgggcttaaggatgcttcggcatgggcggtttccagcttggaaatggcgtgctcaacatcggatcgggtcgcttggttgtcttcgtaatcgttaacgactttgaccaaggcctcaaacgaatcatccgaaaccttaccagtgttagcgccaccgccgttataatcggagctgccgttgttggcaatcagtggccgcagaccggcccagctggcctcgatgtcgtcgatcgtgatgtggctttccgggaagcgcttgttgatcacttttagcaggtaatccacatcggcttgttcgacacgcggatgcttgaagtcgccggtataatcggtatcggtcgtgccaaaataagtcttgccttcacgcggcaccacgaagaacatccggccgtcattcaaaccggtatccatataggtcggttgcggtaccggcagacgtgaaccatcgacaaccaaatgaacccccttggttgggcgcagcgtcggagcctgattttcgttcttgtcgagcgctttaaacttgtcggaccatggcccggtggtgttgatcacgagtttggcatgaatgtcgaattcgctgtcatccaaaagatccttgacgcgcaaaccgatgacttggccagcgtcattgtgcaagacaccgatcgccttcacgcggctggccatgagtccaccgagttcagccgcttctttgatgttttcgataaccaggcgcgcatcattgttcacgaagtcgaggtaaacgccaccgccttgcagcccgtctttttccagctgtggttcacgttgtagaatttcatctttcgtaacggtgtagttggcgtattgcgagccttcaacgtttgccagtcgatcataaagatccatcgcgattttgatgctgaacatgtcgaaagtactgccaggttcctggaaaatcggcagtaacatcgggaatggccgcggaatgtgcggggcgatgccttgaacaacggctcgttccttgacggtatcggcgacgacgccaacatcaaacgtcttgaggtaacgaatgccgccgtggaccagtttggtcgaacgtgagctggttccttcagcaaagtcctgcatttcgatcaagccagtcttgatgccacttgcggccgcctgaatcgccaccccggcaccggtaatgccgccaccgacaaccagaagatccagttcggtttgctttaattgttcaatcgtttgcttgcgggtttcctttgaaaatgccattttgataagctccttttgaataatgattgaatgatatttttaaaaagaattagttgtgatttttcgtatgcttgtacatctgagtggcggcaaccgcttgcttccagccttcgtacagatagtcacgatcgacagcatccatttgcggttcgaaccgcttgccgaccttaacaatgctttgcagttcatcggtgttgttccagaaaccggtggccaagccggcaaagaaagcggcgcccatcgcagtagtttcaaggttagcggcccgctcgatcggaatccccagaatatccgcctggaattgcatcaggtaatcattgttggcggccccgccatcaacgcgcagtgccggaatcggcataccggtatcggcgttcattgtgtcgacaacatcgcgggattgatatgcaagcgattgcaaagttgccttaataaaatcttcgcgggtcgtgccgcgggtaataccaaaaatggcaccgcgggcatcggaatcccagtaaggagcccctaagccggtaaaggcaggaacgacatagacttcattttgactttttgatgccaaagcggcggcttctgaatcacttgagcgttcgatcattttcattgcatcgcgcagccattgaatggcactgccggcaacgaagaccgagccttcaagtgcgtaggtgactttgccatcaagaccatagccgatggtggtcagcagattgtgattggaaagggttggcttgtcgccggtattcatgacgatgaaggcaccggttccgtaagtgttcttgaccatacccggttgaatggccagctgaccgaacaaagcggcttgctgatccccgaccatgccggcgatcggaacagtgctgccaaagaagtgataagcagcggcatcaccatagatttccgagttactgcggacttccggcaacatttgcttaggaatgttcaaaatgcgcagaatctcatcgtcccaatccaacttatgaatgttaaacagcatggtacgcgaggcattggtgtaatccgtgacgtgaatcgcgccgccggacagcttccaggaaagccaggtgtcgatcgttccaaaaagcagttcacctttttccgcacgttcctgggcacccggaacgtgatccagaatccagcgaattttggttgctgagaagtaagaatcaatcagcaggcctgtagcatcgtgaataagatcgtcgtatccatcggctttgagctgatcagcaatctcgctggtttgccgtgattgccagacaatggcgttataaatcggtaagcccgtttgcttatcccagacaaccgtggtttcccgctgattcgtgatgccgattccgacgatttgccgcggttgaatatgtgattcaatgaaagccgtggcaatcgttgacagggcagcgttccaaatttcgttagcgttatgctctacccagccaggatggggaaaatactgcggaaactcgcgttgtgcatccgccactttttgcccattatggtcgatgatgatggtccgcgtgctggtggttccttcatcaatcgctaaaatatattgttgttcgtttgtcacgattagctacctccagtgaaatataattgcacacaatgaaaacgtttccgataatagttatacctgatcgccgggacgaatgcaagcattatgcttatataaatcataagttattttaaccataagacctatattcgcaattgagaatatagattgcttgtttttcggtgaaactgcgccccgactaaacagaaaacccggcatggcggccgggttaggtagggctgattagatgagttgcttgagctgataaatgtggtcaaaaattttgtcttcctgtcgccgatcgtcccaagaaaaattgtgcatggtgctgttcggccggttgatttttttatacagaaccgttggattgtaagcatacttgccgcgggtatgggcaacatattcggcagtgaagtcatagtcttcagcaatccgcaactgctctttgtagcgaatgttgccggcatccaaagcggcgtgggaaaaggctttgttccagatatacccgccgatttccgttccgtgatgggaaacctgttcaaacatttcggcctgggacaacaagcggaaccgatccggaccgccgcgactgcgatgccaccaatcgtaaccaaccgcggtcgcaacgacgcctggggtgaaaccgcggacaagcgtctcggcaaaagtcggcgcgattaaatcgtcaccgtcaacaaaggcaataaaccggccattggcgtgatcaatcccgaagttgcgggcggcgccgatcccacggtgacgatcaaaagccgtagcgtggtaagttggcacgccgcgcacaaaatcggccgctgtttgtgccgttcggtccgatgaagcatcatcgatgagccacagttccacatcaattgtctgttcctgaatggttttaagggtagccggcagataccggccaagattatacgttggcacaataatggatatgtctaaatttgtcataaaaacctaaacctccttggcggcacctcaattatgcacggcgcctaagcggttaaatcattgcaatatcgaatctttgctttgatcattatcgtcagattttggtaggcgtcaattaaaacgacttggttgcccgcaagcacgctgatcaacttggcataagcagcagtgggatattaaaattttagtaaaacacaactagataacacagcaagggacggacatatgtctcaatccaaataaaatattttgacaatagcgcttccatttgcgtgacttttttagtaaaataaaaacggttacaaaaatcgtgaacaaattgacttatctgttttaaatataggaggaatttagagtgaacagtacagatgtcacgaaaggctttacggagcaatttggtaagcaggcggagcatacgttcttcgcgcctgggcgaattaacctgatcggcgaacataccgattacaatggcgggcacgttttcccttgcgcgatttcgcttggtacttatgccgcagttggtgcgaatgaagacaatgcgttccgtttgtattcagccaactttcctaaggtagggattattgacattccgttcccggatctttttcaggaaaagcgcggcttgtggacggattatttccaaggcatggcgcgagtgatgaagacggcggggattaattatacccacggcttgaatgtttatattaatggtaatttgccggatggcgcgggcttgtcgagctcagcttcattggaaatgctggtcggcacgattctgaacaatctttttgacggtggatttgccccgttggatttggttaagttcggcgtgaaagtcgaaaacgattatatcggcgttaactccgggatcatggatcagtttgccatcgaaatgggccgcgccaaccaagcaacactgctggatacgaacacgatgaaatacgaatatctgccagttgaaatgggcgacaacgtgatcgttatcatgaacaccaataagcgtcgcgaattggctgattccaagtacaacgagcgccgcagcgaatgcgaaaaggctttggcaatgctgcaaaaaggcattgacgtgaagagccttggccaactgactgaagacgaatttgacgaaaacacgtatctcatttatgacccgattctgatcaaacgtgcccgccatgcggtttttgaaaaccaacggacactgacggcggcacaagcactgcaaaaaggcgacctgacgaccttcggcaagctggtttccgcatctggggtttccctggcatttgattatgaagttaccggcgttgaactcgatactttggtgaccaacgccttgaaacaacgcggcgtcttaggggcacggatgactggtgccggttttggcggctgcgcgatcgcgattgttaacagcgctgacgtcgaggactttattagtaacgttggcaaagcttatactgagaagatcggctatgatgcgcacttctatgtggcagacattgccgacggagctaagcagttaaactagcgctgacgaaatatatcagttagtgcagacggatgcggaagcaaaaagtaaaggagaaaatattaacatgacaattgcagttttaggtggcgcaggctacatcggttcacatacggttaagcaactattggctgacggggaagatgtcattgttttagacaacttgattaccggtcatcgcaaggcggttgatccgcgcgcccggttctaccaaggcgacattcgcgattaccacttcctgagccaggttttcagcaaggaaaagatcgacggcatcgtgcactttgcggccttttcaattgtgccagaatccatgaaagatccgctgaagtattttgataacaacaccggtggtatgatcaccctgcttgaagcgatgaaccagtttggcattaaaaagattgtcttctcatcgactgctgcaacttatggcgaaccgaagcaggtgccaattaaggaaaccgatccgcaagtgccaaccaacccgtacggcgaaagtaaactggccatggaaaagatcatgcactgggccgacattgcttatggtctgaagtttgtcgcactgcggtatttcaacgtggctggggcaatgccggatggttcgattggtgaagatcaccatccggaaacccacttgattccaatcatcttgcaggttgcggcaggcacccgtaccggtctgcaaatctatggcgatgattacccaaccaaggacggcaccaatgttcgtgattatgtacatgtggttgatttagctgatgcccacgtgttggcattgaactatctgaacgcaggcaaccagtcatcggccttcaatatcggctccgctcatggcttctcgaacttggagattttgaatgctgcccgtaaagtaaccggacagaagatcccggcaaccatggcaccgcggcgtgcaggcgacccaagtaccttaatcgccagctcggacaaggcccgcgacatcttaggctggaaaccgaactatgacgacatcgacaaaattatcgagactgcctggaactggcacgagaatcatccggaaggctttggtgaccgtaattgaccgcaattaccaatcatattgagaccattattaagctgaatcctgattatacccacatggacgccgtgtacctgaccaacaagttgctgaacctaatcggggatgcagcactggacctgccaggtgacgaggatccgttggaaaatctggatttgatggttcaagccgcccaggataacggtaaaattccggattcactgtcagcccgccagattcttgaagcgcagctgatggattttgccacgccaactccgagtcgtgttaaccagatgttctgggataagtatcaagccggcccgcgggtcgcaactgactggttctttgctttaagtcgggcgaataattacattcaaacccgggcgattgccaagaacctggtctttccggccaaaaccgagtatggcgatctggaaattacggtcaacctctccaagccggaaaaggatccgaaagacattgctgcagcggcgcacgctcaatccggctacccggcctgtgcattgtgcctgcaaacggaaggctatgcgggtcgcagtaattttgccgcacgcaccaaccaccggattatccgcttcctgttaggtgggaaaacctggggcttccagtactcgccttatgcgtatttcaatgagcatgcgatctttttggatgccatccatgagcccatggtgattgatcaaagcacgtttgaaaatctgctggcgattgtggccatgttcccgacgtattttgtcggctccaacgctgacttgccaattgttggcggttcgatgctggctcacgagcattatcaaggtgggcggcatacgttcccgatggctaaggcaccgattgagacccaagtcgagattagtggccatccgcatgttttcgccggtatcgtgaagtggccgatgagtgtcattcgcttggtcagcgctgatcgcgaagagttggtgaatgccgctgagcatgttcggcaggtatgggatcagtatacggatgaatccgttgacgtgcgggcatttgtggacggtaagccgcaccacaccgtaacgccgattgcccgtcgtgtcggctccgaataccagcttgatctggttttgcgtgacaatcagaccagcaagcagtatcctgacggtattttccacccgcatcaggatgtccaacatattaaaaaggaaaacatcggactgattgaagtgatgggacgcgccattttaccagcacggctcaagacggaattggctgaagtgcaaaaatatttattaggtgaagccaatgacatgaagccgatgcacaaagcatgggcagaccagcttaaggccaaataccagtggacgccggagaatgcagaggctcagctgcaagaagccgtgggccgcgtctttgcccgcgtgctggaagatgccggcgtgttcaaacgcgatgaaatcggccaggaagcgtttggccgcttctgccgcacactttaagcgcaccttttggcagcacagtcagggaaacggagggaatcgatgaccacgattacagatattgcgaaggcggcgggggtgtcgatcgctacggtttcgcgaattttgaattatgacgcgacgctggctgtgacgccagaaacgcggcagcgcgttttgaaaaccgctgagaaactagcgtataaaccgcgacgacgcaaacgggtgcccactcagacaacggtagcccttgtccagtggcgcagtgaacaggaagaactgaatgatctttattacctgcaaattcaatatgcgattgaagccaaggcggctggcgtcggctaccatttgcagaattttcaccttgaacagctggatagcgacagtgttaccaacatccaaggcatcattgcgttaggcaaatatgacgccggcgaagtggctaaaatgaaagcactgggactgccggtggtctttgttgatcagaacatgctggcgttcgactgcgattcggttaccgccgattatgccgggccaattaaagagatcattgcgcattttcgcaaagtcggcattgacgatattggctttctcggcggacttgagaccagtcgcagcggccgcgagcagtttcaggatgtgcgcacggtaacgtttgatcgtgtggcgaaagacgccggattcgcacgccctgagtttcggctgatcggcgaatttacgccggattcaggttaccgcttgatgaaaaaggcgatcgaaacgttaggcgatcaattgccgcacggcttcattatcgccaatgacaccatggcggtcggcgcgttgcgggcgttgaacgaggctggcttagcagtgccgcaacgggtgtctgtcatcagctttaacgatgtggcggtcgccaagttcacgaccccgccactgtccacggttcatgctgccacggatcaaatggggcagactgccgttgagttactgcaggcaaggctgggtgacgccaagcgggtgccacgccaagtcaattttaagagtgagcttgtgatgcgggctagcagtttgtagcgtatgcatcactgattaaggagggtatgatggacgtttcagttgaacaatacggtcagtaccaaggacacgacttgtatgaactaacattgaccaatgatcagggaatggtagtcaaactgttaaactacggcgccactttggaaaaagtgctgctgccggaagctgacgggttgcacaatatgattctttcgctgccaagtcgtgaggattactcaaaagagcgtaattttctaggcgggacggttggccgcattgtcggccggatccgcggtcacgtttggcaacacggcgatgtcaaagtcgacttgcccatgaatgaaggcaacaatcacattcatggcggggatgatggtctcgatcggcaagtttacaacttccgcatcgagaaaacggcaacgaccgccagcgccagcttcacgtttgtcgatccggacggccacaacggctatcccggcaatctcaaactgcaagtcacctatacgctaaccaacacgaacgccttacagtatcgcgttgatgcgctaagtgacgcggaaacgctcttcaatccgactaaccatacttacttcgcgttggatcaaccagcatcgattgatgacacgacgttgacgattccagctgatgactacaagccattagacgccgaacacctgccaaatcaaggctggcagccggtatccggcactgtgttcgattttcgccacggccaaaaactcggcgatgtcatccacacccgcgccgatcaaatcacgtccgaacgcggcatcaaccatccatttcttttgaaaaacggcaaaacactggcggccaagcttcaaacagccaagcacactatgaccctagtcaccacggcaccaagtgtggttgtctacaccgccaatcacttcgatggcacgggtattcctcacaacatcaaacaattcgacggtgtggcccttgaatgccagtttgcgccggttagcggggatgacctctcggcgattacgctgttgccaggggagccgtttacgttggcgaatacttggacgtttgaataaggcatagtggtttttaattagtgggttatttgcacagaaagaagctttccttgatggggaaggcttttttcttgtgcttggatgttaatggcatcaggttatgcgtcatagatggcaaaaagcgaaatcaatggtagtcaattaaattgaggtccatttgtttaaacctgttcttttttgttaggaaaaattatgtcgtaaataatctacatgattaatttgcaaagtttcatagattgtctaagtacttacacaacaaggggttaaactctctataaaatttattcaatattttgccaacctttttgaagattttcttgactactgaaaacgcttgtttataattaaaagtgaacaggaacaaacaatagttaacaaattactgacagatgattaagcggtggccgacggaactttttgattcaaaattggcatttccccagatgttgttcatttaaaaaacatccgatcgattttgtaacgccgctcagtcagactggtttttgatctagtttttgaaagcgctataaaagacctatcctggtttattttgtgaggatgatcaggtttgcaaatagcatgacgcagagcaaaaacacaccgtcagtttctgttcacgctgcgaataatatttttataaggaggtgaaaagtgatggctgcaaatattgtttttacacgaattgacaaccgtttggttcacggccaggttggggttacatggacacgcgccgttaatgcaaacttgattctggttgctaacgatcaggctgctaatgatccgcttcagcagaaattaatggcaacgacagctgattcgtcaggtgcaggaattcgtttctttacggttcaacataccattgacattattggtaaggctgctgatcgtcagcacatctttatcgtcattaagacaccggctgatgctcgcaagttagttgagaatggtgtgccaatcaaggaagtcaatgttggcaacatgcactttgctcaaggcaagacagaaattactaagaaggtctatgtcgatgaacaagacaaagaggatctgttagcaattgtgaacgctggcgtcaatattttcattcaggactatccgggtgataagaagacaccaattactgctgacttgttaaagaatgtcaaatagtcaatagattaaattggaggtgtcaggttcatggatgttaccttaactcaaggggtgttaatcgcgctttgggcaatgatatcaggtcttgattgctggctacaggcgttcttcattttccgtccgattattgtctgcacaatcactggccttatcctgggcgacttacagctcggtgtcattgctggcgggttaactgaactagcttttgccggattgactcctgccggcgggacacaaccgccgaacacggttctttgcgggattatgacggttgttattgcggcaactaacaaaactgctccagcaacggcgatcggtctttcattaccgttcgcgatgttaatgcaatatattctgctgttcttctactccagcttttcactgtttttgccgaagttcgatcaatatgctgcagaagggaatacaggtgcgtttaaacgtctgaatttcattccgctcacgatcgttactttgtccttcgggatcatggctttcctgagtgcatatgcggcacagggcccaatgaaggcacttgttacttcaatgcctcactggttgacacacggatttgaattagctggtggtatcttgccggctgttgggttcgcaatgttgttgaaggttatgttaaaaggtcaatactttgcatatctgcttttgggattcgttatggcttcaatgatcccattctcaaatgttctgccagttgccttggttggcgcggtatttgcaatgatcgaattctatcgcagccgtgatcagatcaagttagagaagcaagttaaggaagttgaaaatcaatctcaaggaggaggcatgaatgatggcatctgatgacaagaaacaaaagaaaagcttgtttaccaatcatgaaatctccatgcttgggattcggtctaacttagttcaggcatcgttctcatatgaacgaatgcattcaccaggttggacatgggcacagctgccatactggcaaaagatctataaagatgatcctaaaggccttaaagcggttatgaccgataacatggaattcatcaatagttcaccgccactgtatcctatcctgatgggtttgctgctgacgatggaagaaggccacgttgatcggacgaccattaaaggtttgaagaacgcattgttcggtcctatggccggcattggcgatgcgattttctggttcaccattatgccgattgtcggtgggatttctgcatcaatcgcgaagaacgggaacgtttttggaccgattctgttcttcctggtttacctgttcctattctggtctcgtattccgttggcacacttgggttataaccttggtacgcgagcgattgatgtcattcaggaaaactctcggatcatttcacacgttgcttctatcctgggcttaaccgttatcggtggtttgattgccagttacgtcaagatgtctctgaccattaaggttggcgctgggaacacagtcatcaacttgcaaaagcagttgctggataaaatcttcccgaatattctgccatttgcctttgtctttctgctgtattggctgttgaagaagaatgttaacccaatttggttaatcgtcgtgacctttgcgcttgccatcgttatggcggccatcggttggatgtagctgttagtaaatgatttgaggaggaattagacattgagtaaagttcaagtgatcgtcactgggcatggtacttttgccgatgggttcaagggtgcgttgcatttgctggcgagcgtacctgataactggtcgttcgtaaacttttcagaaggtatgagtgacaaacaacttcaggctaagtttgaaacgattcttggatctgatcccaagccgacattgttttttacagatttagctggcggaaccccgtataaagtggcggcaactctagcaagcaaaaatccgcaattggcggttgtctctggctgtaacctagggtcgttacttgaatctgtattcagtgactatgacaatgccgatgcctatgctgatgcgattattgctgcatcaaaacaaggcacgcaaaagtttacgctggatatgccagacaatatggctactggctctgatgacggtatctagttgtcgctgacttatctaggagatacagttattgaggaaggggcgtggctttctagtcacaccccttttctgacaaatttgcatggtagaatcagttacatgaggtgaatgatatggcgactaacatttcgattcttgttttggcaatgattgtggccggtatgggcatcatgctctaccaacggcgtaagtacttctatttggggacattcttcataggacacggtatgacaagcactgtcatcaatttaaaaaacagcgggcattacgtcatcaatatcactaatgttagtgaaaatccccaagcgcctgctagctttaaaatagaagaaggatcgttccgcaaagatggaacagtcattgacttgaagccggaaaaattatcaacttttacctatccaaactcgcaggctttaatgacaaatgattggggtggacatgaggagtcggaatcagaaagtcaccagatatcattgcaaaaccatgctctgatgctctctggagaagaacttcaaccacttaatcagggaaaagtcgtgacagttaagcaatttatgcagaataagaagaagccaaagtctgctaaagtgtgactggttgagtcaatgctttggggtctgcgtttgtcagtaagatggaaccaaaaacagctaatctgtctatgcggattagttgttttcgtatggtttcctttgtggcggcttttggggctgaaaagatcacttgtaggagtgagaaaacttacctttttgtgaatctggtgctgattatctgtaacgtctccgtttggcttgagtctaatagggttttttaattaattgctggctcaatgggttaactaaaaataggcctgcacaaacaaatcagccgccagcccaaacgcagcaaacgcaattaaaatccgtaacagtctgactggcacatgccgcacaacgatcggaccacagtagccgccgatcagaaagccgatgccaagcggcaggacgacgacccaatcaattttgccagtccacgcgtaaataactgtcgccactgcgttagccatgaaagccatgacgttcttgaaggcgttgagaactgcaaatctttggggtaggctcagtgtcaaaattgcgaggataatgacaccaccggctgcaccgaagtagccagtgtaggcaccgatcaagaagagaccgatagcttttaaaaccaggccaaacttgttctgatcgcgtaaggcagggacattcttccggtccgcttggtgtccgctgactaagaggagaacaccggctgacagaatgaagaaggggacgacgtgttcgaatgtggatgccggttcaataagtaggagtgcagatccgaggatgccgcctgctagcgtgagggcggttaagccggtcaccagtttgccttcgccgcgaagttcgcgggatgatgatgcggttgcgccaataccggaaagcacgagtccggctgtattggttacgttggcaatgactggcgggatgccggctatgaggagtgctgggtaggaaactagcgaagctaagccagcaatcgaagccaataagccgccgagaatgccggcaccgataaagtaaatgaatagccaaaatgtcatggttgcgccccatctgtttttcaaattttctctgttagtgtctcgctaagatgttatgaatgtcaagaaaaccccggttgaagttggtggcttcagccggggttgcttgtctatgaagtttaaagttcttgtgcagcctgctgaattttatcaacgaattccgtcatatcagtttgcggctttaagacattggtcagcgcgaccgcagccttcttctgcttgcggttgatgctgagcaagccagtatagccgaggacactgccgctgttgcctagccagccgtcagcaagcttgtgccagccgaatccgtagccgccttcagcagccttgaagatggtttcccagcttcctgctttgagcagcttgcctttcaacacagcttgcgcaaacttttcaagatcgtcaattgttgtgactaagccgcgatctgcctgattttcatcacctttaccagcgaggttcggattgccggcaatccaatgatagctttcggcaaaagcgtgtgaggtgccgattttggtatgtgtcaaagccaaaggatcgtaaatgttttccttcaaaatggcttcaagcgggcgttcctcagtgagccgatcaagcacttcgcctagcaaaatggcgttggtggcgctgtaagcagtctggctacctggcttgaaggctaacggttgatcatcaacgacatccaagactttagccaggtccatgtccgcggcattgtgctggttgatttgtaaggccagacgctcatccggcaaagttgccggcgcgttcgccttgaacggttcagccatgagcgttaagtaatcgggaatcccgctttgcatcgtggcaagctgaccgatggtgattttgtcagcctgcttatattcaggcacgtattgtgacagtttgtcggtcagttttagcgcgcctttttcgacaaattgcatgagcaaaacgccgaagaattgttgcgtgacagttccggcaccgctgagcgtatgcgatgcgaacggaaccttcatatcgatatgggcaaagccttgcgaatctgctgctaactctttgtcggcagtcaccactgcgactgcgccgttatagtgttcggtttgtaaggaacggcttaatggtgattcatctttaactgatcttgttctaccatgtataaacgcctccaaaaatgaacgatcggtcgagtcttagcttgtgcttgttggggcattggcgtcatcggccatcactaactaatctaaatgtgctaccttgacgagctcgcctgtcacgcctacttggatcccttgcttgattttatcggtacgggtggcatgaacgacttggaacttattttgtttaacgatcagtttgttgtcagtgtggtaatcagctggtaagggttgattactgccacggatcagcatcacgataaacttgaatccactggcatgggcttcacacgggctgtaatgcaacgtgtcgctgaagaattcaaccacggtgccagctggaacaaagaacaatttagcgttcttttccgcgttgaatttaccagcgtgcatttggccgcgcttgccgatgaccatgacgacatctgtgaaaaagacgttcacttcactgccttggtggaattccacggcggttaaagcttcggcgtggccagcacattcgcctgcttcgattggcaggccagcgaaaacatcgcggccgatttgctgaacaaccggaatcttttccatgtccgggtttgacggaacatagaggttggctgcggttggggcaggaatcttgacgttttggtccatgaacgttttgagctcactgacgtcgtattgcgggtaggtgacgccgtaatcggcaaacgccggatccgttagctgatgaatctgcttatctggattcaactgctgaatcttttcaaaagttgacatttgatggcttctttccaaaattagtaattttcaatcgtgactttggcaaaataggtatcgaacttcgccgggttgacgaagccggtttctgcttccatcgtgttgagcatcccagtggtcatcgccgtcttcataatgtcttcgtcagacttgccatcgtgaatgcccatggcgagtccggctaaggttgaatcgccggaaccaaccggattgacgacctggatcttagggatggcggcgtgatagaacttgtcttgatgcttaacaaaggcacctgctgatcccaaggaaacgacaatccaatcaacgccgtcaaaaatcggatcctggaggtcttgtttcaacgcggcataatcggttttatcgacttcgcggttaagcaagccggcaagttcttcatcgtttggtttgatcaaaaggggcttcactggcgcttcgagtgcggacttcaaagtggcaccggatgtgtcgagcaagaccttgacgtttttggcaccggcatgggcgatcatttgcgtgtaatagtcttccggaagcccttgtggcatcgagccggaaatcgtcagcaagtctgcctgatccagcaacttgtcaaagtgatcgagaaacttctgcgcatcttcaggggtaatcgttggtccggattcaagaatttcggtttgcttgccgccatcatgcagcattgcgatggaactacgggtttccgcatcgatcggcagaaaatcatgggcgatgccatcgcgatccaattgattctccaaccatttgccaaaatagccgccaataaagccggtcgcagtaagatcgtgatccagcatgtgaatcacccgggaaacgttcagccccttaccgccagcggtcttgcgaacatttttgacgcgattcaccgtgtcgattttaagatgttcgagtgggtaggaaacgtcgattgaggggtttaaagtgacggttaaaatcatgaatttcttctccttctgagcgtgagctggcgcggttaggagccggagtgtaagcggccttgggcgtgatggctcgtttttggccattgcgaccaaggtccttacatgcaggctcctgcgccagggaacgcgttatgatgagcgtgagctggcgtgcattcattcaaacgtaacgctgcactgccgccagtcgttcatttaataaaagccgattccctggggagtcggcttttatggcctgcacacgaactaatcgtgagtaaccttgtccgtccaaggggtggcagtttcagccaaaaccttgttcaaacgatcgatgttagctttgccttcggtttccagccacttcttaccggctgcttcgccttcagcagcaaatggcttaacgcctggcttccaggttgcccgaccgcagagaacaccgttaaaggttgaacctgcttccttagcaaatttgagttcttcgaggaataattcatttgaaacgcctgccgaaaggaaaataaacggcaaatcggtggcatctgactgtgccttgtagtacttagcggcttcttccttggtataaaccggtgtgacaccttcatcagtaaagccttcaacaaacttctggtcaaccggaacttcaactttgaggacagaaacgttgtactgtggcttgctgaattccttggtgatcttgataaccttttcaggcttagccttggcccatgcagcggtgccggtttcgttggtcttaccatcgtaagaaaccaattcaaggaacagcggcaggtcgttggctttagcttcagcaccgacacgttcaacaaaagcatacttgcgatcgttgatgctgtctggttcgtctggatcaatgtacagcaagaacttaaccgcgtcgccgccttcgttcttgatgcgcaatgcactctgattgtcgatcaaatcagggaaacggccaggttcggtcgcatcgtagccagtcttttcgtaagaaagcagcaagccggcctgaggtgcccgaacctttgcagctggcaagccatattccggatccagcaaaatggagctagcgtacttggttaattcttcagatacagcttttttgaaatcaacaatcgtagtttcgtcagccggtttgttggcagcagctgccagcatcttcttcagggacccacgttgatcaatggccaaagctgagataacgttgttgtcatcagaaagttgttgtaaatgtttaaattgacccgcagtaaggttaacagtcatatgaaaattcctccaattcagtaaaggttagtgagcgcgttaacgctcatgaagccaaattagtcgtgataaacgccttcgtcccacttttcgagttcagcatcgaagaagtgcggattgtctttttgttctgggttaggcttagcaattttgtcaatcttgtcgatgatcttcttgttttccggagtttccttgtaagttgcgtcaaggaaagctttaaccgtatcttcaatcaaatggataccggtaacggcgccaccaatgcctaagacgttggcattcaattgttcacgcgcataaactgctgaagttgcgtcattagccatcgcggcacgaacgccttcgtttttatcggcagcagttgagataccgataccggttccgcacattacgatacctaaatctgcgcgcccatcagcaacgtcttcggcaacgcgtttgccataaattgggtagtgagtacgatgcgtgtcataggtaccttcatcaatcaccttgtagcccatgtctttcagcatattggagacttggattttttcattggtgacaatgtggtcatttccgattgcaataatcattaggatgaaacttcctttcttggcttaaaaataaacggagacgtaacttagatcatcttttccagcatgtctaaccgaatctgatgacggccgccagcatattcggtgtcgaggtaacgttgaacgatagcgatggcgcgatcaggaccggtgatgccggtgccgatagcaatagccttggcaccattgtgttcagcggtcatgtgcgccgtgttttcttcttgaacaacggcagtgaccatacccttaaccttattagaagccatagctgagccaacgccatagcggtcgaacataatcgctttgtgagcgtcgccgttcagcaacttctttgtaactgccaaagcagattcaacaaaatcttcagcaggttcaggggttacatcagcaacttgatactgatgatcctccaaatacttcttaacctgttccttcattgcaaatccgtctttgtctgcaccaataatgacatccataattcaattctccttctttgtttgtgagcgttcaccggctcttaaccgcgccggtgaacgcattatgattttcctacgataacagaggtatactcgctaaaatgctgcttatcgtcagcgctgataccatcatccgtgatgaggccatcggtttgatcgaggtcatagaagctgtaaaaatcttgccgattcagtttaaaatgatccgcagcaacaaacttcatgccggcattgttgagggcaatccgctgggtctgcccctcttcaggactggcattgctgatatggttgtcggcaatcccgttgacactgataaaggccttggtggtcgtgaggtgagctaacatctcattagctaagctgccaatgaaagcaccggagcgctctcgcagctggccaccaatcagtttcagtgaaaaataatctgcacgatcctgaaaactctgaaaaacaggaaggctattggtaataatgcgcacttccggttttttgaggtactgggaaatgagttccatggttgtgccgggaccgatgtacaccgtatcgcctgacgtaatgatgtctgcgatggtcgcagcaattttgcgtttttcgttgacgtgaatggatcgcttctcgtttcgggataattcggttagcggcttaaaatgcgtgctttgggcaccgccgtgaatgcggattaactcatttcgatcggcgagctcttccagatcccgacgcacggtcatggttgaaacgcctaaactatcaccaatttcgtttacggtcacaatccctttgcgatccactaagttgcgaattgtcagcaagcgctcgtcttttaacattgaatcacctcacatgatctgttcgttgttgtttgtttttgttccttatcacatttttaagttaccaccggcgacaccattcgtcaagctcataatgacaatgtttaacgccaagtttgcgatttttgaacgccttgtccgctttcttaagtcatcgattattgcctgaataaactcacaaagtgcccgaaaaagtgaacagaatataacaagccttaacatatggtatataccggttgtggaaaatctcacgggcttgtgattgcaacagaatagaagtcattaaatgacgagcttttttgatgaaggagaacgtgtgtcacctgctgcaccaatcagttgataaagacaaagaaaagtcggctcctgcaggcaaagtttgtcgcgggtcggcttttctaaatcttctatatgaaaatgatcgatttcttgtccatttttggccttctgaaaattgcgttggcggattaaatgcgtagtatataatagaaacgaccgtttatcctaagtccggaagcttcagcaaatcgtcagctcgctgcaagacggcgatgcgtggggcgacagctggtgaaggcggcgttgtccacccagcaagtgcaaaagcgacattcgcgttggcagctgcttgggcatcggtcgaggtatcgccgatatagaccgttgtttctgggttgccacctagacgttcgcgagccaatgtaatcggatcgccaaatggcttgttgcgtttggcttcaccagcgacaactaccgtctgaaaataaggactgaagtgatatttcttgtcctcttcaagaaactgcggtttatcttttgatgtgacaagaccgagtttatattgccgacctagctgtttaagaacggcttgcatattaggaaaccagctaacgtcagtcaaaaaagcctttgaatcttcccgccactcttcgtgaaccacgggaacttcttcatcgctgaagcctagttctttcaagctatcaacgcctgcacggccattggtccaagtcagatcctggataggtaccttgcgaccgtgccgccgcagcgttttctgtaaaccgtagagataaccctcgacattatcgagtaaggttccatcgatatcaaagataaacgtgttcataaattttcctcctaaataaccaatattattgtagcaagtaagcggtaacaaagaaaggcgttcaaatgcgattcttacacacagccgattggcatattggcaaaaaattaaatgattttgacttattagcagaccagcaggcagtttttgatcgactagtggcggttgcgcaggcgcaacaggtagacggcatcgtgattgccggcgatttatatgatcgggcactgccgagcgaagcagcggtggcggtgctggaccagatgctcgtgaagttgaatcgcgacttgcattacccgttgttggtgatctcgggcaaccacgattcggcggtgcgtttgcgaaccggtcgttcctggttttccgccacccaaatgtatgtcaatacgcagttagccgaagcatttacgccgattgagcttgatggcgttcaatttttcctgctgccgtattttgagccgttcgcggttcgcgactattttcaggatcagaccattacaaacgttgcacaggcgattcggccgatcgttaccaagatgaagacgctgttcaaaccggggatgcggcatattttagtgagtcatttttttgcggctggcagtgaccatagtgcttcggaaacaaaagtgaatgtcggcggcttggacgcggtgccgattgatgatttgacggcatttgattatgttgcgttgggccatttacataatcacaatgcgttgcatggcgagccgaaaattcaatatagcggcgctttgctgaagtatgcagtaggcgaggcgaagcaggaaaagggtgtctacattgtggataccaaaacgatgcagcgggaatttgtgccgttgaagccgcagcatgacttactggaattaaaagccagctatgcggatttgaccgatccggcgtattaccaaaagcaggatcgagatgcctacatcgggattgatttaaccgatacccaggtgattcccaacgtgatggctcagctgcggcagatttatccacgcatcatcagcttacgacgggaaaatggtgtccaagcggtgaagccattgcaacagcggcaacgtgatctggatccggtcagtttattgaaagccttttatgaagaactgatgcaaaccgatctgacggctgatcaactgaagtgggcaaagtccggtcttgccgcggcagaaagcgagcagaagcgatgaaactaaaacaattacacatgcagttttttggcccgtatgcagatgaaacggttgattttgatgattttcagaccagtcccttgtttctgatcagcggtccgaccggcagcggaaaaaccaccatttttgatgcgctggtgtatgccttatatggtgaaacttctggcgagcgggatggcgttcagatgcggtcgaattttgccagtcatcatgatttgaccaaggtgacgttgacgtttgagcatgatggcaaacactactcggtcacgcggcagccgcaacagttgcaacaaaaaaagcgcggggatgggcttaccgaggttaaggccaaggtcgtgctggcgattgcggatggcgataagcaagtcgcggaatataccaagaagaatcaggtgcaggcgcagttagatgcggttttgcatctggatgccaaacagtttcgccagattgtgctgttgcctcaaggcgattttcggcactttttggatgcggacagtaatgctaaggaagacttgctccgtgacttgtttggcacgcagctcattcagcgctggcagacagcgatgttagccaaaaccaaagagcagggcgcggaaattcaggatcaggaacgcatgctcaacctgctgacatctcagtttgattttgaagtcgagccagatgaaaatgctaccccagcggacaagttggacttgatgcgggagactgtcgaaaagcaagcggtgactgttgcggcgcgacaaaaagccgctgacagcaaccatcatgcctatcaggtcgcacaggcagcgcttcaggcaggcagacagttggcacaagcgttcaaagaccgcgaacagaccaccactgccctggcggaactcgccgagcaggaaccagttcagcaagaccggcttaaacgcatggctcaattaacctgggttcagcaacatgaagccgctgcgcaacgagtcgaaaccacgacacaggatttggccactgcgcggaagcaagcaacgcagatcaaagcaaccttggtggcgacccaacagtccatggatcaggctaaaacaagcttggttgagctgcagcaacaagagcctgccgttgacgcgaagaaaaaacagcttgatcaattacagtcggttcgcgaacaactggttgccatgagcgcgcaaaaacaacaggcaacgatgaaagcccatgcggtcacgaaagcaagtgctgcattgaagaaggcgcagcaaaaacttgcggacgatcaacaatcgcttacccagcagcaaaccgaattatccgacttgttagtgaccgatttagcaaaccgagcggctgaacataaacaattattggcgaccttgacgccaattgcggcgaactatcaagaagcgcaaacagatgcttttacttttggagaaaagctggcaaaggttaaaacatcgctggaaaaagcgacagaaaccagcaaaactgcggcgcagcaattgaacgatctgcaacaaacccagatcaagcagcaaatcgcccggctggcggctaagctggaacccggcacgccttgtccggtttgcggtagtcttgagcatccccaccgagccgtggccacgaccgaaccattggtaaccgaggcggccatcaagcaggcggaacaaacgcgtcagcaggccgctgcaaaagaaacaaccttgcaaacgcaacttaaaaatcttgaagaccagcaggcaacggtgacccgaaaagctagtgttgcccaacgtgactttgtggaaaaactggcccagcaaccaagtctcctcagttctgatgctgacaatgccgatattttggttcaattgagtgcgtttgaagctgagactactaaaatcgtgaagaagctggcagcggccgaggcaaaacaaacagcgcttgagacagcattgaaatcgttgcaaaccgctgtcacgaaggatacggacaaggttcaagccgctcaagatgcagttaatactgccaaacttgaggccgctacggctacgagtgcgctggcaacgatgcaagcggcgctgcctgaagggaccagcgatttggcaactgtgaccgcacagtcagcggaactgacccaagcggttgacacctatcagaaaaaccgccaagccgcacaagacaaagtaagcgacttggatcgccagctagccggactccatgccgatgagcgccacgccacggagcaaattgccaaactggaaaaagaccatcaggaagcaacggcggcctttttacaagcagtaacagaatattttggcgcagatgggtccaaacaatttactgcactaaaagagcaattggatcagttgccgattttgcaacagcagactcaagactataacaatgcggttttgaagcaaaagacgttattggaatccagcaataaaaccattggcgatcagcacgagccggcgcttgatcaacttgaagagcaggccactttgacggaggctgcagcaaccaaagcccagactgcgttgattgaagtgcagcaggcgcatgacacggccaagaagttgttgaagcaggctgcggacattttagcaaaaaataaagccgcgctggctgcctatgctgacttacagacgttgacaacagtgatgaacggcaatgggccgaagaagctgagtttggagcggtatgttctgcaagcctatcttcagcaaattctggatgttgccaacacgcgcctgcaggttctgtccaatcagcgttatcagtttgtgctgcacaccgatctgggtacgcaaaagattcattccggtttggaaatcgatgtttatgatgatcaggttggcgaacagcgtgcagtccagacgctatccggcggcgaaagcttcattgcagcccttagtctggcattagcattaggcgaggtgattcaacaggaaagcggcggtatcaacattgatgcgttgtttgttgatgagggattcggcagtttggacaccaatagccttgatgtggccatgaacgccctcgagtcattggaaggcgaatcgcggctgatcggcattatatcccacgttacggaattacgcgataatattcccgatcagcttcaggtacaaccggcaggaaccgggcgcagtcggctgaaagtgttgcatatggcttagttaagggatgttgagcgcggtgcgacaaaagttttacttgataggaatatacccatatggtaatgttcaatgaaacgattggtatttttgcaagcactgaacatggccattgccaggacggatttatgtttgaagtagactttaatgattcagcacccatgaacattgtgccaacgacttcggcagctgatgcgttgaaggaattgatggcatatcacaatattacgcagtctgagtttgcggagcacattgacgtttcgcaaaagcaactctcatttattttgaatcggcatgcgtatatgagtatcaatgttgcgcggaaaattgagcaagccactggtcttagtgctagatggcttttacagcttgactttaattatcggttgtcacaggctgagaccgatgaccttgctcaggttaaacggtttgagtgggcgaaaccccaaaagaattaagcttgaaaaacatatgctggaaggccaaaaattcatttgttcttctcctgagtcggtgatcagattaaaatttggtgtgtcaaggtgccatttaagtggtataacagaagttgaaagggtcaaaccttctaactcacaccaaaaagaggcgacatcacatggcatcattgagcaaagaacagaagaaagctttgatcgctaaggtcgaaaaggagcgccaagaacatcctgaaaagaaacctaagaagtcaggtttcgaaacgattgacgaagaagcagaacgccttgaaaatgaaaactaatttttagctgagtcatggattccaaatgagaaattgtttgggatctttttttgtgagcgtgagccagcgcgcttaaaagctggagtataagttataagtggccttgggcttgatgacccgggcttggtcattgcgaccaaggtccttatacgcaggcttctgcgctggcgagcgcgttatagaacgtaacagcccaacctatctttgcagacaatagaacaaataccgatgccgctaaaatcacttacggccacaaccaaaagtaccccgatgatggctacttccaacaaaggtataggtaaatacacaacccgaaaacacagtaatgacgccccataacaaccgctaaccaaacttttttcaaaaaactttagcactcggcgttcacaagtgctaatttgtggtataactataggtggagcgagggagaaggaacaaaggctccggagctaagatcgttctcctgaatccccaaagtctctgattgaaaggaagttatctgttatggctaatgaagttatgaatcgtcgtaataatgagttgatgaatgatgttaatgatccgttctttgacaacttggcacgtcggttcttcggcccggtatctgactggatggattgggcaactccttccattgccagcacggccgtcaacggattgctgactgacgttaaggagaccaaggacgcttacgaagttcatgttgatgttcctgggatcgataagaacaacatcaagttgaactaccatgatggcattttgagcatcaatgttcacaaggatgacatcacagatcacgccgacaagaacggcaacgtcatgatgtccgaacgcagctatggcacgatgagtcggagctatcaactgccaaacgttgatgacagcaacatcaaggcaaactacaaagatggtgttcttaacatcacatgcccaaagttgactgaatcaaaggagtctggtcacaacattgaaattcagtaatggattgagtagtgtttgtcgtcaggcggctcaagactcacgaactgcattgcaagcatgatcagaagcggcaccactgtcgttgatgggcaaaacccagtagtaagcaaaacgaatcgatgagaattgcagcagttgcagtgatcattgaaccgtaaaaagaaatcacctctgcgatacgtatgatcgtaggggtgatttttttgtgagcgtaagccagcccgcttagaaaccggagtgtaagtggccttgggcgtgatggcggtctttgccattgcgtccaaggtccttacacgcaggtttctgggctggcgagcgcgttatagaaagcgaaacttaaccattccattgcctcaaatagaacaatccccatcaagccaccaaacagtttcccaacaccaaactccatggtaagctaacttctatgatgacaaacaacaaattaatggattggccgccagaaaaagtagcggcatttcaacaggcacttttagattggtatgacggacacgcgcgaacgctgccgtggaggcaagatcatgacccttatcatgtgatggtgagcgaattaatgctccagcagactcaggttcagacagtgattccgtattacaaacgcttcatgacacagtttccaactgtcgaggcgttggccgcagcaccggaagcggcagttttgaaggcttgggaaggtttaggttattattcacgggcgcggcgcctacagcaggcagcgaaacaaattgtgaatgattatggtggaaaatggccacagacgtcagctgagttacaaacattggctggcatcggcccttatacagccggcgcgattgcttcgatcagcttcggcgaagttgtgcctgcgattgatggcaatgcgtttcgggtgtttgcccgcttgttcaaagtggacgccgatatcgcgcggccgcaaacgcgccaagtgttttacgatctgattcgcccattaattccaaaagatcgtcctggtgatttcaatcaggccgtgatggatcttggctcaagctatatgtccgccagtcacccggatcccgaacactcgcctgtgcgtgactttgatgcaagttaccgtgatggcgttgtggcagattatccggttaaaacgaaaaaaccgcgaccagttgtgcatcgctattttgctttggtcgtgcgctctgatgccggttatttgttcgagcagcgtcctagtaccggtatgttggcagatttatggatgttcccattgattgatatggcagatctcgaagctactatgatgagcgatcaactagatgaagtgagtcagacttttgctgcatcatcaggcttggccttaactttcgccgatcttggcgtcaagcaggttcaacatacgtttacccaccaacgctggcagatgacgttaatcggggccgatgccaaagctgaggagctgaagtttatccctgcacgttgggtggcgcctaaggattttggcaaaatagcactgccaaccgtccagaagaagctgaatcaggcgctaggattggatgattcagattagattccaggccattcatgtcgcgattagcagcaagctgaagcgggccaatttttagctgttttatagaaaagggcgttatactgtggtcatcgtgatgattgagaggcgattattttgacagttaaagtcaccaaagatattgcttatggcgatgctcctttacagaaactcgatttctatgagccggacaaaccaaatggtgcggcgattcttgatattcacggcggcggttggtttcgcggtgaaaagaataaggaaggtagcatggccgaacgcttcgccgcgcttggctatgcggttgccgttccgaactatcgattagcgccggaagcctttttcccagcagcgcgggatgatgttttagcggctttttcgtggctgcgtgatcatgtggaaacgaaaaagctcggcgttttcgggtcgagtgccggtggttccttatcggttgacgttggcttggctgaaggcgtgccgatggtttcatggtcggggatttttgacattcaaaagtggtttgccgcgcatccaaacgtcgtagcgcaacctgataccaaaaccgattttgtgaacaccgcgagcgctaaaatcgaccaaggtggccggaacgatccattttacaagtggttcattttgaattatgtggatgcagatgagaccaagtttccgcaagtcgaaccgtttgaacgcttgacagcgcaggcgggtccgatgtatctggctaattcacaagaagagattattccggtgagcggcatttatcagcttggtcaagcagccgcgacgttgggcgtgccggtgacgttgcaggtcatccccggcggccagcatgcggaaggttatcttgccgaagcgtggccggagacagtcgcattcttggcgcaacacttactgaaggggtcaaattgaagacattagtggttatcagccatccgaatatcgaaaaaagcgacacacagcagtttctaaaagccagtgccgcttctttgtcgcaagttgtgtggcaccatttagatgcgaacttgccgtttgatgtcgctgccgagcagcaaatgattcaggaaactgaccggattgtcttgcagtttccgttgtattggtacatggcgcctgcgagcttgcatcagtggttgacagaagtttgggtgaagcaattcgtttatgacacacatggcggccttttgaaggggaagtcattgggcctcgtggtgagcttcagccaaccggaatcggcttatcaacttggcggccaggtagggtttagtttgagccaatttttggcaccttatgccgcgttggccgaaaagaccggcttgcggctgttggcgccattggccattgcccgattcgccaaccaaaatgattcggaacaccagcaattactgatccgctaccagcaatatttgacgctgcagcatcctgataactttgaagcgcaggcgcagtggtttatcgatcggttgcaggaagatcccaagacgacaatgctagctgaccaactggctacgcaaaccgatgaaattgaccgcttgcgtttgacgttacatgagttgaaggcaggtgaatcggaatgacaaccgatgaacagtggctgatcaacgcggctgcccagcatgaaaaagatgcggtatcttatgaaaaggcggccttctttgcggcgttgcaaacttttgtcgcgcagcaagccgagcggcgcgaacaactggaagcagaaatcgacggccgtagctggaatcatgagcaatggtaaagttcagtctgacgacggaggggcattgccgggcaatatgctatgctttaattagcaaaacaagggagcatcggatatatgcaagcaatgtttgatcgtcttcaacggtggtcgtggttacgcggccttcttatgattctgatcggagcatggattttaattgaaccgcaccaagtctatcggagttttctatggatcgtggctgcggtgttgattgttgcggccattcccaagctggtcgacggcttctcggctaaaaagcgctccggaacttatagcacatcgctttttacaggcatcgtctatctgttagtagccctgctattaccggcgattgtcatgccactgatgagcatggggccgtttatcatcggcatcgtgttgatcgtttatggcatcaataaaattatgagcgcccgtcatcagcagcaatatgtgaatgtcgcaccgtggccaaccatcgtctatgggattgccctcatcattatcggggcgatcatggtgattaacccattcagaaccgtgatgatggtcttctcgttattcggcggattgctggtcgtgatggggattctgcagttgtttggtagtaagcaaaaataaaacctatgtgtagaaaagtcgcggaccctgctgtctacggctttttgtttcatcagcaaccaaaaaccgcactaccttaaccaccagacaaattaattgtgtttcaccgccaacatcgctaaactctgtggcaggaatgtgataagcgcttacagagaggggcaataaaatgagcgaatttaattgggaggaagtcgaacaggacgaatattcacgttcggcaacgccaagttttgttaaattgacgacgcggagttatatcacggcaatgggggttgcgccgaatcggttagccgatgaaacgtttaccgatttagcagcggctgtcacggcagtagccaagcaaatcagcgaaggtcctaacgttggcattaagatcccgaattttaaggcgtatcgaccttatccattgcaggcggtttggtcaggcggtgacaaaatcagcagtcggcatgttttcagaatatggctcaagcagccgttgtttattgaaaaggcgcaatttacggctgccttggcgcaacttgattttgatcctgccatcgccaaacagctgcattttgaacaattggcagaaggctttgagattcagagtttcagtgacacgccgctggacgatagcgcagttgccttgacgcggattcagacgatgattgcggacaatcagctggtgccgaagtacaatgatcgccaccgtgaagtttacgtggccgggtactcgaaaacagcccctgtacttttgcgaatggcgttagacgaaaattttggacagattgatgaagagcatgtcgtctataactaatcgataattgtggtattaaacggttaaggtggccaaactaaaatcggtgcaggaaactgtctgggtttcctgcaccgattttgttttgcagttctgtgcgttgtttagttttgcgggtaaacgatctgattagcccaatgattgatcgggccgtattggtgaccaacggcaatgggatggccgatcgcctggttcgtaaagcgtttggcaatccgaatggcgtcttcgatcgtgttacccttaccgatttcagcggtaatgacggctgacagtgtatcgccggtgccattgacccgatcggtattgtggtaaggttcgctcagccagaaggttttgccgctttccagcaacacgaagtcacgaacttctttttgctcaggattatcgtgtgcgccttttagaacgacattcttagctccggaatcttgcagttgatgcgcggccgcctcgatgttggcgtccgtatcaagcttcatgccggtcaggtgctcggcttcgtagtgattcggcgtcacaacagttgccagcgggatgagatcatttttgacggcgtcgtacgcgtcttgttccagtaacatggcaccgtgtttggtgataatgactgggtcaactaccaacgcgccaaaatcatattgctgccagttcttgataatgtcctgtaccaaagcgcgatcagccaacatcccggttttggccgcgcgaatcttcagatcagcggccaacgacttgaattgggcatcgatgaacggcaatggcatcaccatgctgtcctgaatgccataggagttgccggcaacagcagcggtcaaaacggtggcaccatacacaccgcgcataaagaaactatgcaaatcggcttgaacgccggcactgccgtcgctatccgtaccgccaatcgtcattacttgcggaaattcattagccatggaaaaacctcccaacaaattgtgagcgtgagctggcccgcttagaagtcggagtgtaagtaaccgaaatatcctcacacgtagaattcatcaccagcgaacacgttaagctgcctgatctgtgatgattaaccttaattaaacgcccgtttctgcggcaatacggctttgagccattcaccaataaacggatattgccggtttaattcaattacctgagtttccggatccggatacttcagataaaccatattattatcaggatcaatcagaactgtaaagagtttttgattgggcagcggtaattcgtagacacctttttgtttgccttgccgcattaaaatcgcattgtttgacgcaatgacaaatagttcgtctaaagcaggagagttattgccggcagcaacccgcacgactaatttgagatggtgattgaccagttcttccggaattgtcgtcgatgcccattcgaagcgatcacttttcacatcttccgaacccagatctttccagtcgtggccgtcttcatccagaatctgataatcgagcactttgctttcaagatctaaggtgacattaatgctaaaggcgcctgctttgacaaccgtctttttggcaactaatggcttgaggttgtcaaaacgggtcttaaagtgtagcccgttgacaggttgtaagactgtttcatcaattgatgagaactggtagccaccttggttaagcgccttggtcaacgcagaaagtgccttgacttcatcgtcatcgtacggcaacgcatggctgtcgctggcggttatctgcaataaggttggcagattgaccgctttgagcgtcgcatcggcgcttaaaggattcacgatcgtcaacaaggtgttattgtcgttttcggttgcctgaatgagcgtgatttcgctgtgctgtgaatcggtcgttgtatctttgaaccacaacgtttgcaaaaagttggccggaattgacgccatgttttgcaacgtctgatagagcttatcgcgcatgaggccggtgtagctggctaataatgccgtcaaagcgtcgtcattggcgccccatagtggggaatcagccagacggtcggtttcggtttgataagcggtactaatttgttgccgtaattgggaaacagataggggcttggcaattaaggcagccagatgtgtgtcattcagattaagcattcgtgcggcctccttcaagctttaatgactgcatgaaatcgtcctttaaattggcaaggacattttcaaattcagcaacggaactgtaagtattcatgacggcctgatattcatagcgcgtgatggctgcagaaacttccagttcgcgtttgcgcttgtcaaaggtgtcatcagcagccagcttttctttgtcaaagcgggctttgagttgtgaagcgtctgcggctgaagttcgggatgtcggtgcaggatcatcgtcgtcgtttggatcgatgaagttcttcagcaacccccggaatccgctaccgccttgggcaggttggtcgcgttccggcgcagcctcggcttcgagattatcgatttgcgtgtgcagcgaatcaacatcgcggtacacttccttgcgcatcgcatccagttgtcgatctaaataatgatcaggatcagcggaaaaggcttctaattgcggcagaattttacgctgctcatcggtcgactgggtgatggcgcgtaaaataacgttgatatgaccgaagtcacgacggtggtaccagttaccaaaatagacggttccttggtcgttgacctcaaaaaaagggatgtgctgacgtaaaaaatcaatgaacccgatttgcaaaaagtcgtgcaactcggcttgggcgcttttgtcgtaggctaagatgtaaccaggggcttcttcgatgtctagccgcaagttttcggcggttgcatcgattccctgatataagcgataacgtgattttttatgccaggcatcggtaaaatcactgaagaattttttttggtaagttagactcgtttcgattgacatttaatatcctctcacattctatccggttattttaagtgtaccgcataaacaggcatataaggaagttttattctcatttttgccacagagaaggttgaatcagccgctttcatcaaatgcatgctagaatgaaatcaaatctggttggtaagcgtaaacgaaatgaggtatgaagatgaaaatagctgttttaggtgcgactggccgggctgggagcgcgatcgttgccgaggcgcagcggcgtggtcatgaagtgttggcagtcgttcgggacacgcaaaaagcggctagtcgacttggccaaaatgtgccgacactggtgaaggcaccactggagttgacagaagctgatttagataacgttgatgccgttgtggatgcgctgagtgtaccgtggggatccggtcgcgggtatttgcatttggactttgcgacccacctgattagtttgttacggaatacggacactttagcggttttcattctggggagtgcgagtctgtcgatgccgggcgcggatcatcccatgattcttgattttcctgaaagtgctgcaagccagccgtggtatgacggtgctaagtatcagtattatgaatatcggttcttgcagatgaccgataatgttaactggatcgggatttcagcgagcgaggcgtttccgacggggccggccacgagttatgttgccggtaaggataccttgttggttggcgaagatggacagagccacattaccactggaaatatggcattggcgattcttgatcagctggaacggccgactgcgctgcaggatcggattacggtgcgtgatgcggatgcgtgatggtgtggttggttgtttgagtgagtaaaacaaaacacgatccttggttcgatggttggcggtgtggtgtggctggtcatcgggcgggggtcgtgttttttggtttgtaagtatgtaggtggactgttgtgttctgtaaggcagttgatggcgtgggggctgcttgtaaggacttcgaatggttgaagccgcgttaacgggggaatgctttctattataggcaagtatgtagtcagagtttcgtgttctataacgcgctcaccagcccagaaacctgcacataaggacctcagacctaaatggccaaagaccagccatttaggtctgaggccacttatgctccggtttctaaccgggctggttcgcgctcaacaaaaaaagaccccacgcattgggggtgcgcggggttcccgtgtcagtgccattgggggtggtactgacttatttttactttggaggagtaaaaatgaaaaaagttgggttggggtagtagtaagaagggggtaaacttccttgctacggttaaaagaataatccgtaaatgtgaactttttatgacgatctgacacaaaattttagaacacgtgttttttcgctggttttttggcaaccaccagcgtttatttgggaataagcggcagattgtcactttccgtcaaaaatagtcaattaattcgataagccttggcaaacgtgacatttcgctggtctttttcccaaaaatgaggccattaacgggaaattttgggcgaaaaacgttaagatttaaggaagacaaagatgccagttagaaatttaaaaatggggtaatttgatggatcattcagtgtcgccagttaatcttaatagtctgactactgaagaaaaagtgaaattgacttcaggaaaagacttctggtcttccgaagcgtttcctgagcacggtattcctagcattcggatgagtgacgggccgcatggtttgcgttatcaagctgcggaagccgatcatctgggcatcaatgacagtgtgccgagtactagttttccaacggctagtgccagcgcatcgtcttgggatcctgaactcattgctgcaatgggtgaggcgatcggactcgaagcacggagtctgggcgttgatgttgtgttggggccgggcgtgaatatgaagcgcaatcctctgtgtggcagaaattttgaatattttagcgaggatccgtttttggccgggaaacttggttcggcttggattcaaggcattcaaaagcagggggttgcggcttgcctgaaacactttgcggcgaataatcaggaaaatggccggttgtcgtctaattcgatcattgatccggttgcgctgcacgaaatctatctggaagcctttcgcattgcggttactgaagggcatccggaatcggttatgtgttcttacaataaagtaaatggtcgctatgccagtgataatcattatttgatgacgcaggttctgcgcaaccagttcggctttgacggcgcggtcattacggattggggggcacttaacgataaggtcgcttcgctgaatgccggtacggatttagaaatgcccggggatcagcacctttttgacaaagaggcgttgaaggcttttcagaccggcgagttgcggcctgccagtctggaccgcgccgctgccaatattgccaaaatggcgcgtaaacagcgacctaagttcactggctcccgtgaggacttgctacatcagcatgcccaattagcgcaaaaaattgcggaaagtgccatcgtgctgttgaaaaacgatgacggaattttgcctttagctgctaatgagcaagtagccgtggtcggcgagttggccaaagagacccgcttccaaggtgccggttcatcgcatattaaggcggcggaacaggtgccgattttgactggactcaagcaagctggcatcgcttatgattacgcggcgggctatcgactggacgatcaagtcgatgaggaagcaatcgctcaggcactggaactggcccgcacccacgacaaggtcatttttgttgccggattgccagataactatgagtctgaaggttttgatcgccaaaatatggccttgccgaaagttcaaaatgatttgctgcaggcgattgctgcaattaatccgcatgtcgtcgttctgttggtcgccggcgcaccggttgagctgccatggttggatcaggtacaggcggttttggatttgtatttaggcggtgaacagatcggagcagctgccggtcgggtcttgaccggacaagtaaatccaagcggtaagttggccgaaacttatccggttcgttatgcggatataccatctgcggagctttacgatcaccgtacgcgttccgtaccctatgtcgaaagcacgtatattggctaccgttacttcgacaaagcgcaggtgccggtggcgtttccgtttggttttggcttaagctatacctcttttgtcattaaaaatgcgcgcctcactgacgatcacgtcaccgatgaccagccagttacggtgcaggtggagctgacgaataccggcagtcgcgatggtgcagaagtggttcaggcctacgttcaggagcaggcggcacgtccattgcgcccaatcagagaactgaaagccttcaaaaaggtgttagtcaaagctggggaaacgatgacggttacgttagcaattccggcacaggcgttcaaagagtggcatgaacaaacccagacatgggaactgcctgatgccgcaaaagccgtggccatcgggacaagttctgcggatatagtcagtgtcttgccggttcaagttcacggacaggcctttacgaattttgaaaatgtccctgattggtataccacaccgtctggcaagccgaccgttcatgattttgaacaactcaccggtcaaaaggtaccgccgcatcatgagtttgttcctggtgagttcacgcgtctgaatacgccgcgggaaatgcagaaatattcgtggctgctgcgcttggtcgcacggacggtcattaaaatgcgtaccaaggattacattgacaaagacggtccagaggccaagttccagcaggcgatcgtgttggacacaccgcttattcggttggcccaacaagcaagtggcgcacttagactaagtatggtagatcgattggtagcggccgccaatcatcagtaccttaaaatgatttttagataacaaacgtattgtaaaaagattaaaaatttctcttgacgaatgtatcttccattcggtattcttaatcccatacaaaaccgaaggaagtgttgaccgtgatgaatcatcggcaaacacaactgaataccttttttggcagcttttttggatagcggtttgcagtcagatgcaaaccgcgcaagcaacggtttgcatccataaggctgtcacattaaatgtgtcaacaacgccgcatggatgaacaataatccatgcggcttttctataccgaaaacacgggccagtcgcatggaaaaatgtgactggcccgctttttattaggcgaatgtgtttatggggagggcaagtcaaggccaaacttccgcgtgtacccagtcatctgctaaaaaaggtcttcacggttttgtcacagggtaaatacgcaacgtcacttcaaggaggactatcatgaaaaaacatcttttactcgcattggctggcatggcgctaattggcttaacgttaacgggttgtggcaagcaatcgaaagctgccagcaaagaaactgttaaagtcggtattttgcaattaatggatcagaccgcgttgaccgaggcacgcaaagggtttgaggcggaactcgccaaggccggctacaaaggaaagcgcatcaagatcgattatgtgaacgcccaaggcgatcaggcgaatctcaaaaccatgagcgatcggctggcgcgcgggaagaatgacgtgaatctcgccattgccacgccggccgcccaagcgttgcaaaaagccgacaagaagacaccgctgcttttcaccgcgatcacggatccaaagtcagccggattggtgacgaacctgacgaagccggacaaaaatgccactggcgttaccgatttagttgccattagcgaccagattgacttactgcacaaaacatttccgcaagccaaaacgattgggctgatgtacaacgccggcgagcccaactcggtctatcagatcaagcaagctaaagtacatctcaaaaagctgggcctgcgttaccagatcaagacagccgctacgactaacgatgttcaacaggcagccgaaagcctagccaaagatgtcgatgcactgtatttaccggcagataatgtaatggctgcggcgatgccgaccatcggtaaagttgccaaggagaaacaaatcccagtcgtgccagcggcgtccacgatggtcaaagacggtggcacgattaccaaaggcattgattatcgcgatcttggtaaacaaaccgccaaaatggcaatcaaactgctgaaaggcactccggtcaaaaaactcgccgtcgaaaaaccggccaatgttaaaaccgtgaaaaatgacgccatgttaaaagcggtgaaacaaaaagttaacttgccaaaataaccggtataacaaccttctttgacattttaaaccgagcaaaacctgagatggtcaaaataatcgtgaaaatatgtgttgacaagatgaaattatgaggatactcttagaaacaagccagaaggaacaaacttctgggcacaaggagtgttgatcatgagacaaagcaaaacaacacaacttaatcacgcgtactattacggctatttcggataatggtttgtatctcatggatacaagccaatcaggtttgtatccatgatggccgtgagtatttcacttgcaattaactgccacatggacgaattcatccatgtggctttttctttcccgggaaaaaagtaagaggcacgccacacggatgagtaaatccggtggcgggtctctttttagagcagagcgtgaattggcgcggttagaagtcagagtgtaagtggccttgggcgtgatggcccgggcttaggccattgggaccaaggttcttacacgcagtcttctgcgtcagtgaacgcgtttcaaactagtgtcggcggctttgcagtgttttctacatgtactgcaaaccagagcccgatgctgtcctactcacaaccgtgcgcggggaccttaagcacccgcccaaaccagcacgtcaattcaccaaacatctcaggaggaagaaaaaaatgaaactcaaacgaatcgctgccgtcgcagcaaccgcactagccatcatgacgttagttggctgtggcaagtcaaccaaagccgcggctgacaagagtcaggtaaaggtcggtattttacagctcattgatcagcaggctttaactgcggcccgcaaaggcttcacagacgaacttgcaaaagccggctacaaaggcaataagatcaagctggattacgtcaatgcccaaggcgatcaatcaaatcttcaaaccatgagccagcgcctcgcccgcgacaagaatgatcttaacttggccattgcgactcccgctgctcaagctttgcagaaggcggataccaaaacgccaatgttgtttacggcgatcactgatcctaagtcagccggattagtcgctaatcccgagaaaccgaataaaaatgccaccggtgtcaccgataaagtcgatgtggcgggccagatcaagtttattcataaggtctttccgaaggccaaaaagattggcttgctgttcaacgccgcagaacaaaattcgcaagttcaagttaagttagccaaagccgcaattaagaagctggggctgacggccgtcgaaaaaacggcagcgacaaccaatgacgttgaacaaagtgcatcggcattgatgaaacaaagtgatgtcatctacattccaaccgacaacacgatggcagcttccatggcgacgattggtaaagtcagcaccaaagaaaaagttcctgtggttccggcagacgcgaccatggttaagctagccggagttgccactgtgggcatcaactacgaagatcttggcaagcaaaccggcaaactagccgtgcagttgctgaagggtaagaaggttaaagatctgccagtcgaagagccatccaagacgcgattggtgatcaatccggaacggatgcggcaattcgggctgacaaaagccatgttagaagaagcagaataaataaacgatttaaaaaacgaggggattcgttatggacattgtgacatcgagtattgcccaaggattattatggtcggttatggcaatcggcgtgtatctgacttttcgtattttagacattgccgatatgacagcagaagggagctttcctttaggggcagcgattaccgcccatgccattgtatcgggaacggggccgattgtggcaacgctgatgggatttgtaggtggcgctgcagctggggcagtttccggatttttgaccaccaagctgcatattccggatttgttaaccggtatcttgacgatgacgggcttatattcggtgaacctgttcattatgggcaaggcgaatatcagcttaattggcaccgtcaaaacagttttcaatttgactgacagcggtgatgcgacgacaatcggcatcatggttggcgccattgtggtagcaatggtcatcggcatcttggtgttctttttccatactgaaatggggttggcggcggccgcggttggtaacaatcaggatatggcagcggcgaacgggattaacaatgacgccatgaagatcatcatttatatgctaagcaacgggctcattgccttgtcgggcagtctcatggcgcaaaccaatggctatgccgacttatcgatggggattggcacgattgtcatcgcccttgctgccattatcatttcggagattctggttcgcggcgtaccgttgtgggcgcgattgttgatgatcatcgttggcgccgtgatttaccggttgattattgcggtggtattggacatgggcgtggatccgaactacctgcgtttcttctacgcactcatgttgacggtcttcctgtccttgccattactgaagaagaaacttttccagctaaaagtgcggcatggcaatcggcatccggtcaagcaacgccaagcggtaacaaccaagacggcagataccatggcagtttcgccgatggaacagcaaaaggaggctcgttaaaatggcagttctcgaagtacacggtttgcatcaatattttgaacaaggaaccgtcaatgaaaatcacgcattgaagggtattgacttgagcctggaacgcggcgagtttgtggcgatcatcgggggtaacggcgcgggcaaatccacgttgcttaacagtattgccggcacgttgccggttaatcagggacagattctcattgacggcaaagacgtgacctaccaaaacgttgccaagcgtgctaaattaattgcccgggttttccaggatccccgatcaggcacggcttcgttattgacgattgaacaaaatctggctttggccgaaaaacgcggtgactggcgcaatttttgggcgagtggcgtgaagcggcgcgatcgccaacacttccaagagaaacttgcgacactgggattaggcttggagaaacgattaggtgcggagatgggtttactttccggcggccaacgtcaggcggtcacattgttgatggcgacgttaaagaagccggcgctgttgttgctagatgaacacacggcggcgcttgacccgcagaccagtgcaaccgtcatggcgctaaccgatcagatggtgagagcacagaagatcaccacgttgatgatcacccataacatggcgagtgccttgaaatatggcgaccggctgatcatgctggaccatggcgaaattgctgtggatgtccgcggtgaggaaaagcaaaatctgacggttgaagacttgttgacgctgttcaaagaacgcagcgggcaggagtttgctgatgatgcggttttattaagttaatggtttggatgtgaaccagctagttagtgagtgagtgctaaaaagtggcttaattgaaaagacacctgaattcccaacacgtctatcgttgggagtccaggtgctttttaattttgacagatagctgactttgctcctctaaatattctcaagccatactaacaaccgttctgactggatggtgcgtaaagtggttgtttaacgcttgcggcaggtcggctaggctgattttttggaaaggaaccggttttaattttgccagtgccgtccatgctttttgccgttgggctgttggtgcgcttacggaatccacgcctagcaggcttatgttacgtaagataaacgggaaaaccgtcagcggcaaggaagtaccggccgcgttgccgcataacgcgaccgcaccattatagcgcatgcttggcagtaaactggaagtgaagctgccgccgagtggatcaatggcgtaatcaaactgttggcggctcagggctttgcctttgggtaattcatctagcgccaaggttccggtggcaccgagatcgcgaacttgggactgctgatcaggggtgcgcacaaccgcaattcgatttgaaaatccggcattttctaacagttgtagggcaatgctgccgacgccacctgtcacgccgccgactaagatcttgggattttgttctggcgtcatgccagcttgcatcaacgcattgacgcataatgctgccgttaaccctgctgtcccgaatgccatggccgtttctagcgtcatgttcggcggtagtggcatggcccatgttgcggggatgcgggcatattgggcataaccgccgccttgactgacgcctaaaccatgaccggttgccagaatttgatcgccttttttaaactgcggatcctgactagctacaactgttccgctcaaatcaatgccgagaacttgcggatattggcggatgatttggttgtgcggctggtaagccaaggcatctttataattaatgtctgaataagcgacgcggattaaaagttcgcccgcggacagatcatctgtggtgatcgtttgtagtgtcgctttttggccgtcgtgaatgaatgcttgaaagaactgcatcgagctacctgctatataaaacgtggaagaatgtctctttggcaccaataaaggttttatatatttcctttcttgattgacaatcctacatttcatttagtcccgtcaacaacggtattcccactctgaaataattcagcatgacagtgaccgtctcctgaactttaaggatatagcctaccccgtaacctttgattttgcataagctatcagattctccaccgcattttcgtctcgccgcaacttcaccccacactggtaacaatgatagtcatcgtgacccgtacgatgtttcaagttgccgcttagcgtaacccgttcatcagcagtcttcacataaccgcagcgggaacagcgttgcgtactggggtaatactgatctgccagcaccaacgtgttaccataccagtcagccttgtactgcatgatcactttgaacttaccaaacagtgatcgatgcagattcttggcgagatgtttattcatgcgcatatggcgattatctaagtcctcaatcccaattaggtcataatcagtgataagcttcgtcgtaaacttttgcagcaaatccgtttgaatccgttcaactcgttggtattggcgtttcaacttggttctcgttgtgcgataagccttggagttaaaatgcttgggacttacttttcgcttacgggctaattgacgctgataatgagcaatgcgggcgtaaagtaatggcaaacgctcaggtaaggtgggttgagtcgcatagccagttgccgtttgatagtcaaacttaccgatgttggcatcaaccccagtggccgttagaaccggccgcttttcaacaaaagtctgaacctcaattgaaaaggaggcatagtaaccatcagcgtcttgaacgatgcaaacttgtttcaattcgccttgccaacgcggttgctcggctaatttgatgtcgtaccacgtaccagcactatgaggtttatctaaacgtaacttgccattcacaagttgcgcccgatccgttttgaacgttttgcgagatcttttcttagatttccagttgggtttatcgtgatctggcatcttcggattgaagtagtttttccaagccttacctagatcgtttaccgcaaactttaaaacttgagccgatcgttcgtactgccaatcggctttattccaaaccagttcgtcccgtactttgcgttcatttggtcgtagcgctttgtccaccatcaccagagatgcgtcatacatgctgttccaagtttcaagggcctggttccagcaaaaccggcgatagttgaacaatcgttccagttcacgccgcatggttgcgttgggatagagtttaatcttatgcgttttaatcaaaagttgtcacctcctctcaattagctggttaaatgccacttgagaggaagcttgaagtagacgttcaaaccaaggctagttagcggaactttggtaagaaccatcatacagtaccgattcaggctcttgtcaatacatttcgcagattagtttggtttgaacacacggacagcttccacttaattattctgtccatgttgtaccgcttaattccatattattcgtcatatttgagtgctgttaacctccccctcgtaataagaatcacatctatgctcaattattaactaaatcatagcagtttcattcgtaataaccaaacgctcgttattcgttgtcgctaaccagattcggttggtgccaggccgccagttcgtgccgatgctgccaacgtttgtagctttcgacaatcaccatcggcaaccagacggcgacaaacacaatgagccactgaccaagtgtcagaggagctagctggaagatttgttgaaacggttgaaggattgctagcagcagaatgatcgccatggtccccaataggctgacggttaaaatcggattactggttaaggcagtgcggttgagccgcgcccgggttttgatcgggaagacatcaagaatcgaaccaatcgccagagtcaagaagagcatggtcatgccgacaaccggttgatcagggctgacgacgaagcgtccgatcgcgtagataccaaggatcagtcccacataagtcgctgtgcgcacagcaacgcgcttactgaggccattggcgaagatgctggcttttttaggaatcggcttgaggtgcatgatgccgggttcagccagttcgcggctcaggaagaatcccggaatcccatcggccagcacgttgacaatcaacagctgttccggtgtcatcacggcgccccagccgattaaaacggcaattaacatggtgaaaatctgggcgaaattgacggaaatcagaaattcaacggctttgagaatattttggtaaactgttcgtccttgcgccaccgcgtcgataatcgtagcaaagttgtcatcagtcaaaatcatgtcagccgaatttttcgctacgtcggttccggtgatgcccatcgcgatgccgacatctgcagctttcagcgctggtgcatcgttaaccccgtcaccagtcatggcgacaacggcttgttgttgctgccaagccttcacaatgcgaattttgtcactcggcgttgtccgtgcaaagacgcgaatctgctgaatagtggcggctaaggtttcatcgctcatttggtttaactcgtgaccggtaatcgcgcgatgactgccatcgagaatcccgatgtcgcgggcaatggcggtggcagtgccaaggtggtcacccgtaatcatcacggtgacgattccggcatcttttgctgcttgaatcgcagccggtacttctgggcgcggcggatcgatcagtccaatgagccccagtggctgaacctctgtaagttgattctcccaatcagctccgggatcggctgtgaattcttggtggccggcagccaaaacgcgcaacgcctggcctgtcatctgatcatggacagaagcggcttcagtttgccagtttggtgcagaaaaggcaatccgatccacggcacctttaataatagcaagatagtggccatccggagtgcggtgtaacgttgccatggtctttttagctgatgaaaaaggggcctcagcgatgcgtgggtaacgggtttcaagatcgtcgcggcttaagccatagtgggcaagcaaccgcataatggccagctcggtggcgtcaccgatgtctggttcgtcctgatcggttaacttggcgttggtggcgagtcctaaataggatagaaaacggcgcgtgtcagtcgttagcggttcggccgtcgccttttgaatattaaactgcccgaatgaccaaaaatgcgtcacggtcatcttattttgcgttaaagtaccggttttgtccgaggcgatgacgttgacattgccgatggtttcgactgcagtaacttgacgaatgatcgcgcggcgtttggccattttctgaacaccgtgtgccagactcaaggtgacaatgaccggcaatgtttccggaactgcggcgatggctaagctgacaccaagcatcagactgtctgccagagtttcctgatgatacagcatggctaataacatggttaacgcgccgcctaaaactgcaactaatgatagccgtttgccaagtgcgtcgagccgtttagcgagtggagtgacctgctttttggtttggtttaatagcgaggcaatttttcccagttcggtattcatgcccgtcgccgtgacgatcgcggttgcttttccgctggtaattgcggtgccggaaaaaatgcagttggccgcatcgccgagattttcaggaacttcagctaatggggcggctgatttgtcaacagattcgctttcgccggttaaaacggcttcgtctgcttcaagttcctgactttcaatcagcctggcatctgcagcaacggcatcgccggccttgagcagcattaagtcacctggaactaaatccgccgcttgaatggtttgcgttttatcatcgcgaatcacggtaacagtgtgaacagtcatggcttttagcgcagccaatgctttttcggcgctgtgttcctgatataaggcaatgacaacgtttaagatcacaatactgccaatgacaatcgtcttggtccagttactgtccgtcgtcaatgcgagataagcggataggccgacagcaaagagcaagatcaatgacgtgatatcgctgaggtgatgggcgatttgccgaaacaagctaggctttttggcagcggtcaattgattggaaccattttgttgccggtgtttggcaactgcatcagttgtcagaccggttgtgaggttagtgtcaaattcagcggccaaatcgctcggcgtcagaagtgtcaaggctttggtcgttgttggcatacactcagtcctttctggtttgggtggatcatgtcaatacttacttataataaccgtaacatgacaaagtgtcgtctgtaaaattttgaatcggcgcagcgagtcaaaatacaacgattgtaacttccacgttgttactagccgcctgccaatttgcgctcaccataatgcgttcgccagcccagaaacctacgtgtaaggacctcggtcgcaatggcctaagcccgggccatcacgcccgaggccacttacactccggtttctaaccgggctggttcacgctcacaaaaacaggactgccgagtgatgaccagcagtcctgttttatcgattggttaatagaattttctttaattttgcaacgcgtgataacgataatgcggctgttgcgctgcttgggttttgaagccataggtgtcggcaacgatgtaaagcggtcgatggcgactttcggcaaacattctgccgatgtaattgccaagtagtccgatcgtgaaggtcacgccggcgccgacaaagaaggtggcactaatgacccaagtcaataaactgaggcgcccgaggagaaggttgacgaaggtggtggcaacggctattaagaggaagaagccacttaaccagttggcaatcgtcaaagggacagtcgagaagctggtaatgccgttcatggcaaggtgcagcattttccgcaatggatagtgggttttaccagcggtgcgttcttgccgatcgtattctacagcgacttgtttatagccgacccatgagaccatgccgcgaacataaggatcttgttcgttcatttgttttaaaacgttgacaacgcgacggtccatgagtcgaaagtcgccggtgtcaaccggaatatcgatactcgtgacggctttcagcacccgataaaacgtctcggcggtcagctttttaaaccaggtttcaccgcttcgtttgcggcgcttaccgtaaacaacatcaaagccttcccgccagcgcgccagcatttcgggaatcacgcgcggcggatcctgcaagtcagcatccatgacgacaaccgcgtcaccgctggcataacgaatgccggccgtaattgccagttgatggccgaagttgcgtgaaaaatctaccagccgaatcgtcgggtttttggccacagcagctcttatctgatcggcactatcgtcggtcgagccgtcgttgacaaaaatgagctcatatcgttccgttcttgcacggacgtaattagccaattccttgatcgtctcaccgataccggcgctttcgttatagactggcaaaacgattgagatgaagggatccttttcttgtcgcatagcgcatcttctcctttcaaaatgataatgggttacttgaccatgctggcgtcaagctcatacagggtgccgccacccatgccaccgcccatccccataccacctggggacttggtgcttgagctgctttgactactgtatttgtttgaagaaacctttttaccgactttggtgacccaggattcaatcttggaattacctgagcgacctgaggacaggtaatatttcatgtcgccttttttaacgagggctttgaattgtttgagggtaatggcagggtcggtaccattaaatccgccgatcgccatgactgctttgccggacttaatgatgtaaggcgcggccgtgctagcgttgctggtagcaaacaggtatttggcgctgccttgatgtttttcaacatacttcagcaatccgctgtcaacactgccgctgccaataccgccgctgttaccgccggaggtcagaagtgaaggaccggcagacggaatcgcagctgatgaaccggcaagcgtcggcgtaagtgaccagaagcctggcgctaccaaaatagcggcaatggcaacacccagggctgatttgcgccaacttctggtgcggccgatgaaaagaagcgctaagccgattagacctgcaccaaccacgagccatgtctgccactgatagtacaagctgacataccaagcctggagtgccgttgttgtcacgatggcaagtggcaataaccaactttgccaatgcttgaagcccagcttgaattgcttaaacattgtgacaatcccgatgccgaacaaagcagcaatcggcggtgcgagcataatcatgtagtaagggtggaagaagctggcaattgagaagaaaccggcgactggtacgagccaacccatccagaaaagtaaatgattttgctgagaggttgtttgataccatttacgcttgcgatcaagataataggcaaatgcactgatgaagccgattaaagcagctgggactaaccaactgatttgcgggccaaggtcggattggagcaagcgtaacgggccagcagtaccaatggcaaaggcaccgccgccaccgccaccacctttgcggccgcccggagcaccgccgcctgtaccaggtccgcctttaaagttaccttttttgaagttggcaggcattttcccgccggtagcttttttggttttgacagttgcctgctgctttttagtcccagttggtggtgttccgccttgggtgttgccggtacctggttgaccggacgtgcctttagttgacttgccacctggtggattgccggtcttaccggttgcgccagttggtggtgttccggactttcctttggttccggtaggcgcagtcccggttttacctttagtgccagttggtggggtgccaccggtcttggacttggaattattccccatgcctgggaaagctgcgccagtaccggttgtttgacctagtaagcgttcagtaccgttatagccaaaagccaattccatttccgagttcgtttcagaactgccgacatagggtcgctgagtcgcagcagtcgaatcaacctgcattggccaggctaatgtagtaaccgccatggcgacagccgcaatgcctagtgtggtaaggcggcgccaaagtttctggttcgaggcgagccagtagaaaagcaataaggccggcaaaatcataaaggcctgaagcattttaatattgaacgagacgccaattaaggcaaaactgacaaccaccaaccatggcttgcgggtgctaatggccttcatgaggcaccagctagcaagcagtaggaagaattgtagggtggcgtccatattgtttgtccgcgaatccgcaaccacaatcggcgtcaaagtgagtgccagtgcggctagtcgcgctgcccaggcattaaagcgtggcttgatcatgttgtagattaaggcaacgctgccgatgccaaacaaaatggatggtaggacaactgaccagccatgaacgccgaaaatcttggcggagatggccataaaccacagtgcgaccggtggtttatcaactgtaataaagccagcgggatcaaaagccccgtaccagaaattgtgccaactttgaaccatactggtaatggcggcggtgtaataatcattggcattgcctgcttcccatatgttccacgcgtaaagaaacgctgcgagaattaaaatgccaatgagccaccaatcaaccgtccattgtctaatttttttcatgtgccgtaactcccttttctcggaatacccagaacttacttaaaaggaagttcgtcgggacagtaaccataagcgaaaacatcggtgctaaaggcttaggtaaacccaaagcatcattccagaagctggtcagcaccagacttaaaataaatgtgaggccataagagaaatagtatcgcggcgctacacttttaagttggcgatgatctttgactttgaaaacccaggtatcattgaggaaaagtcccaagatggacgttaacccataaccgacacccattgcagcggtcggattgatcaattggtataatgtcagatagatcagataagtcaaaatggtgttgatccctccgacgagaccgaagctaatgaattgtttcagctttaggcgcatcgtatcgctcccttcctgatgaatgggattagtatgcgatgtgcagcataaattaaccttaaaggtggtcggattttttcttaagaaggttttatggttggtgtgttaggctgaaatagtggctgaagtgattgaagtatcatgcggctactggcgcagatttctaaccgcgccagttcacgctcacgctcagattagttgggagtatagaaatgacggttaaaccaaaaattcttgtcatagaagacgatccggatttgaatgaaagcattgttgacttcattcaggactttgccgaacctgaagccgcgttaaccggggcggatggtttgtatcaggcggaggaaggcgtgtttgatgcgattattctggatatcatgctgccggaattgaatggcttcgacttgctcaagcagttgcgcgccaagcaggtgaaaacgccagtgcttattttgacggccaaggatgcgcttgctgataagttgcgcgggtttgaattaggcggggatgattacctcaccaaaccgtttcaccgcgaagaactcattatgcgactcaaggcgttattgaaacgcactggacacttttttgatgatgatggcttaactgctgggccatatgaagtgtatttaaatcgccatgaagtgctgatcaatgggcaacccgtttcgttaaatggtaaggaattcgacttgctcgtgtatttgctgcagaatcaaaaaaccattatcacgaaagatcagatttttgatcgactttggggctttgactccgaaaccgctgtgagtgtggttgaagtttatatgtcgaacttacgcaaaaagttaaaaccgctgaaagttgacggctggattaaaaccattcgcaatgttggctatatttttcaagaaccggagggccgtgaatgaatgcagataaaggaattaagcggcagcagcggcgcttatttgtcggtcagctactgagtttcgccggacttttcctggtgctgggatttatcgtcttttttctgtatgaacgctcggtttatcaagacattgaccatacgttagagcagcaaaagaccatgatcatcaaaccagcgacagggatgacgacccccaacgccccacggcagccaggaggaagtcggccgattttgtttcggatgaatatggtggtcttcaataaaaaaggcaaaattattaatcaagccatgctgggcgaacgcttttatgcgtatttcaagaaactgaaattggatcggcaggcgcttaacaaactacagactttagcgacctcgactggcacatttcgaacattgttggttaaagtgccgcagacagctgcggatccgcagtatgccggtcattatgtactgattttgcaaaataccgatgctcaggaggcagccattcgctcattccggcaggttttgattgtgacgattattttattctgggcgttggcattggggttatcttattggttatcgacgcgggcaatgcggccgattgtgcggtcgtggcaacggcaacaggattttgttgcggatgccgcccacgaattgcgggcaccgctggccgtgattcaaagcaaacaggaatctctgctgacaaaaccgcaagcgacaattatcgatgaaagcgaagcgattgcgacttcgttaggcgagaccaagcgtttgcggcaattgaccgatgatttgttgacgatcgccaaggctgacagcaataccatcgaaatcgagttgacagacttgcgtttcgatcaggccttagcgccacagctggcgtcttatcatgacattgccaaaagccaggataagtccttcacgaccaagctgtcagcagacggccatgcctggtttgatgccgcccgaatcaagcaattgctggtgattctgctagacaatgccttcaaatacacgcaggcaggtgattcaatctgggttgaagtcacgcaaacgccgcgggactggcaactgattgtcggcaattcagggccgaatattgccgatgccgacaaatcccgaattttcgaacgtttttatcgcgaagacgcttcgcgcagccggcaaactggcggcagtggcttgggattggccatcgcccggtggattgtgacgattcatcatggtcacattgaagtcaaagacgtccatccccacggtgtcttatttgttgtgacgctacctaataaaccgcgtggggcttagttgtcaaatgatggcaaacgaaaagcagtcgttccgaagcttgaaatagcttttggaacggctgcttttaaatttcaatcactttttaaacaacgcttggtgacaaaaccctgatacgacgattaacgggcaggattattgcgaaccccattggcttccgtgaaatcgataaagcccatgttcgtatcaatatcgccgccatcaccgcttaaaattaacgtattaagtgtcttattgaagtggacattcatatttgcatttaaatcttcttgtgagtaacccttgatcagaatcggcccgaggttgctatcaattttcgtatcatagtcggttgccggatcactggctttgacaacattcagtgaaaactgcacctgcatatgaatcatagcgtgctgtgaataagggccaacgccgtcttcaaaggtcaaaagcagtttcttgtccggatccaaatgaggcttgatcttgtcgatggcaccttcgtcaaaatgaatttgcatgcaatcaactcccttcgccgtaaacataggctgattaggaagcaaaagcaactgattcgactcggtgattggctcaacgacgctgtggatgtggtgttacttgggatgatgggtgagaagttgccggtgttcagtcacccgcctcatagcatggagaatcctttgattatggactatattatttcgatgaaagcgattaatatatttatataagaaatgaggtaattcaaaatgacagatacagtagcagcaccaaagttaacgaacaatgatttgggcaatgtgatgtttgaccgccattcagcccggaagtttgatcccaacgtcaaaatcagccgggatgaattgcaggaaatgatcaaggaggcaaccaccgcaccctcggcatgcaatctacagtcatggcattttgtcatcatcgatacaccggaagcaaaagaaaagttgaagaaagcggccatgaagttcaactatccgcaaatcgatacgagttctgcgattattttcattgcaggggacacgcagtcgcatgaagtttatcgcgatgtctggaccaaggtttataaggctggcaagatcagcaaagagaaacttgaccagattttcaatacattcttaccgctttatgagcatgcttcaccggagttcctgaccctagacgcaaccattgatggcgcgatggtcggcatgcaactgcttttgctggcgcgcgctcacgggtatgatgccaatccttggtctggttatgactttaaaacaattattccgacgttgggactggatccaaaacggtttgtgccagttatggcgattgcaatcgggaaagcagcggaaaaaccgctgaaaaccgaccgttacgatgtcaatcagttaattgactacttggcataagtcgttaacaaaccatacgatccgatctcaagggaaaagaggaaacaaacaatgatcgatgcagttaaaactgatcctttcggtgaagtaaacgcgattgacgtgttggatctggcaagcctggaaggccgcgcagagaaggtgctcggtcgtggcgaatttggctacattagtgaaggctccgatgatggctatacaatgcgccggaacaccaccgcgtttcaagatgtggagatgctcccgcgtgtcttacaaggcgttgaaaaaccagatcagtcaacaaccttcctgggcgctaagctggcttcgccgttactgacggcacccattgccggaaacacgctggcccattcgagtggtgaactgggtttggcaaaaggtgcaaaagaagctggtattatgatgtcgcaaagtacttttgcttccaagcccattgccgaaaccgctgcagtcagtgatggtgcgccttatatgtttcagttgtatatgcccaaagactggtcatattgcgaatatttgctcgatgaggccaaaaatgccggtgcattagcgattattttgacagcggattcaacactgggcggctatcgcgaaaaagatgtcatgaatcattatcatctgaaaggccgtctagctaatctagaaggctataatagcggtcaaaccggtgtcggtgccggtgggctgttcaaagaatccatgcaaaaactagatttggcacttatcgacaaacttgccagttactcaggcttacccattattatcaaaggcattcagcatcctgatgacgcagttgcagccataaatgcaggcgcagcaggaatttatgtttccaatcatggtggccgccaactagatggtgcccctggagcgattgaacagttgccagccattgcagctgcggtcgatcatcgagtaccgattatctttgatggcggcgtgcagcgtggaacgcacgtgctcaaagccctggcacttggcgcagatcttgtcggcgttggccggccatttagttatggcttggcgcttggcggctggcaaggcgtcaaagcagtcgccgatcatctaaaaatggaaattaatattgccatgcagctaaccggatgccaaacgattgaagacgtcaaacggatgaaacttaagacgcggtttgcttaattgattagggtgggccccttacgattaggcctcagcaagcacgtttagatgaacatgcgttaccattttttgagagcccgcacccatcgcaaatttcacaccatgtaaaaagcgccacacacgaaagacataactttcatgtgtggcgctttttctggatcttaacggacttgaaccgtcgacctcctgcatgccatgcaggcgctctcccagctgagctaaagacccgctaattaagtagcttcaaagctaatggatccaaacggacttgaaccgtcgacctcctacatgcgaagcaggcgctctcccaactgagctatggacccaaaacacaaagacaattgtactgaacttctgcggttgtgtaaagaggattgtccttgatacatgacagaggattgccagccttgctataaacggcgaattttacaaggattcatctcgacgagcgattagtgaaatgatgatattttggcaagccccgccgatgatgaagatgacccaagaataggtccatgtgtgaaaaagaaaagaaactaagaagtaggtcactaggataaggggccaataaatctgacggaaaagcgcgatgtcttggctagtgcgttgattgtggtggtgctgtgacgtgtggaagttgtcgcgatggctatgatgaaggcgtggctcaggatccggcacagctgtcgcgtcagtatagcgctttatttgcgaataattgatggcgacatacacaattaagtaggttcctagtccagcaatgatgaggaacaaggcaccaccggcatcgtcgctgataaaatgcgataagtaagtggacagaatcggtgggatcaacgcgacaatacaaatcataatgcccacgattaaacccgcagaaaattgccgctgatacgtatcggttgtttcttgggcaaatcttttggcgctttcagacaagggccggccattgagccgcttcttttggaggctaaacatggtgccggcccaaatgaagagacccactgcgatagcatcaagcaaaaacataccgatgatgccgaagacctcaagcgaggaatccgttgtataggcgggcaaggcgacgctgatacaacaaagtaaaacaccgaaggcaatttgcgttgcaaaccggtcggcaatgtgccaaaaatgactgagctccgtttcagaaactgcattatcaggttccgcagttgcgtcggtgtttgcttggtcagcctgaggagctagtcctagatcttcccgtaattcatcaacggagccaaaagcacgaatgacggcaccgattgcagtttcttcgcttttaccctcgcgcaacaaatcgcgataataatcgcgcatattggcaagcatgtcggctttggcctggcgcgttttcgggttatccggaaaagaagcaaatagactgtctaaataagctgtaattgtatccatgggcgatcctccaaggttcaattttgacaagcagttagttcaaaaataaatcgaccacatgcttaacctgatgccattcttcggccttcatagcaagaaaagcgcggccgctgggagtgatgcgataataagtgcggggtttaccgttcgtaacatcacccggataagcttcaatatagccgtttttgctcaagcgagtaaaggcggcgtaaagcgtggtttcacgaatcatatactggtcatgggtgcgctcgcggatttctttgccaattttgtagccataagaatcaccttgttgcaaaatggcaaggacgagtgcgtcgttgtaaccacgcatggcatcactactgatcacggcgctcctccttttgcgagttttatactggtgtgcgcgagaatacagatgagactcatcttgattttgctggctgattacttcatctgttggagtaatattaacatgatgtaaccattaggtaaagcaaaaaaacaccttcctatcaagaaggtgtcgtcagatttacttgattagtgaacaaaaaccgtgacaaaggtgattaaaccaaacaggatcccgggtacattggcgatgatgatcggccagtctttggcaggtttcatccagccataaccggtccacaaggtggcattgatcatggccaccagtggctgaatcggattcaccggagttccagaaaagttagccatgatttccggaatgtaggaaacatacattaaaatacaggtaaaagttgccagcctgctaaggagattcagtcgctttgctttaacggggtcaataccactgtgatattttccattgtcagcttgcatcaaaaatgcctccttttggaataaaataaccgtaacacgatcgaacgtgaaaaccaaggaagacattaacgtgtgatagaatcaaataggcggcctgacttaggttggcagctttagattttttctgaaaatgaacgaaatgagggaacatcatggcagaacaagaagcagatacggtcacacgcgtgcaaaaacaagaaggcgccgatgccatcatggataaaggatttgtgaccgaacgggatattcccgaaatgatggcggcgtcttggagtgaaaagctattggcggcgattaatgacgaattgcggttgcgtactgttagcaatcgcgctgtgttgcagcgattccattactatatgggcgatggctccattatttacgatccggggcaacttaactcggagggtgcgaagattgcgttgcaacatgcactggggttccggaagtagtggcttttttctaacattttgaaactagctttagtcgctgaaggttccagttaagacgaccttaccgaccatatgaccttcttcgacgagctttgtggcggccttcaagttggcaacattaatgccggtaaattctttggtcactgaagctttgatctggccgtcttgatacaacgttaagagcttgctgaggatcgcaccttgtgtggcaacacggtagtcgaagtcggttttggcaaacatgtactcatagtcaaaactggccgctttgtctttgacaacggccagatcaagaccgctttggggaccgacaatgcagccgatgtggccaaaagcgcgaattaactggctggcggtggccagatacggttccggatgataaagcaaagcaacgccgtcaacggtttgaacgccagcctggtgaacctgactcacaagatctttatgataatcaagtggcgttgcaacgccgtgggcccgcaaccagtcatgatttttaggactgctggttgccaaaacatttaacccgctccattgcgccagttgactcagcatcgaaccgacgccaccggcaccgttaatggtcaacaaatgctggcctttgttggcattatattccgggatgaagcccattttttcaaaaagcagttcccacgcggtcaaaccgacaagcggcagtgctgcgagatcagcggtgggtgcttgtttcggcgctaatgcgatcagatcggcgtccactgcctgaaattgttgatcactgccgggcttgcgggtagttccggcatagatgacgcgatcgccaacgtggaaggcagtgacggcagagccaatttgggtaatggtgccgactgcatcatacccaagaatctgtggcgtttcttgtcgtggtgcggtttggcggcgtttggtgtcaaccggattaaccgagaccccagccacttgtacaatgacttcattgggttccggtgttggtactggtagcgtgaagctttgaaagctattgggttcagtaatgggtaggccttcagtgaagccgatggcaatattttttggcatctgaatcgtcctttcgtttgatcggttatctgttgctattgtaacctttttattaagagagttggaaatgcagtggttatttggtaaaatgtgcaggatattgtagaaaacgcgttcgcagtcgcagaaatctgcgtgtaaggacctcaaacctaaatggccacagcccagccatttaggcttgaggccacttacactccgatttctaaacgctcctgctcacgctcttatgaaaaagcacgttcaatgacgaaggaggcagctcgtgaaaaaattgagtacaaagcgtgaattgatcggcctgatcgttgttttggttttggcagcggcaggctttgcattcttcgcgtggtatacgatgcggccggatgatgtcattggtaccattgcaacgattagtttcggcattgttttggctgccttgattggtattgcgttatttttggatgcggcggcgacaactcggtggcgccgattctgggtagatcttttgtttgcggcgctgatgttggcgctcatcgactacttcttcctcgatacgacaacgccgtggcagatgctgatcgccggtgccggattggcattagcactggttgcactgctggccattagaaaattagatgaataaacgggctttgtcccggctgatcaatgataaaaacgcctcggaaaattttccgaagcgttttttaagtgccaaccatgttgaggctgtgactagttcatccgctgcacagtaaccgggactgttttaggaagtacttttgtcaattcagtcatcaggttctgaagacttgcctgaaacgttagccggaccatgcggcgcttactaagggcgaaaaccgcaacgacccattcctggccattaggcagactgacaggtgtcaacgtgatactggacatgttggtgtagggaataacccgggccagcaacccatttgcaatgagtcgcgttggggccaaaccacctgtgcccgccataatggacaacaccaggaagattgaaataaacacaatatacggcatgttgttgacgcgggttgtcatgaaccaaaagccaagcaacaccgcccaaacgagttgcgaaaccgcataacgtgaagcaaaattgattttatgttgccaatacagataataaccggcgagtgcaatcaagacgacatcaaggccgattagtaaaacatcaaaactattcatgagggactcctttttgatcgacatcatcagtgggactgtcagtttcgtacaaaccggaaacctgctggtaccaactgaagaatcgggtcacgacaattttcaaaacggcaaaacctggtatgccaaggatgacaccgactaaaccgaagagattgccggccgtgagcaagaccaccacgatggtaatgggatgcagctcgagcttgctgcccattaccagtggcgaaataagttgcgtttcaattagccattcaatgaagaaaacgacaatgaccgcgagaatcatttttggcgacgtcaacgcgcccatgataagtggcgggatcattgccagtgccgaaccaaagtaaggaattaggttcaatgggcacgccagcaagccgaaaatcaagccataacgcaggccaatcaccgaataaccgatcatgaacataatggccacgcacagcgcaaccgtgatttggccctgaacatatgaaccgactttttcgttcatctcgtgcagcatttgtttgacggacccacgtaacttggtggggataatgtgcagcaccatcggcgtgaacttgtcgccgtctttaagcatgaagaagaggatgatcggggctgtcgaaatcgtgataacaacattgccgacaatgccaatcagattttgcagctgcgaaatggtaccggtgacgaaagcgccttgcttgccggtgaagaatgtttggacttcgctggcaatgttgttcaggtcatgttgcgataaaacattttgcttatcattcaagtcatccagccatttaccgatttccgtaaaaatttgcggtgccgaatcgacaatgctggtaatctggttacttaccgccggaatgaagcgcaatagcccccagacgagaagaccgatcaaaacgacgaatagtaacgcgatcgcccagccgcgatgcagcccggctttttcaaggcgattaatgatcggtaccgtcaaatagaagagaataccggcaaaaataaacggcggtgcgatgataccgagaaaatcaaccacaggctggaatacccaagcaattttggtgaaaacaaaaataaccagtagggccaaaagcaggtcaattaagaagaccatgaacttgttgttgatgaagcggcggtagaaccatgagtcggtacgtttcacaggcgatcctcctctaaggacgttaaaggttatgactcgatttaatcagcgatgtcattggtaacctttacaaaagacgacaagtcgagcacgagatctgtggtgaaccaagaaaaacttcgacgtacagttgtcgttttttacaagtcagctgagtgcacgtgagtcattttttcgaagtttctacccgccagacgtcggatgcttctgtataacaatgatactagactagccatgatttttcgaggctcgggttaactaaaatggtcagaagaaggtatcgacgccgttacaataaatttacaaaaacaccgatttgccgttacaaatattaaaaatgcctaaataagggcatcaaatgtaaattttacatatacaaaagctttacaaatcaaaaaaatcaggtatgataaagtcacaaccaaaacggtgagtcaatgtcggttttaccgatacggagaggagtgaccccatatgaatttacttcgcggggctaaatggacattaataactctgaccctggtcgcaacattgctgttatttagcaactatgcgacggccggcatcttgttgatggctctggatattttcctaagcttcttctatgcagtcatcaagagcagatgtgatcggcgtcagatgcataagatgccattattgcataactaatttgatgaaatgatccgcagccgtgatgactgcggattttttcgtgtaacgacggcgaaaatgattgcaaacgttcgttcggtttggtatgctgagtgtaacaaatgagaacggagcggtgagcggatgccaacacaagcgagtcaaaaacgttggaaacagattttacaaaccatctatgacgcgatcgaggatcatgggtatccacccacagttcgcgagatcggcaagtcagttggccttagttcgtccagcactgttgcagcatacttagagaagttgctagccgctggattgattgcaaaagacccatccaaaccgcgcacgattgaagtgactgcagcaggacgtgattatatcggcgttcaggcagagggcattccgattgtcgggactgttgcggccggggtgccgattactgctatcgagaatatcgatgactatttcccggtgccggatgacctaccatactcggccgatgagctgtttatgcttcgggttcaaggcagttccatgatcaagatcgggattcttgatggcgatcagattattgtcaagaagcaaaacgacgccgaaaatgggcagattgtcgtggcaatgactgaagaagacgaagccaccgtcaagcgcttttacaaagaaaagaacggtattcgccttcatccggaaaatgatgatatggaagacatgttttttccggatgtgacgattctcggcattgttgtgagtttgtatcgtcctgcgcttgtataagtgctactaataaagccagctaaaaaagcatttgccgcacacattcaattgagtgtgcgtggcaaatgcttttttgttgaggtgacagtttctaccatcaaggacggttaagctgatcaagatcgtcttttggtacctttttgtaaaatgggccatccggaagctgtttcagtaatccctttttagtaagttggaattgaaccgtgttgctggcggcctgtggttgggctttgccggtgaaggtgaagattcgcccttttaaagtcagttgggccgcaaaaataccctgatccgtactttcaaaatcgccgtcttggttcgacagcgtttcgaggtaatagccactggttgacgacaacacgcgaatcgctttcttttgatcatcctgttggacaaatgcgtgaccgaccaaggtggacaaggttgctttaggcacggccttttttgcctttttccgggattttaccggctttgatgcctgttcactggtggctgatcgagttgatgatgatttggcagtcggcgtgccttgagaacaaccactgaggataagtaataacatgagccaaactaattttttcaatggcggtctcctagtgaatgaattgaatgcaggtcatgacgatggggatgacgatcatggagagaagtgtggtttccgtgaccatgatcgcagcatagtcagcgtcggcgtcataaagtttggcaaccaccggcgcattggtcatgaccggcatgcaggattgcagaatgaagatttgtttcattagcgtcggaaccggggcaaaggcgaccagtgctgtcatcaacagtggggcgaaaagaaagcggccgctgaagataccgagtgcttccttgctgaggcgcagttggctccacccggcttcgtgtaaggcaatgccgataaagaacatggagcccggaaccgtcaaatcgccgatataagtcagatcggacatcaaaaaagtcggcaacttgatattcagtaaaaccaacacaattcccaacatgaaccccagtaaaggcggggagaaaaccttccccaaagcctttttaagattaaagcgggctggtttggggccgtcgccttgaataaggtagactccgatggtccaaaaaattgtcgtgttggccatgtaatagaccaagacataaggcaaactgcgaggaccgaataaggccaggttaaccggcaggccgataaagaccgtgttggagttgaaaaacatggacttaaatgtgccttttcgcgactttggaacttttaacaggtaacacaccaaaaaggacaacgcgaaaagcatcatcatggacaagaccggaaacaacaagtttgggagtaaccgcagcagcatgccggccgtgaacttcgatgcgatggtcacgatcatataagcaggcaaggcaacttgggtgacaactttggcaatgactttactcgaatggttattaaaccagccgcgagcggtcagaaaatagccgagaatgatcaaaatgagaatttccaaaaccccaaagacgcttgagataaatgcggtcaaatatcaacacttccttataaattattttggccgccgtaacgtaaaagtttgaccaagttcggcataagtaggaccggcgaggcgagctaccggtgctaaagcggcaggattaatgtgtaagcttggcaaatcgagcaccgtatcggcaaagtggaactgccgaacttccagaataaagagatcggtgatgatcaccccggcacgatcacgaatcggtacatattggtaaagttgcgtttcaaagcgaatacgcgcggattgcagcccgggtacctgaatctcggtactggccactaacggcagatcaattaagttcaattcactttgatcaggggttaatcgggcagcggtttgattcatcgctttggtgagatcaacgctgaccatgtggacgaccgcttcatggcgagccaaaagattcaccgccgtgtcttttcgttgcccgccatcacgcaaaatggacacggataacaatggtaactgattggagatgccggttgtaaatgaaaatggcgccaggttgatgatgccggccgtgctctgcgtcgtgatccacgcgatggggcggggaatgatgctgccagacagcagtttgtattgctcgcgaggtgatagcttattggcagataagttgatcataatagcctccggtggctgttgaataagaatcatgaaaatgctgggggacctaaaagacacgccatgactgcaagtttagcgcaggcgcggggtggcgtcaaaaggggtgtgccttgcctcgttaaatgaccatgagttgttgacgaaaaaaagcagtgctagagatgatggtgatctcaaacactgcttaaattgatcgtctgaaacaaattgtaattctgttagtgattgctattggcggaaggagtgctagacggtggcgtagaagaaggcgtttggctgttgtctggcacattgttctgggttgactggccattaccaccaccgttgttggttgatgtaccagtgcttccgttcgaatgattgcctgcagtaccaccagcttgtccggtattattgctttggctgtgttcactttccacacttggcgcagcagaaggcgttggcgccaccgaaacctgcgaagaagtaggctcgctgctatattgcgattcttcactatatgaatagttactcgtcgctgagcttgactcagaacttgaagcggtctgtttcgtcttgaaatcatcaaggctgagaagctttttctttgagcgttgcaacggcaggctggttgttaggtaacgataattgtgcggtgttttgccctttaaagtaatcgtgttattgagttctttctttaaggccgtggtgtaatcatgaacagtgccagttgccccttctgaggcatattcaaccgttgttgtcggctgattgtgcttgtaagttttcgcgctggcatacgtataaacattggcgtgctccgagctgagcgttaacttgccttttttctgtttgacatcgccagtatcgttaataatttgcggttggcttcccgcgtcaagaatgattaagcgcgtataggttttggatgacgttaacttcacataaaccgtcagatcgtggtggtcgccgttggtgtcggtgacgtccccggaagcggtgtaagtgccgcttttaaatgaactggtgaccgttgatgaaatggaaatgctggtggcggaagacgaagctgttggtccttgtaccttggcgccgcgcaacaccagccaaacgaaaacgccaatgaaaataacgaccgcaccaatgccggttaatgtgaggtaaagcctccttcgattctttcgaatacgttcacgtcgcatgattgcctcctgaaatatggtgaaagcttttccccaatattagggtaagcgggtttgaaacacaagcataaccaaaaaggctgccggcaaacacttgcctgacgccattttggttgtttgaaacgagactgctagttactcggcatcacgcgccacttagacaatcccttagtatcattgttacctaacgatatccccgttggccagtattaaggtttcaatcgggacatcaaacggttcgattggccaatcaggttggggaaaagccatgactggcggaaccagtgtcaaagtgtggccggaatattcggctaaaaagcgatcatagtagccgccgccaaaaccgatacgatatctgtctgccaatgagaatccgattccgggcacaattaaaagatccggcgccggttcaaccaagtcggcttggtaagcaggctcaggaataccaaaggcactggttacgagttgttcacgaccgggatcaggtaaaaagaccatttggcgtttaggcatcacccgcggcaaaaaaacggctttatcagcagcatgtgccgcagcaataatcggcgctgtggcgacttcaaaagggccactgactgtgatgccgatgcttttggcttgttgccaaacggttgtcttgattaaagtcgccattagtgtttcgctagctgcctgagtttcatcggcagcttcctgaaggcgtttaagctggcgggtgcggaattcggcttttgtggccatgggaacctcacttatctttaagaaattcgcttaaaacaacggcttggttatgggtctcgtctttggcaccatataacatgataatcggatccttttcgtgtgctttcaatgtcttgatgaaatccggcaaatcaggattagcagcgagttccgctaagtaacgctttttgaattcagggtatttttccggatcgtggccaaaccactttcgcagttctgctgtcggtgcaatggttttggcccacaaatctaaggcagcattgactttactgatgccccgcggccaaactcgatcaacgaggacgcggaagccacttgcttgcggtttttgatagatgcgttcgagtgttactttcaaaatcatcacctcatgattatcataccagttttgacaagtcgtgaatgttcaaatagcgatacggtatactagtcaaaagaggtgtcaacatgattacgtgctatcaaattcaaaaacagcgcaatgtgcaggtggcgacggatgatcaggctaattggattcgggtccagtcgccattgccacaggagttgcagacgctggccaccaagtatggcctgcccaaaacatacgtggatgcggcacttgacaaacatgaaaatgcccgggttgaagggctggatcccgctgatgatgttcccgggttaatcgtgctgcgctacccgattgagatgactaacgagatggggtttcgtcaatttaatacggtgccgctgaccatgattttgttagcggatcgggttattaccgtcatggatcatcccttgcaggcgttcgatgacttggcggagcagaagctttcacctaagccggaagaatttgcgctagaagtgctgtggcgggttttacaccaatttgtcctcgacatggacaagttgaatgacgaaacgaaacagattgaaggcagtttaggcaaggccgccaaaaatacgcagctgtatcagctcatggcgatgcagaaaagtctggtgttctttgatgcggcacttgatcattccgggaacttgttgaaaaccttacgggcaggcgaacgctttttcaataccaatggctatcttcgtcggctgcatgatgtcgaagtcgaggtcgttgaggcgcaaacgatggtccggattaccaataagttgttggatcagtattccaccacagttagtgccatcgtttctaataatttaaacctgatcatgaaggtgctgaccagtctgaccattattttaacgattcccacaattgttggcggcatttacggcatgaatgttcggctgccatttgccaatgcctactgggcgttctggtggttgatcggcggtacagcggtcttgtgcggaatcgctgcttggtggttgtggcggaaggattacttttaattgagcgaagacttttcggtaagcaaaaacggtcgaaggaaggcaactttcttttcggccgtttttgcttggctgatgactaaaccacttttggtgcgctcaaaatctgagcaaagcgattcatggtgggcgtcaagacgcgatcttggcgatagacaaacgagatggtgaaggccggttgtttggggtcgtcgattttgagcgatgcgagatgatcgtcagcctgaatggcgactttggttaaaaagccgatgcctacgttctgggtgactaagcgttttagcagcagaacgtcaccggtgcgataaaccactttcggcgtgaaggtttgttgctgttgaaaccaggaaaatgcccgggtatgaacgaacccttcactcaaggtgatgaactggcgatcagcaagtgttgcgaaggagacatgcgattgttgcgccaacggatcattttcggcggtaatgatgacaaacggcgccgtatcgatttggatgacgcgcaactctggatcgactaacggaccgctagcacccagtaaggcaaagtcgagattgccgtccttgatttgatcaagaagtgcggccgatcccgcttcaaatgtttccagttgcggcatcagcccggcagcaatcaagtcgaccgcaatttttggaaacagataactgccaataatcggtggcagaccaaagcgaatcttactcttctgatcccaagcaatgtcctgcttggccaaatccaactgatgcagaataatcgcggcgtgactggcaagctgctcaccagccggcgtcacactgatttcatgatgccggcgatcgcgaataatcagctgtgcctgaaaatgatcctccagccgcttgattgccgcagtaatagtcggttgactaaccgcaaatttctcggcggtttgcgaaaaattccgggtatcggtaagttcgagaaaatattcaaagtctctggtgttcacatgtaaacctcctgtgagcgtgagccggcgcgattagaagccggagtgtaagtggcctcggccgtgatggctcgggcctggccattgcggccgaggtccttacacataggcttctgcgccggcgaacgcgttaatgtgagcgtgagcctacgcgcgttaacgtaaagaaaataataatcatgaaagcatataaaaagattttatcactcctgccaagtttgactataagattggacgcggcgtaatgtctggacttgtatttaaaagttgtgtttgcttcacggcatattagcgcgcgccgaccaaaaagagttggcccatgtttaacacaaaagaggagtgtggcattttgaaatatacaccagaacaaattttaaataatccctttttaaataaagggacagcctttacccaagaagagcgggatcaatacgggttaaacggcttgttaccaccagctgtccagacattggatcaacaagtcaagcaggcgtatgctcaattgcagacaaagccgaccgatttagccaagcggcagtttttgatgacgttgttcaatgaaaatcatgtgctgttctataagcttttttcggaacacattaacgaattcatgccgatcgtgtatgatccgacgattgctgatacgattgaaaattacagtgcgctgtttgtgaatccccaaaacgccacttatctttcgatcgatgatccggatcacatcgaaagtgcgttgaagcacagtgctgatggccgcgatattcgcctgttggtggtgagtgatgctgaaggtattctcggcattggtgactggggtacccaaggtgttgacatttctgtgggtaagctgatggtttataccgctgcagccggcatcgatccgagtcaggtcctgcccgttgtcttggacgtgggtaccaataatgaagcgctactgaatgacgagctttatctgggtaatcgtcataagcgcgtttatggccagaaatatcatcagtttgtggataagtttgtagcaactgccgagaagttattcccgaatttgtatctgcacttcgaagacttcggtcgcagcaatgccgctgatattttgaatcaatataaagataaaatcacgaccttcaatgacgatattcagggcacgggcatcattgtgttagccggacttttgggtgccatgaatatttccaagcaaaaattaaccgatcaaatttatttaagctttggggccggaacagcaggcgctggcattacggcacgcgtgtatgaagcgtttattgaagaaggattgagtcctgaagaggctaagaagcatttttacctggtcgacaagcagggtttattgtttgacgacatgaccgatttaacgccggaacaaaagccgtttgcccgctcgcgcagtgaatttgccaatgcggatgagctcacgacgcttgaggcagttgtcaaagccgtgcatccaacagtgatggtcggcacttcgacggttcccggtaccttcaccgaaagtattgtgaaggaaatggctgcgcacaccgagcgaccgattattttcccattatcaaacccaaccaagctggctgaagccaaggcggaagatttgattaagtggaccgatggacggggcttgattgccactggcgttccagctgccaatgtttcgtataagggtgttagctatgcgatcggccaagctaataacgcgttggtttatccgggattaggcttaggtacgattgcgtccacggccaagctgctcaccgattcaatgatttctgctgcagcgcacagcttaggcggcattgtggatcctgatcagccaggcgcagcggttttgccgccggtgtcgaaactggatcaatttagtcagacggtcgcgattgcggttgcggaagacgccattaaaaatggactgaatcaagaaccgatcagcgatgccaaacaggccgttgctgacatgacttggaaaccggaatatcggccactgccgaattcactcgaactagacttggaggaataaaactgtgactgcattaagtacatcgattcaaagtgtgctgaccattgttttactgattgccgtgggttatgttttacggcggcaaggtcggtttgatgatcagtttgggaaaactatttctgatttgttgatgaaaattgccctgccggcgtcaatctttatctctgtcttgcaacgattgaccctcgataaactggtaagcctgtcatcagggttggtttacggctttggcgctgtcattctaggctatctgatcgcctttttactggtctggttgcttaaagttcgcccggggcgtcgtggaacgttcatcaacatgtttgtgaatgccaataccattttcatcgggttaccgctgaaccttgccttgttcggtgataaagcggtaccgtacttcctgatgtattacgtggtgaacacggtctcaacctggacagtcggcgcctttatcatggcatgggatgacccgacgcaggagaaagcagaaaaaagcggtgcaggctttaactggaagaaattgttgccagcgccactggttggtttcttggtagccttggtctttcttttgctgaaaattccgttcattcacgttgggtggctaggatttgcggttaacacattaaattacgttggtagtctggtgacaccgctatcgctgatttatatcgggattattttggctgatgccggcttgaaagcgattcggtttgaccgcgataccatcgtggctttgattggccggttcgtcatcgccccggcattgatcaccgggttgattctgttgggcatgaaggcaggcttcaatgtgccaagtctcgaagcacaaaccctgatcattcaggcggccgcacctggtcttgccgtactgccgattttggcaacggaagcccatgccgacgtgaagtacgccaccaacgttgtgacgacttcgacagtcctgtttgtgattgtcgtgccgattttgatgatgctggttcaaggattggcataatattttttgagcgtgagccggtttttgcgccgacgaacgtgttgtggcagcaagaaaaaaagagcccgaaacggctctttttttttgcccaaaattaagcttgatgcgcttctaaataagctaaggcgctggtgtaatcaggctcgtgtgtttgttccgtgatgagttcccgatatttaaccgttccggtaccgtcaacgatccaaacactgcgggcatcggtgtggttgtcggcaacgaatagccccatcgccttgccaaaattagcattctggtcggaaagcagctgcattttcgtcacattttccgccgcgcaccaggattgttgttcttgcggggtgttggttgaaatcgtataaaaatcaacatcgtcaaattcatccatatcctggttaaaatgtttggttgagatgctgcagacccgtgtgttgatgtcgggaacaacactgattaatgtcaggcggtgactgagatcattagtcttaaccggctgtcccttggcatcggttaccgtaaatgccggtagtttttcgcctagtgctgttggattgccattggtcgtgatgactgtgccatgtcgggttatttccataaaaaaacactcctttacctgtatacgcgaaacaggtgagatttaagacaacacagtcagtgtatcatgcttaagggataagtgacatggacacaacttaattggcaaaaatttatcagcatatacattgacgctaatataaatatttatgtaagcttaaattaacggagatatttcaaccgtaataatgcatattaacgttcacgcgttcaaggagggttgccagatgcagcaaacattagtcgtttacacatccgaaaccggttttacccagcggtttgcgttgagtattgcgcaaaccttacactgcgaagtgattgatgttcagtttttgacagcctcggacttaaaaaaccgcaccttgattatttacggcggtcaccttgtgggaaataaggtgctcggcttgaaatcctttttccgtcaattcaaggatatgctgcctgatatggtcattgtgtttggcagcggcgtggttcggcgtgacaatgtgaattgccagcaaattaagcaatatcagtttatgcatgattgtcccgtaaccagtttttattatgtgcaaggctatcccaagctcagccaaatgaattttctccggcggctgcgagcgatccgagcgttaaagcactggggaagcgagtcatatcctgccgttcaagaggcgattcagccactagttgccgatgtgaccagcttactgaacggtccgtttacgcatggtgtcgtccaaatttgattggcaaagtgcgcgaagaccaataagtgcgttaaaaaaccgcatctccgaaaaaagatgcggtttttgcataaatctatgattaatcctgaccaatttccttactcaaagccacgacttcatccaccgtatcacctaagaaactgatagcgtgtttcagggcagcatccgtggtgacatcgacgccggcaacacgagctgcggcagctggatcgagtgaatcacccagactcagatatcggagccagcggtcaacagcaggctgaccttgctgctcaatagcttgaaaagcctgagtggccacggtcaaaccggcagagtaggaatatgagtacagccccatgtagtagtggctttgccgcatccaagttagctcggcaccttcttcaagctcgacagccgggccccagaagtcggtcaacactttacgtttgatcgcatcaaggcgcgccgcatcaaagctttcaccattgtcgatcagcgtataaacctcacgctgaaaagctgcttcaagcaagtgggtgacaaagttgtggaaataggtgtcattcaacaagcgtgacaaagcaaaccgcttcatccgcgggtctttggcagtttcttccagataatgggtcaataataattcattaaaagtcgaaggactctcaactaggtaatcattgaagtccgcatcaagaacattgtgcgcttgctgcgagcggaccatctgcgctgtgtgccccagctcgtgaatcagcgtgtacaccgcgggcagtgtgttgctccaagtcatttcgacatacggatggacaccataaggcccggccgtgtaagcgcctgagtctttaccctgattagcgggaaaatcgatccagtgatccgaaaatgcctgcatcatctgatcctgataatctttgcccatcaacgccgtcgcgtttttgatcatttcctgcgcctgcgccaaagtgatggtcggtgcatagctcgggtcaatgtcgatttgtaagtcggtataaccgatgtgatccagtccccaaagcgttttgacgtgggtcacatatttgcgcatgacaggtgctaggtcgtgcataatcacatcgatttggcggttaaacatttcccgattgatttcctggtcagcgagcaggtaatcgatgacggaatcgtaaccgcgcatggttgccgtaattttttcgcgggtgacttgtgctaagtagccggcagccatggtgttttcatagcggcgcaacgtcttgttgaactgagcataggcggcgcggcggatttcggtgtcgggatgcttttggtaattctcttcgtacatcacgaatgaaagcgggtaggttttaccgtgagccgtaaacgtgccgaagtccatgtcgccgaagatcgtttggtcgcgaatgttgctgggtgcctgaaagaccggggacaattccgctaacaccttttcggcagcaggtggcaaggcgcctttcttggctactttgatttggcgaatgaagccggcgtagtcaggcgccttgtcgaccacggcatcaagcacggtttcggacaactgggtgagttcggcttggaagaaactcaattgaccgccgatttcgccgcccagtgcggtgacctgtgcctggcgttcccgcaatttagggtcggtggtatcggttgaatacggcataaatccccagtgggcaattttgctatcaagggctacaatcgtgccgtagtcggccaacgcatcgacaatcacggccggttccgtcaattttccctgatacatgcggacaaaatccttggttaaggcgcggacctgtttgaccgcttcaccgtaagcaaagtcgtcatgaaaaatcggggttagatcccaagtcagcttcggatcaaccgcctggcgtttaggtaactcagtttcgctcatataaaaagcctccttcacatggtggctaaagtatagcattgatcgcgcttaaggtgcgtgtcggcctcctgttgaaccgattatttctttcggctaactgctcatggtagaattatataaaaaggatgtgttatgaatgggtatcgacaacaatcagctagtggcgcgctactttgatcgaaaagccgaccatgcggattttttcaaagctttagagacctatcttgacgataaactgggacaattatacgcgactttggaaacgacctttgccgacacagtggtattgtccgttgacgacgctattgcccaagcgcatcaggccggggcaacgattgatgatcctgctgctgaagaaattgctgccgcgaattacttgtttaaggaattggcttcgcgcggcctgtggatccagtcaccggatcagacggagccgaatacgattattgccaagctgaattttggtaatcggcgtacgtattattaaatttgcttgccgctaacgtgttggcataaaaaagccgcggtgcgatcgttacaaagatcataccgcggttttttccgattattagttatgtacccgcccggtgattatgatttaggcgcgtattgcttatctgcaaaccaaatcgggatttctcgccgtgcgctttcttcactatcggaactgtgaatcacgttgcggatggtttggtcggcccattcccgcccaaaatcgccgcgaatggtgcctggtgcagcgtctcccggattagttgcgcccgtcatttttcgaacggcctcaatgacattaaagccactgacaaccatggccacaagcgggccgctggtcataaaccgttcaacttttgggaaaaaaggtttgtcgacaagtgcggcgtaatgctggtgcagttgagcagttgttgcctgagtgacttttaaggcttcaatggtgaagccacgccgctcaatacgggtaatgacctcaccaatgtgcccgttcgcgacgccatcgggtttgaccaaaactaaagtttgttcctctgccatgcgtgtgcctcgattcctaaatattttcagaaaattcatccaaattcagtatacacgagtcaaaccaaatggcggatggaatttttgtctaccgccaattgattttcgatagcacccgccgaccaaggaattcttggatgagcagataaaacggtacagtcgagaccatgaggggtacataaatcaatgcgagttgccactgccacaggctggcgagcgaaaagacgtggttgaaaataaagaataccaggaacaacgctgcgcttagaccagccagcaagccgaccttgagccgattgaagggacgggcaacgaccagtaacacattaagggaaattgtgccgatcaacatcgcgaccattgttgaggtggtgtcgaagctgaggttcaggaacgactccatccaagttagcaataaggtgtagacgaccacgctgatagcggctggcgcggcaacggtcatgactttttgcatgaattgcccagtgacgcgttcaaagttaggctctagcgtcaggaagaaggaaggaatggcaacaccgatggccgaaaccggtgtgaggttaatcggcacgatcgggtagtcgagtggcaaaaagacgaaaatggtggccaaaatgacggagtacatggttttgacaagatacatcgatgccacgcgttcgatgttgttgatgacacggcggccttcgttgagcacaccagtcatggcatcgaagttcgaatccagtaaaacgaaatccgcaatcgagctggcggcgtcggcgccggaagccatggcaatgctacagtcactttggcgcaaagccaggacgtcattgacaccatcaccggtcatcgcaacggtatggcctaatgcctggtaagccatgatgagctgcttcttttgatctggggtgacgcggccaaaaacgttgtactgcttgaccaaagcctgaaagtcggcttcagtggcatccgcagcaattgtgctcatgtcgacactgcgatcggcgccttcaaggtgtgcctgtttggcaatattggcaactgtgatcgggtcatcaccggagatcacttttaatgccacgccttgactcttgaagaaatcaaaggtgttaatggcagtcgggcgtaattcgtcggtgatcaaaatgagcccgagcaactccgggttcacaagcggctgagcaagcgctttgacggtccccaccgccagcacgcggtaaccgtttgaagcggcctgtttgatttgggtcgcaatgtccgcaggcagctggtcgccaaaagtaaactgcggggcgcccataaataaagcacgtccgtcaaccacggcacctgaccatttacgcgcagatgaaaacggcatggtttgcgtgacctgctggttggcgtcagcgtcgattgcggctttgatggctaaggcggtttcgttatcatcattgagggcatacacgatggctgccgcagcactagtgacatcttcggcgttgtggccagttgccggcaatgtgttggcaactttaagttttccgctggtaatggtgccggttttatccaggcaaatcgtatcgacacgcgccaaggcttcgatggcaggcaaggctcgaaccaacacgcgtttgacggccaggttgcgggcagaaacagctaacgccacattggtcagcaacaccaaaccttccggaatcatcccgatcatggccgcactggtggttaaaatagcccgattataattgccgcgacgaatcatggaaacggaaaaaagaatgataccgatcggaatgagcacataggttaaaacccgaatgatgcggttaatcgttgccagcaattgactttgactggctttttcggctttggcttccaaggaaagtttagcggcaaaggtatctttgccgacagcggtcacttgcatggtagcttggccggaaaccacaaaagcgccggaaagcaacggatcgcccacttttttagtgattggccgcgattcaccggttaacggactttcatcgctttcaagcccgttggtggcaacaacggtaccgtcaaccggaatctgatcgccgcgtttgagaagcaccatatcatccatgaccagctgctcgagatcgattttttgttgctggccgtcacgaatgacggtggcatgagcagcggcgaggatggacattttatcgatttgccgcttagcctgaatttcctgaatggtaccaatggcagtgttgatgatggccacaccaaggaacaacaggtttttgtaactgccggtggtgatgataagtgcaccaaggacaacattgaccaaattaaataaagtaaacgtgttgacttggataatctggctaatggaacgggtcaaaggcttgagcggaaggttgtgttgaccgctctcaaaccgctgctgaacctgttgtgccgataaaccctgatcaggtgaaatgttttgcgctgccatcgcatgccctccagttctttttatttattttaccaatctatgcaacgagatgccgaatatcaaacttgtttttacgaatctttgaagttataccggttgccggctattgtctggtgccatggcaaccgtcataataaaggctaaatgacaggaaagaagcgattgcatggtaaaactaaatccgaacggaacccgttttgtaacgttgccaaacggttatcatctatggacccagacgcaaggccaaggccagattcgcctgatgactttgcatggtggacccggcggcaccaacgaagtgtttgaaaactttgcccaagaactcgcgccttatggtgtccgcgtcacccgttacgatcaattgggttcattcttttccgatcaacccgactttgccgatccggccaatcaaaagcgtttcctcaacatcgattattacgtcgatgaggtggaaaatgtccggcagcagctggggattgatcacttttacctgcttggacagtcttggggcggcgtgctggcgatcgagtatgcgcttaaatatggcgaacaccttaagggactggtcctaagctcgatgattgataatctggatgaatacctagtcaacatcaacaagattcgcgaaaagatgttttcgcctgaagacgttgcgtatatgcagcaaatcgaggcgcgccatgcgtttgacgatgccaaataccaggcgttggtgagcgaactaggtgagcattatctgcaccacgcagccgatccccagccccggcacttaatctcaacactggcaacgccggtctatcactattttcaaggtgacaatgaatttgtgatggtcggcgcgcttaaaaattgggatcgccgggcagatattcaccgaatcacggtgccgacgtatttgacatttggcggccatgagaccatgccattgaccgcggcggaacggatggcccaaacgatcccacatgccacgttgcatgttaccccaaacgcagggcacgggcagatgttggacaatccgaccgattatttcagccatttaggccagtggctcacgcaaaccgacgcaaaagcacctttaagtgacaattaacgttataataaaagtggtaatttaaagttgtttaggtaatggaggtgctttcatggctagcattgatgaattaaaagatgatctatttgaaccggttcatgcgtttgataaggcgattgaggaacaaccggaattaatgatcccgatggccgtcgtgcatttgattccaattgcgttggcacttggcggcggcatcatgatcattcgcggtcaccagaagctgcgcatcgaaaaagagcgaaccaaacagctgagtcttaagttacaaatgcacaaacatcatcacggtcgccacaactggcggttggcgccagaacatcgcggcgcccatgacgtctttgcaccggagtatgaagaggtgcctttgaacaagaagcatcatatgcaccaccggcattaaggttgttaatattaaggctgagatacagtccacggtctaaataaaaggagaacgcatgcctaaaaaatcgggtgcgttcttttttgcatcaagataggtaatttggtagaagcatagggatcttagtgccaaagcggagcaatcgtaggccagatgggctcagtggtgagattgtactagccgggcgatcttcccggcgtagtacaaggccgagcttagagactctgccggttttgcagaggctctaagtcgtgcccaccactctagctttgcggtcgccagccccaatctggccggagattgcagagtttggcacggcgtggaactcattgcctagggtttttctgtattattcagaattcgttaaaccttgaaagtttcacaaaacttttgactcagttactaaacttgagacagggccttaactttcaacgagcagattgaaacttgcggtcagatgcgggaaaatagggcaatacaattattttttggagatgaagctgatgtcaaccattttcatgcgcgcggcgacgaccaacgatattcctgatatgatgcgggtgattgcgtctgctcgcaagtttctaagcgatcagggtatccctcaatggcaaggcacttatccggatcaggcagccattgagcaggacgttgccaccgggatcggtcgggtgcttgaagttgacggaaaagtggccggactggcggcactggttgtggggccggacccgcactatctacggatcgacggggaaggctggctggccgatgtgccatacctggccgtccatcgatttgcgcttgacggcagcattcgcggcaagcaactgagtcgggttttcttcagcaacatcatgagtgaagcctatcgccgcggttttaccgacttacgggtcgatacgcacgcacaaaacgtgattatgcaacatgcgattaccgggatgggcttcgattttcgcgggattgtgtacatggatgagccggtgccggaacggaatgcttacgaggtgcggctgacaacgggttgacgattttcaaaatggaggagaaatatgcaggatattggcaacttagcactcatcttggtaacaacattgatactggcacatatcagtcgcttgctgaaaatgcccgccgtgatcggtgagttgttagcagggattttaattggaccggcattattgggctggctgacccctagccatacggtttcattatttgccgaaattggcgttattattttgatgtttttggctgggctcgaaagtgatttggatttgctgaaaaaatacttcaaacccggcatgctggtagcggtgattggggtgatcgtgcctgtggtcgtcgtgttcggctttgctcacgtctggggattcaatttgaccagcagcctttttctcggcatcacttttgcagcaacatccgtctcgatttccgttgaggttttaaaagaactgcatgcattggatggccgcaacggggcgaccatcttgggtgcggcggtggtcgacgatattctgaccgttttgattttgagtttcacggttgcggtgttaggggaacaaaaaacagccagcgtaccgttctggctgcaaattgtcgaacagttgctgtacttcatcgggatttatctggtggtccgctgggcggcgccgtacttgatggggctggcagaaaagctctttccagcttcggctgtcacgattatgtcgttgctgatttgcttggggatggcctatgtggcagatcttgttggcatgtcagccgttatcggcgccttttttgccggggttgcggttgggcagacccattatcggcaggaagttgacagtaatctgagtgcgattggctatgcggtgttcattccggttttctttgtcagcgtcggcttgaacatgcgctttgatacgtttggccgggatatcgggtttatcgtcattttgaccttgctggctttggtcaccaagtgggtcgggtgcggccttggcgatcgcttggctggggccacttggttgcaaagtaacgtggttggcgccggcatggtgtcccgcggtgagatggccttgatcgtggctcaaatcggttttgaggctaagttgatggatgccgagtattattcggcggtcattgtggtcattgtcctcacaacgctaattgcgcccgtgattctaaaggatgccctccatcgggaacaggaacttgtataatgtaagtggtaagctcaccaagacataagcgattatgacggtttgaggcgcttatgggcggttgaaaataaggaggatttcaatggcaactttattttttgattttgatgggaccgtggcagattcggaagccggcattgtcgcgggattaaaatacatggttcaggatcgcggcttgcggcctttggataattcggcgtatgtgcaatttattggtccggcactggtggatatgttaccgaaagtctggccggaattggatgatgtcgaagttaaacgagcaattgacgctttccatcattactatgaggaagaaggcctgtatcaggcaaagctctatcctaagtttctggataccatgactgaattgaagcaacaaggcgatcagctttatattgcttcggcaaaaccagagaccatgttgcatcgtttggttaagcatttttcactggatcaatattttgccggtgcttacggtgccagcgatgatgagcagacgcgagtgacgaagaccgatgttttggcctatgcgctgaaggcgacccaaacggatccggctgtcagtgtcatgattggtgatcgagcaaacgacatgaccggtggcttggataatcatgttcagctgctgggcgttacctatggctttggttcagccaaggagttgcaagatgccggcgccaaagtcttggccaacaagccggaagcaattccggaaggcttgaaaaaggttgccaaacttagcgccaaatcctgaacgtgtggtacatccgcaggtaacaaaacgacgccagagttcggtgttccgaactttgacgtcgtttttatatccagacggtgcagcctactgctctttttttgcagcttgccggggctggatgacttttgtgccgatttcatttaaaagtttcacaaattgcttggctttgcgtacgcctaaagcgttcacccattcgttgaagcgctcgctggcttctttggtaatcgcggcttctacctgcttaccaagcggtgttagctgcaatgtattacgccgccgatcagcttcgaacttggattgcgtcacgtaattcaaattacgcaacacgcgtatttgccgcgcaacagccggcttggttacgccgcgtttggcaacaatggcagtcaagctgatggtgggatcattggcaatgtcggataaaatccggtattgctcgaaactcaaatggtattgggccatgggttctgagatcagttcgttgatattcttgaatgttgagaaataggcatccacatatgcctctagtaagggtttatcagtcatttttcttcctccagacattatcttaacaaaacacaggctacatgtaacttgaaattctgaaaagttgcggtacactttttagttatgtaaaggacttgaactacttatggaggctacaaaacttgcgaaaacataaaaaggcgtggctgatcgggatactgtcagtcgttgggattattgtggtgggcttaattggtgccagtctttatttttaccaatatgctttcgtgccctcaaagaagtcttttttgagtggcaaagagagtcgcatcattacggacgggaaggcgtggcttaaatccgtacataaagaaacctggacgcaacaggcggtgggcgacaagcttaagttggtggcggattatgttccggcggccaagccaacgaccaaaaccgttgtggtggcgcatggctatatgacgaacaaagaatatatggcgccgcaaatcaagatgttccatgatgccggcttcaatgttctagctcctgatgatcgtggccaaggccaatcggaaggcaattatattggttatgggtggccagatcggctagattacctgaaatggattaatcaaatcatcaaaaaacaaggcaaacagagtcaaattgccttgtatggtgtctcgatgggcggcgcaacggtgatgtatatcagcggcgagaaactgccgtcgcaagtcaagagcattgtcgaagattgcggctacaccagcattattgacgaacttgcttatcaagccaagtcgatgtttaatttgccaaaatggccgttggtgccggcagtggcactgaccgcaacgcttaaagccggttacaacgtttttgatgccagtgcgatcacggctttgcacaagaatacacggccgattctttttatccacggagccaaagacacatttgtcccgactaaaatggtttaccagaattatcgcgcagccaccaaggcgaaaaaagcgctctgggtggttaagggtgctgctcatgcgcggagttttccggatcatccccaggtttacgccaaacgcgtagtcggctggtttaacgccaactggtgagtgtgcgtttaatgctgcgcttcattggcggcaacgcgggtgagaatcgtgtaaatcctttgcgcatcgcttggtgtgccgcgaagttcgtagtcggctaaaaatggggcgtcgaattctttagcgtagcgtttggcagtgaggcagtattgttcattaaaattccgattgcccgaaccgatgatgcctaagcaatactcggcattttcgccttcagcaaggtaatcgcccatcgcattggtcatcagttccttgacaccattgtcgataccgttgccgccgtcaagatacgtgggcaccatgacaaaaaacggcttggtttctccatcgctctgggtggcttcagaaatttctttcaactgaatcggtggattgtcgggattctgctggtgctgggtttcggcatagtcagccaagcgatgagcaaaagcacgcgtgttgccggagattgaaataaataaaacgcgaataggttcagtcatgatgattgcctctttcgtttaaaagtaaaattgctggttaatggccataataatgccggaaaaaggagtcgcggtgtcgtcgaaagcgccgcgactccttttgggtgagcgtgagccggcgcgcttaggagtcggagtataagtggccttgaacgtgatggcccgggcttaggccatcacgtccaaggtccttatacgcagactcttgcgcctgcgaacgcgttatggtgagtgcgttatagcaataaattaaaactcctgataaacagccggatcctgatcccttaagcggccatcaggcttacttaactgatcaatggctgtcatttcttccttcgtcaggctaaaatcaaaaatatcaagattcgtgcgctgccgggaaagatgagccgattttggaattggcaagacacggtgttggagatcccagcgcaggataacctgcccgacatttttaccgtgttccgcagcaatttgcttgatgacaggttcttttaaaacggcaccgcggcctaaaggactccaggcaactgtttgaatgttatgggcgtcatcatactcacgttgggtttgctggttaaagtaaggatgtagctccacttgattaaccgctggcgtgacgccggtttctttaatcagtcgatcaatgtgctccggtaagaagttggaaacaccaattgagcgaattaagccgaaccgttgtgcctgaatcagcgcctgccaagcttcaacgtaaagtccttcttttggattaggccaatggatcaaataaaggtcgtaataatccagaccagcgcggtatagactttcttcgatggtgtcaatggcctcttgataacggtgatgacggccgggtaacttagatgcaacgatcaattggctgcggggaatgccgctttggcgaaccgcttcgcccacagcaccttcgttttcataattaaacgctgcatcgagcaggcgataccctaagttaagggcaccgaccatggctctgacgccgttcgtgccatttaatttatatgtcccaaacccgactgccggcaagacgttgccgtcgtttaacgtatagtgcatgcaaacaacctccttgtgaaatacgaaatcgctggtggtttatcgtgcaataacaggtgatgtcgttgccgcttcatttagtgtagtccaaatgtcaggatgcgtacaagtcacgatggtgcatcgtgtataatgaatgccatataaggaagcaggtggtcaaaacgagaacacaacaatggcgagccatttcccgaagttggtttgcatttttcaccatgattttctgggtgcttctttttgtggaagccttcagcacgggaatgatgctgacggttgggacaccggcacgtactgaacatgtgattgttaaaagtaaagggttggtgcagatgacccaatccctaaataaagaattaatcgacacggcgaacaagaacggcgccactttgaatccgcagtcgacgttggtgaccattgatgacacgcaacgattggcttcaaaaatggtgactgccagtgcggacaatcaaatgcgtgtgtcactggatacgattaaagagagcatagcaagtcgcctgcagaaagccgctgccgatcaagggcaaaattttgatcaaaagaaagtgctgacgagccttacagccttccttgatcgcgaaatcaatcagctcgtgatgtccgaaggctggggacgggcttatccgttactggtgctcatgacccaaaccgcggtcattgtggcggcgatcctgatggtgatcgttttattgattatgctaaaaactgcccactcttggcgccgatttttggcagtcacgggtcgctccacttacatcatgggctatatgggcggctttatggcagttttaacaaccgctagcccgttcttaggtgccattagtgcccgaatgccggtcaatgctgaactggcgcgcgatttgcttcttgcgtattcaccgttgtggcagcgcgtggccggttggaccattgtcattgggttggtgatcgcggcgctgagtcatttcctgccgcggccggccgttgatgaaagtgagtcggtgaatgcggcatgacgggtttattgaatcgcattaacgcgttcgccagcccagaaaccgggctggcgaacgctcactagaaagggaggtttcatgaaacgagataagtggctttggttggcgttattggttgtggtgcttgttgccggtgccgggtggtattggtataacaaccaggccgatacgccgccaactaaagaagaaaccacgattggacgcaccgcgacactttatttgcatggctattctggcggtgccggatcgacgaatacactgattcgccgggccgagggaactggtgcgaccaaagtgctgacggcaacagttgcaaaaaatggcaaagttcactggaccggtgatccgcatcgcgtcagcaagcccattgttcaggtgatctttcaagacaacaagaatcctgacgtcgtgaaactggcagattggttgacaacgattaatcggcagctttaccagcgctatggtgtgcgcaatgttaactttgtggcgcattcaatgggcaacatggcggtgatgttttacgcggttcgcaatcaggatcaagggaagttgccaaaaatgaagcactatgttgccattgccgggcattttgacggcattattggcatgggtgatcaacctcaccagattaagctggcggcaaacggttacccgtcacccatggacgagaactacggcgaattggcacgtttacgggatcattttcctaagggcgttaaggtattgaatatttacggtgatcttcacgatggcagcgattctgatggtcgcgtagccaataactcttcgcgatccttgcgttatcttgtcagcacacgggcagccacttatcaggaaaaggaatactttggccgtgatgcccagcacagtgcattacatgagaatccgcaagtagccaaagccgtcgattcgttcatctggtaaactcgcgactagtcacggtcataaggcgcaatgacgactttaccacccagaaaacttgccatatacacgtcttctggtttatagccttgttcggcaaggcgggctttgagccagtcctcatcgtggtcaatcgcatcgagtgctgccgggtcaatctggccgtctaagatgagtggatacttgatagtctcatcgcctttgaaaatgacattcaactgtccgttctgttcaagataggcttggcgaacatcgcgcagatctttcacaccagcggtacgtaagcgataggcgaggtcgttggctgacaaaccaacctgcgtggcggtttcgacgcgaatgttcccgtgtgagaccactaatagcggctcgccatcgatagcccgtttgagccagcgattatgattcgtcaggtatttcgagctgaagacgatgagcgtccagatcagtaagacgttgacaaattgcaaaatgctgacgtcggtattataaatgacacccccgataatgccgccgaggacatagttttgcatctggtcaacaattgtggccggggctagattgcctttaccggtgagcttaatctggacaacaaacacgataaagcctaagagcagtttcattgcggtcacaaaatataaatcctgaaaaagtgccatgtgtgcctcctacttggtgacaaattgaacttgcgggacaattaaagtcgtcttggtgagttggtaactattgttatcggcgttgatcgtgacggtgtacattcttttcgtggacttgccaatcgttaccagcattcccgtgtgaaccgtgctactgttggcatatagttgattgacgggcacttgcttctgcttggcaacgctgcgcaataaagtcgcgactgcctgtgaatcagcagtggcggtacgacttgcctgaagatcgcgaatctgaatgccgatggtcaacaactcgatgagagccaccaggattagaaggtcacgatatttgttgctgcgcttgtgacggagaaaataaaccaggtaggcaatgatcgccacagctccgatgatgatgatgctgtaacgcaaggtgttttgccaattgtcttgatgagtcagcgctgaatacgcaaaaaaagtcgttcccatgagacgcctccaaaaataataatctggtcaaatcataacagaatgataacctgtttgaagttattcttgacacgaaacatgacggtgttatgataatcgcaactcaaaacagacaacattgctttgcggagaagagtatctgaagcgcggatcccaagcgagcctggacagtggaagcaggcgatcggttaatcggagaagatgagctccaaatagcttttcagtggttcacgccattgaaacgggtgcatccgttaccatgccaggtatcgatttggtactggtgaggtgttggcgctatgccgacacgaataagggtggtaacgcgcgtcaagcgccccttgatctttaaaaagatcaaggggcgctttttttgagcgtgaactggcgcggttagaagtcggagtgtaagtggcctcaggcgtgatggcccgggtttaggtcattgtgcctgaggtccttacactccgacttctgcgccagagaacgcgttatcgcgattgccgcctctttcgttgccgtgtgctcaatgttgcttgagaatcgtcattttcataaaacgggaggaattctcatgacagaagaagttaaaatcaaagcaccatttcgtgctgatttagttggcagtttgttacgtccggaaagattgaaagtggcgcatcagcaactggacatcggcgagattcaacaggatcaggagctggcgattcagcacgaagcgattgatcacattgtcaaaaagcaggttgaattaggcttcaatgcggtcacagatggggaattctcccgccggtactggcatcttgatttcttctggggcttaaatggctatgaaaaagatgactcctggaagtatgagcacgattttaaaggcggcatcaatgcggcggcgaacgttcatttggcggggaaagtcagctttaatccgcaacatccgttctttgcggcatttgagtatcttaaaagtatcgtgccggacggggtactgcctaaacagacgattcccagtccagccttgctgtttcgggatcatcgcagtgacaactggccgaagtactatgacacctttgacgattatttagccgatattgtccaggcttatgtcgatacgatccagcacttttatgatttaggcgatcggtaccttcaaatcgatgacacgaactgggcatatctgattcagaacttgaaggacaccgaaaacgatccgaagaagcatgaacattttgtggcattggctaagttggcacatcgcgtgattaaagcggttttggtgaaattgccggaagatttgacggtcacctcacatatctgtcgcggcaatttccagtcgacgtttttgttctccggcggctatcaatatgtggctgatgatattggggacttgccatacgacgggctgtttcttgaatatgacagtcaacgggccgggtcgtttgaaccgttgccgcaactttggaacggggatcccaacaaacgaattgtattaggtttgatcacctcgaaatttccggaattagaagatgaagaagcggtgatcgagcgcatcaacgccgcaactgcttacgtgccgctagaaaatctggctttgtcgacccaatgcggctttgcgtcgacagaagaaggtaataagctgacagaagacgatcaatgggccaagttggcgttggttcaacgcattgcccatcgtgtttgggccgatgcctaacctgcaagttgttttgatgatgaaagtcgaatcgtgaccgaattttttacgcacctccggctattgtgttatatgatgaatatgtaaacgattgagaaggagatcttttatttatggcaaaagtcgaaagcttcacattggatcacacggcagtcaaggcaccttacgtacgtttgattacgactgaaaaaggtaccaaaggcgatgaaatttcgaattatgatctgcggttggttcaacccaacaccgcagccatcgatacggctggtttgcacacgatcgagcacttgttagcatcgttgttgcgcgatcggatggatggcgtcattgattgttcaccatttggctgccggaccgggttccatctgattacttggggcacgcacagcaccaccgaagtcgccaaggccctgaagtccagcctggaagcaattgccaatgatattacctgggatgatgtaccgggcgttgatatcaagagttgcggcaattacaaagaccacagtctgttttcggcaaaggaatgggcaaagctgattctgagccgtggcatttccgacgacccatatgtgcgtcaggttgtctgagtttgtcaaaatgatcgacgaatgattgcgcgtccgtgtgcgcaaaaaaggcgctgtccaagtttgtgaagcgaacttggcagcgccatttttatgggaactgatttaactgaataagtcgatcaaccagcggccgccatagagaagactcatactgtaggcgaaaatcgtaatgggcttgcctagtacgataatccagaagaatttagtgaaggtcatttttgtgagcccggccagcagacacaaaacatcatcaggtgcgaccggtaacacaattgccagcgtaaataatcggtcgaaacgcgtttgattttttgtatacccaatgtatttgtcgtaagttttttcggaaatcaaataagtcagcagcggtttgccgaaacgttgggccaggaaaaagttgataaaagagccaatcgcaatgccgacgtaattgtaaagaaagccaaaccacgggccaaaaagaatgacgccggcagctgtgctgacacctccgggaatgatcggaatgacgacttgaataatctggatgatcacaaaaaacaaaattccggttaggccgagttgagcaatatagttttgcaagaccttaacatcggaaagaatgccaaggtcgtaccaatagatggtcacggcaattaaagcgatgacaaccatgacagttgccaagttaatcaaatggcgaatatttttgggagtcatatcctaaacctcaaaacgatttatcatcacgaaaacatctatgctacaatgagtcaagcgtaccaaacgtatgtactgaatggagagctatatgtacgaatattttgaaggcacgattcaagcaattaccccggcctacattgtcattgatgtcaatgggatcgggtttcgtctgctggttgccaacccatatgactttgaagccggtaagcagatgcgaatttatgtgcaactgattatccgcgacaatgatcaagccttgtatggtttcgaatctgctgcagataagcgcacgtttaaccagctgttgacggttaccgggattggcccgaagtcggcactggctattttggcgaatgtctccagcggcggcctggcaaccgctatcgctcaggacgacgttaagttcctgaccaagtttccaggtatcggcaagaaaaccgcggcccagatcattctcgatctaaaaggaaaaatttcagcggatgccgagccgtcgccagctgccatcacgccgacagcgagtgacgtggcaccggcgctggccgatgcattggcggctttagttgctttaggatacacccaacgggcagtcgacggtatcacagatgctttgaaggcatttgatgccacaacgactgatgcctatttgcgtgaaggcttgcgattattaagcggacgtgcgtagcattgattatactggagccattctcggccgacaacatgaaggaacttatgaataggttaagaatagggggtgaacctttttggcagacgcaaacaaggatcggctagtttcaggcgacattgatgacctgaacgaagcgcaaattgaaaagagcttacgtccgcggatgctggcgcaatacattggccaggatcgggttaaacatcagctgcaggtctatatcaccgcggccaaacaacgcgaagagtccttggatcacgtgttgctttacgggccgcctggactagggaaaacaacattggcattagtcattgccaatgagctaggcgtcaacattcgcacgacttccgggccggccattgagaagccgggcgacttagtggcgttgttgaatgagctgcgtcccggtgacgtgctgtttgtcgatgaaattcaccgcttacccaaaatcgtagaagaaatgctttattcggcgatggaggacttctatattgatatcgtggtgggtcaagggccgaccgcgcatccggttcattttcccttaccgccgtttacactaatcggtgccacgacgcgtgcgggcatgttatcagcgccattgcgggatcgatttggcatcagcgaacatatggcgtattattcgcctgacgacttaagtgaaatcgttaagcggtcggcaacagtgtttgacatggcgattgatgctgaaggtgctcatgaaattgcgcggcggtcgcggggcacaccacgcgttgccaatcgcctgctgaagcgggtgcgcgattttgcagaagttgccggtaaaagtccggttgatttgcagatggttgatcatgcgctggatcaattacaggttgatgcgcagggacttgatcaaattgatcgaaaactattgatgttcatgatccgcgattaccaaggcggtccggtcggcttatccacgatcgcggcaaacatcggcgaagaaatggccaccattgaagaaatgtacgaaccttatttgctgcagattggctatttaaaacggacaccgcgcggccgcatggtgacgccggccggatttgcgcatatggggatgacggcgccggagcctgataaccgggcgcagtaagtcaaaacgattaaaatgaatggaagcgaacaaggtgcaagacaaaaaacgttatcgtcaagtagaaaataaaaattatcaactttcggatttcgactatgatctgccacatgaattgattgcgcagacaccgctgaaggaacgcgatgccagtcggttattggtactgaatgctgacaccggtgccatgcaggatcggcatttttatgacattttggattatttcaaaccaggggacgcactggtcatgaatgacactcgggtgatgccggcgcggctttatggtgttaagccggaaaccggcgcgcacatggaagtcttgttacttaacaacacgtctggcgatgactgggaaaccttgatgaagccagcgcgtaaggcaccggttggcaccgtgattgactttggtgacggcttgttgaaggcaacggtcaccaaagaactggatcatggtggccgcatgattcattttgattacgatggcattttcatggaaattctggacaagcttggcgaaacaccactcccgccttacatcaaagaaaaacttgacgatccggagatgtaccagacagtttattcaaaagagctaggatccgcagcagcaccgacagccgggttgcactggaccaaagaattgctgaaaaaagtgcaggataaaggcgtcaaattagtttatctgaccctgcatgtcggccttggcacgttccggccagtggttgaagaaaatatcgaagcccacaaaatgcacagcgaattttaccgcttaaccccggaagccgcggcaacgttaaatgaggtccgcgacaacggcggccgcatcattgcaaccgggacaacgtcaattcggactctcgaagccatcggcaccaagttcgacggtgaaatcaaaccggactctggctggaccgacatcttcatcaagccaggctaccagtggaaagtcgtcgacgccttcatcaccaacttccatctaccaaaatcaaccctagtcatgctagtagccgccttcaccggccgcgacaccatcctgaatgcttacaagcatgcgattgaagaaaaatatcggttctttagttttggggatgccatgttcatctattgatgagcgtgagccggcgcgtttagaagccggcgaacgcgttacggaaagcatcagagaacattttttcaacaaacaccacaccacgcaaaaagccggcttgcccaacgcaagccggctttataacggacgggatcacatcaacacacacctacagacatgtctcgatttttcttttaacgcatcgctgcgtggaacaacgtattcatagacgatcacaatggccgggtcaaaacccgggaagtgcgaaaactacggtaacggggatcccgtccttaggtttattttaacaggaatcgcgatccgaaaaaagcaaacgggcctaaatctgccaaactttgagcgcatttcgttttgtgatttaaaacaagtcccttacttttaaatcacaagtaactctgttaaactggcataacgagaaaatggaacagcaatgctgcgagggcactgcgatgaataaggagtttgttcatggaaccagctgttaaatatcgtctcatccatcaagataagcatagcggtgcccgtttaggtgaattaatcacgccacacgggacttttccaacacctatgtttatgccggtagggacgcaggcaagcgttaaaacgatggcgccggaggaactagatacgatgggtgccaccgttattttagccaacacgtaccatctgtggttgcgcccgggaccggaactcattgaagaagccggtgggttgcacaaatttatgaattggcataaaggcattttgactgattctggcggttttcaggtcttttcactcgccgacactcggcacatcacggaagacggcgttacgttcaagaaccatcttaatggggcaaaaatgtttctgtcaccggaaaaagccattgccatcgaaaatgcgctgggtcccgatatcatgatgagtctggatgagtgtccgccattttttgaaagctatgattacgtcaaaaaaagtgtggcacgaaccagtcgttgggcggagcgggggttaaaagcccacaagaatccggattggcaggcgttgtttggcattgtccaaggagctggctttagggatctgcgtgagcaaagtgccaaggacttggtcagcatggacttcccgggctattcgattggcgggttgtcggttggtgaatccaaagatgagatgaatcacgtattggactttacgacgccgctgctgccggagaataaaccacgttacctgatgggtgtgggttcggcggatgcgctcattgatggcgcattgcgcggcattgacatgtttgactgcgttttgccaacacggatcgcccgcaacggcacctgcatgaccagtcgcggtcgccttgttatcaaaaacgcgaagtatgcccatgattttggcccgctcgatcctaattgtgactgttacgcttgtcgcaattacagccgcgcctatattcgtcatctgattcacgttggcgaagcgttcggcattcggttgacgacctaccataacctgtatttcctgttacacctgatgcagcaggttcgcgaagccattgcgaatgatgatcttttggcgttccgtgaagacttttttgaagcttacgggtataacaaggaaaaggcaaagaatttctagattattggagcacaacgcgaaattctggtacactatgcattgacaaactaaaaataagaggtgcctaatttgggaaatggtaatgtttcaatgatcgttctgttagttgctttttttgccttcatgtactttttcatgattcgtccgcaaaaaaaacagcagcagaagcgtcaagaaatgctgaatcagttaaaaaaaggtgatccgattgtgacgattggcggcctgcacggggttatcgactccattgaccagcaagcaggaacggttgtcatcgattctgacgggatttatctgacgttcaacttaaacgcggttcgtggcgtagcttctcgtcccgcaacaccggcgccagcagccaagtcagaagaagctgccaatacggatgaacaacgagcagccaaagcagctgatgacactgcatcagaggctgatagccaagcagctgcctcagacgatacgacttcggaagcagacaacaaacagaattaatcggcaattcattgctgaatcaaacaagagcgggcacttgctggctctttttttgagcaagaacggaagcgcttacatagagttttctgtgactacgagcacgtaatttctgatcaaattgtcgatcactcgtaattcccggcgatcaagttcaaaaaaatacaaagtgaaaagcgcttttaatccttgatactccgctaatagcaatgagcaagcattttttcgtgaaaaagttcaccaaagttgtttacaaattcacatgaatcggttatgatcttcttgtgaaatggttaacaaaaattctgcgaaatgcttggaggtaagctcatgcttaagaataccgcgaaaactgctactgaagttgatgtgaagcaaatgatcgacgaactggttgccaatgcgcactcagctttgaagattatgaaaacctttgatcaagaaaagatcgatcacatcgttcatcggatggcgattgccggcttggatcatcatatggaattggcaaaactcgccgttgatgaaaccggccgtggagtttgggaagataaagccatcaagaatatgtttgccaccgaagaaatctggcattcaattaagaacaataagacggttggtgtgatcaatgaagataagcaacgcggtttggtgtcgattgccgaaccgatcggggtcattgccggggtaactccggtgacgaatccgacttctaccacaatcttcaaatccgaaatttcaatcaaaacccgtaatccgattattttcgccttccacccgggggcccaaaagtcttcagcgcgtgcgctggaagtcatccgtgaagaagctgaaaaagccggattgccaaaaggcgctttacagtatattccggtaccaagcatggaagcgaccaaggctctgatggatcatccaggcattgcgacgatcctggcaacaggtggcccgggcatggttaagtccgcctattcttctggcaagcctgctttaggggttggtgcagggaatgccccggcatacatcgaagccagtgccaacatcaaacaggccgtcaatgacctggtactttccaagagttttgacaatggtatgatctgtgcttccgaacaaggagcgattgttgattccagcatttacgatgctgtgaagaaagaattcaaagcccaaggcgcttattttgtccaacctaaagacatgaagaagtttgaaagcaccgtgatcaatcttgaaaagcaaagtgtcaacccgcgcattgtcggtcaaagtccgaagcagatcgccgagtgggccggtattcaaattccggaaggtaccacgattctgatcgctgaacttaaaggcgtgggcgcgaagtatccactttcccgcgaaaagctgagcccggttttggccatggtcaaagctgacggacatgaagatgccttcaagaaatgcgaaactatgttggacattggcgggttagggcacacagcggttattcatacggcagatgaagacttggctttgaagtatgccgatgccatgcaggcttgccggatcttgatcaacacgccatcttctgtcggcgggattggggacctttataacgaaatgattcctagtctgacgctgggctgcggctcttatggcggcaactcgatttcgcacaatgtggggacagttgacttgctgaatatcaagaccatggcaaaacggcgcaacaatatgcaatggatgaaattgccgccaaagatttattttgaaaaaaactcggttcgctatctggaacacatggaaggcattaagcgggcgttcatcgttgccgaccgcagcatggaaaagctgggtttcgtgaagatcattgaagatgtgctggcacgccgggaaaatccggttcaggtgcagaccttcgttgatgttgaacctgatccatcaaccgacactgtcttcaaaggaaccgatatcatgcgatcatttggtccagacaccgtgattgctatcggcggcggctcggtgatggatgctgccaagggtatgtgcttattcaacgatgcaggagatgccgacttcttcggggctaagcaaaagtttctggatattcgtaagcggacttacaccttcccgaaactgaacaagaccaagctggtttgcatcccgacgacttccggtaccggttctgaagttaccccatttgcggttatcacggattcgaaagccggcatcaagtatcccttagccgattatgcgctgaccccggatatcgcgattgtggacagtcaattcattgaatccgtaccgccagtggttgtcgccgactccggtctcgatgttctctgccatgcaactgaaagctatgtatccactatggcgacccattacaccaagggtttgagcctcgaagcaatcaagttggtatttgaaaacctcgaaaagagttatcacggcgacatcgctgcgaaatccaagatgcatgatgcttcaacgattgccgggatggcctttgccaacgcactgctgggaattaaccacagtattgcccacaagttgggtcaggcgttccatctccctcatggccgttgcattgcgatcaccatgccacacgtgatccgtttcaatgccagtcagccgaagaagcgcgctatctgggctaagtacagttacttccgcgctaacgaagattatgcagaaattgcccgttatcttggcttgccaggtaaaaccaccgatgaactggtagaaagctacgttcaggccttcatcaaactggcacacagcgttggcatcaagttgagtctgaaggatcaaggagttaaaaaagctgatctggacaaacaggttgatcggcttgccgaacttgcttacgaagacaactgcacagtcaccaatccacaagaaccattaatcagtgatttgaagcacatcattctcgatgaatacgaaggcacagaatcgactttctaggcgagcgcatgctaatcatttcacgatgatcggcaatggttcatcagattaaccttttgtgccgatctgccaaaacacgtcatgaaattgacgtgtttttttgcgcaagtcatggcataatgtagtacagtgactgcaaattaaaagtaaggacgtaaaatgacaccgaataaagaagattatcttaagttgatttttgagatcggcggtgacaccgaattggtctctaataagcaaatcgttgcggggatgcatgtttctgctgcctcggtcagtgagatgatcaataaactgggtgaagaaaaactggtcgcgcacacgccttaccagggaatccagttgacatcggcaggccgaaaaaaagcggctattttggtgcgtaatcatcgtctttgggaagtgtttttagttaagtgcctgaagtattcgccggatgctgttcatcaggaggcggagaaactcgagcatgcgctgacaccggagatggccaagcggttgtccgcgatgttggggaatcccgaatactgcccacatggcggcgtcattccggatgctgaaggccactatatccagcagagtcgggtcactttgggtgcaatggaagttggccaacgcggtcatatcgaacggctaatcgatgaagtctcgttaattgattacaccgtcaaaattgatttgcgacttgatgatgcctttacagtgactgcaaaaacgctggatgcggtggtcattaaattggatcggactggaaaagaattggcggtcgatgctgatcgcgctgcgcatatatttgttgaattgtaatcaggttttgagaaagcagggtcgtatacatgccagaagaatcacgcgctgtgatcattatttttggaggatcaggggatctggcttcgcgtaagctatatcccgcattgtttaatctttatcgccgcggcgtgttggctgaacattttgccgtgatcgggactgcccggcgaccatggagcgatgaacattaccatgaggtggttgaaaccgcgattgccgggcttaaccccgagccggcgcaagcacacgcgtttgcccaacatttcttttatcaaagccatgatgtcaccgatgcggatcattacatcacgctaaaaaatctggcggctaagttggatgatcagtttgcgacgggtggcaaccgggtcttttacatggcgatggcaccggacttcttcgaaaccattgccagccatctcaagtccgaacatttgttgacagatgtcgggtttaatcggctcattatcgaaaaaccgtttggccatgactacgccagcgccaaagaactgaacgactcgttaacggcaacgtttgacgatgatcagatcttccggattgatcattacttaggcaaagagatgattcagaatcttttggcgtttcggtttgacaatacgatttttgaaggcatctggaataagaagtatatcgacaacattcaaattacgttggcagaagcggt

SEQ ID NO: 301 - DNA, 546 bp, Lactobacillus casei
tttggcgtttcggtttgacaatacgatttttgaaggcatctggaataagaagtatatcgacaacattcaaattacgttggcagaagcggtcggtgttgaggaacgggccggctattatgaaaaggctggtgcactgcgggacatggtgcaaaaccacgtgatgcaggtgctgtcttatctcaccatggacaagccgaagtcctttaccaccaatgatattttggcggaaaaggataaagtgttcgcggcgttgaagccctatgatctggcaacagcgaaagccaattttgtccgcgcccagtacgtcggcgctgaagtcgatgggaaagccgttcgcggataccgtgaggaagaaggcgtggcggctgattcacaaaccgcgacatttgtggccggaaaaattatgttggatatgccgcagtggcaaggcgttccgatttatattcgcaccggcaagcgtttgacgcgcaaatcgacgcagctgacactgaccttcaagccagtcgctgcgccgttgttcggccaatccgccgacagcaaaccgga

SEQ ID NO: 302 - DNA, 51544 bp, Lactobacillus casei
gcgtttgacgcgcaaatcgacgcagctgacactgaccttcaagccagtcgctgcgccgttgttcggccaatccgccgacagcaaaccggatactttgacgatttatatcgagccaagtgaaggctattcgttacaactaaacggcaaggcgttgggaactggcctcaccattgaaccggatgaattgcgttaccgtcatgatccaaaggcagcggctgcagcaccggaggcttatgaacggttaatcaacaacgtgttggaaggcgatcagaccaactttacccattggtccgaattgtcggcttcgtggcacttcattgatgccattcaggctgcctggtcacaagaaccgaacatgccgacgtatccggccgcaaccatgggaccacaggcagcgtttgatttgttgtcgcgcgacggccgcgaatggttctggcagccgcaccgtgttcaaatggctgattaagactaatttgcagtgagaagggactgtggccggaaaggttatggtctcttttttagtgagcgtgagctggcgcggttagaagccggagtgtaagcggcctcgaaaccaaatggctggtctttggtcatttggtttcgaggtccttacacgcaggcttctgcgccagcgaccgcgttcgcgttatagaaagccagacttattcgcccaacatagaaagcttcccgtccaccatagttaagtaagcacaatcgcttttcaatcaccgtaaggagggacacatggcactattcgaattacctttacaaaatgatacgtcccgaaagattatccatctcgacatggatgctttttacgcctcgattgaaatgcgcgataacccgcaactgcgacgcaaagccttggtgatcgcgcgagatccgcgcacgaccggtgggaaaggcgttgtgacgacggctaattatgtggctcggcgctatggcgtgcactcggctatgcctgctaatgaagccttgcaactggtgccgcgatcggaactggtgtttaaaacaccggactttcctaaatacaaggctgtctcagcacaaattcacgccttttttcatcaggtgacggatttaattgaaccggttgcctttgacgaagcatatctggatgtgacggccaatcacgcttttcccagtaccattgcgcttgccttatggttgcaggatcaaatcagtcaggccacgcaactgaccagctccattggtatttcttacaacaaattcattgccaaacaggcgtctgactataacaaaccgaacggtcggaccgtggtgctaccggaacaggcattactgtttttggatcgcttaccgattaaacagtttcgcggcgttggaaaaaagacgctgccaaaattaacggatctaggcgtgactaatggcaaaacgttacgtgcgttatcacaggatcagctactggggatgtttggcaagatgggctttgtcttgtaccagcatgcccgtggcgtcgataatcgcccagtggcagtgcggaccgccaagtcgattggcaaggaacgaacgtatggcacgccgctgactgattctgcgagtgtccagacccagctgcgtaaactggcggcgatggtggtcacatctttgaatcaaaaaggcatgcatggcaagaccgttgtccttaaagttcgggatgtcgattttatcactcagacaaaacgcttaacccaggatcattattttgaaaatgaacaggatatttttgccgctgcatggcaactttggcagagcgtcaagttaccaaagttagcgattcgcctgctgggcattaccgtgaccggcctcgatcctaaacagtatgaaaatattgatttgccattaggatgaggattggaactgctttcattgtcatgccgcctgtggccgaatggtactgttcccatactgtcatagtacagccaaagctatggtatactaacgatagattgcaatgaggtgatggtatggcaacaaagcatgagcagattctggattatattgcgaatttagccgtcggcaagaaaatctcggttcgatcaattgctaaacatttgaaggtaagtgaaggtactgcctatcgggcgattaaggaagccgagaataccggtttcgtttccacaattgcccgagtcggaacgatccgaatcgaacaaaagccgttaaatccaattgaatccgtcacgtttaagacgttagttgatttgattgatgctaacgtcttaggcggtcatgccggcatggataagaagctcgataagttcgtgattggtgcgatgacgccggccgccatgcggccatatattacgcgtaattcattgctgattgtcggaaatcgtgaagacgttcagcgcctggcacttgaagacggtgctgcggtgttaatcactgggggatttgaaaccagtccggcgattattgctttagcggataatcagcagctgccagtgctgcagaccgcttatgacacgtttaccgtggcgacaatgattaatcgggctttgtccgatcaagcgattaagcaggatattttaacggttgccgcgatttataccccactttctcagatcgaaacgatcggcgttgaagcaaccgtgggcgattacttggccatgacggatccgcattatccgttaccggtcatcacccgcaacggtcgcctagttggattaatgcgtccggcattggcagctggcaaaaaaccaaccgtgccgatcgagcggttaatgcaaaaagatccgcaaaccgtaaaaccgtatttgagtgttaccacagtcgggcacacaatgcaggataacggtatgaatgcgatgccggtggttgatgacagttggaatctactcggaattgtgacgcgcaatgccgtcttttccagtttgaccgggattgcgcatagtcgggaattgtccaataccattgcggatcaagtcagtgcccaattgacggcgattacaccgcaaaagccgtacggtggcgggtttgaactcaaaacggtgccagcgatgaccaatgcgttggggacgatgagttttggggtccttgctgaagccatcaatagctgcaccacaaggtatctccacgctagcgggcggcgaaatgtgttggttgaaggtgtgaatctgaccactttccgccctgtacaactggaaagcattgtgaccgttttgctacgcgtacttgaactgacacgtcatgatgccaccgtcgatgtcgacgtcctcagcgatggggttcaggtggctaaggcggttgtgacctgtcagttactagaaaggaattgatcaaacatgattcaaaccgatattatcaacgccattaaggccaataatcccattattattcaccggcacgtgaacccggatccggatgcattgggatcccaagttggcttggccgaagccattcgcgcgggttttccggacaagcaggtttatcaagtcggcagcgataccgggaatttaagttggttggcgcaggaacaaaccatcagcgatgatgtttataaggacgcactggtgattgtgaccgatacagctgacacaccgcggatttcggatacgcgctttaatcaagggaaaatgctgattaaaatcgaccaccaccctaatgatgatgcttacggcgatcttacctgggtcgataacgatgctagctcggcatccgagctgatttacgatcttatcgctgccagcgacggcacgttaaaattatcggatcaagcggcacgaatgctttatgccggcattgtcggtgataccggccgattcctttttaataacacgacgccgcatacgctgcaggtagccgccgagctcattaaaaaagattttgatccgactgcgattaacaatcggatgaacacggtcacattggcccaagcccgactgcaagggtatgtgattgaccatttgaagatcagtccggccggggcagcgagcgtcaccgtgccacgtactgccattgaggatctgaaattagcagacgatcaggtaagtgccgtggtcggaacacctggccgactcgacattgttgtcgcctgggccgaatttatcgaacaggcagaaggcgggtaccgagttcatttacgttctaaggggcccattatcaatacactcgcaaaagcgcacaatggcggagggcatcccttggccagcggtgccaaagccgctaattttgacgaagtgattcaaatcgaaacgcaacttgatcaattggtcaaagactattcaacttcaggaaagtaggcattatggagaatcaatttaaacaataccaaatcaaaccgttcgtgatcgccggccttgatgctatggggatcacgcaaccgacgccgattcaaaaaaaggtgattccggccttattgcgcggggagaatcttgtgggccagagtcaaacaggcagcgggaaaacccacgcctttttggtaccgttgcttagcatggtcgatcctgaacaggatgcaactcaggtggtcatcacggcaccgtcccgcgagctggccaatcagatttatgcggttgcccaacaactgacccaaacggagccagcgattcggatcagtcggttagtcggcgggatggataagcaaaagcagattgacaaactgcagcatcatcagccacatgtagccattggcacaccggggcggattctagatatgataaaacgttatgatttagtgccggcttcggttcggcattttgtcgttgatgaagccgatatgacgttggacatgggttttctggagactgtcgatgcgattgcgtctagttttccggagaatttgcagatggccgttttttctgccaccattccgcaaaaactcgaaccgttcctgcgtaaatacatgcatcaccccacaatgattgaactcaaaccacagtccgtcatcgctgacaccgttgagaatattctgattgctgctaaaggacaggataaaaacgaactgatttatcagcttgtgacgatgggccatccgtttctggtgttgattttcgccaataccaaaaccagcgtggatgcgattcatgattacctgaaacatcaagggttgaaagttgccaagattcatggtggcgtccagccgcgtgaacgccggcgcatcatgaaagaagtggctgatcttaaatatcaatacgtagttgcgactgatttggctgcgcgtggcattgatatcaaaggggtttcgatggtgattaatgccgagattccgcgggatctggagttctttattcatcgagtgggacggaccggacgaaatggtatggccggtacggcgatcacgctttatgaaccgggacaggaagaccaggtcgccgagttagagcatatgggtatcaagtttgcgcctaagaccttacacaaaggcgaactggttgacacgtatgatcggaatcggcgcgttcaccgtaagcctaagcaggaagaaacgagtctggcgatgcgcggcttagtcaaaaaagccaagcaaaagcatatgccaaactatcgtaagaaaattcgtaccgctgcactactggaacgtaaacggaatgccaaagttgcccgtcgcgaagccttattagctgaaaaacgtaaaaaccgcaaacgaggataaaaaatatggccgtaaacgagttgacgctgccgacatggaataccctgaatgaaaaacggcagcgctttatttttcaacagctgactcgctatttcttaagtccattgctgacagttgacgcgattcgtccggtgaccgctacgttttacggtcagacacttcacacttttgaagcgatgatcggtggtgagtgggtgcggttggttccaggaatgacgaatgtcagtctgggattcgccgcggatctgcaggaagagttggccccttacttggcgcaaagcggtttgactctggctgacattcaacagctgctttcgccggttagaaaaaccgatatgcctcctatgttggtcgcaacaagggcaacgccagccaatgaggagattttgggacgggttagtttgaccacccgaattttcaagggcaaccatatggcatatgcggcaatccgtgcgcaggtactggcattactggatcgtcatggcagccttgatccgttttcgcaaaccggctggccggcaaccctgacgagcggcaatgttaaattgcgactggccagtgcccaccattatcaggtcagtatcgttaaatcgtggcgtaaggctgatttgagcaagtcattgagctattttggcttccgtctgccgactcaggatcaatatgaatacctgcaaagtggcgggaatcccagcctgtttccattcggcaatacgctaccactggaaatgccgcggtatttgcctaaccgctttggcctgaccattccggttaaacgaaccggtagtgagctaattgtcgaagacttgcaaaaaagcacggcgttaacggcacagccgacagcaaaagaggcattggcgttatcgccgttttatcaggttccaggtgaagtagatttgtcatctgccgtgtatcgacgggttgcgacaattacggtgaattagtcgccaagccttcatgctccttaacaaagtgagttgaccccacttttcagaaaagctataatgaaaaaccgttaggacatgcgtcgacccctgtgtgagacagaaacaaccgcgttagttgagaacggttgcgccaggctaagatgtgctccctgatatcagttgaacgaatattaatgaagtggtaatgagtcgcatcattgcaaccaaggtggtaccgcgtgtaagcgcccttggcagcaatggtgctttttgtgttaacgtgcttaccagcccagaggaggaagtgccaaagtgaaaaagatgtcaagtggcgagattcgccaaatgtttctggatttttttaagagtaaaggtcatgctgttgaaccaagtgcttcgttgattccggtcgacgatccgactttgttatggatcaactccggtgttgcgacgttgaagaagtattttgatggctcggtggtgccggataatccgcggattacaaatgcccaaaagtcgattcgaaccaatgatattgagaatgtcgggaaaaccgcgcggcatttaaccttttttgaaatgctaggcaatttttcggttggtgattatttcaaaaaagaagtgattccgtgggcgtgggagttactgacgagccctaaatggttcggatttgatcctaagcgtctgtacgttacggtttatccaaaagataaggtaactaaagagctatggcgcaaggtcggggttcctgacgatcacatcgttgaagcggaagataatttctgggatattggtgaaggtccatccggtccggactccgaaattttttacgaccgcggtcaatcctttaacaatgttgctgaagatgatcctgaaaattatcccggtggtgaaaactcgcgatatgttgagatctggaacattgtcttttcagagttgaatcatctgccagacggccggtttgtcgagcagccacataagaacattgataccggcatggggctggaacgtttggttgccgtgattcaggggacaccaacgatttttgaaaccgacctgttcatgccgattatcaaggcaaccgaaaagatgagtgccggtaagaagtacggtgccaatgcgcaggatgatgtttcattcaaaatcatcgcggaccacgcgcggacggtgacatttgccattggtgatggcgccttgccaagtaacgaaggtcgcggttacgtcttgcggcggctgatccggcgtgcggttctgaatggcaaaaaattaggcatcgatcacgattttctgtatcaattggtaccggttgtcggcgaaatcatgaagagctattacccacagattctggctaaccaaccatttattcaaaaggtgatcaaatccgaggaaacgcgattccgtcagacgttggatgccggtgtcaatctgttgaaccagatcattgccgaattgaagaaaaccggcaagaaagaaatttccggtgccgatgccttcaagttgtttgacacatacgggttcccggttgaaatgaccaatgagtttgcgcaggacgaaggcttgcaagtcgatatggccggcttcaaaaagaacatggccgcgcaacgtgatcgggctcgtaaagcgcgcggcgatcgccagtcgatgggcagtcaggatacggttttaatgaacattacaaccccaagtaaatttaccggctggaccgaattggatcataagcatgcgaccttgcaggacattatcgttgatgatcagctgcagaatgatgtcagtgatggcacggcgcagttgatttttgacgaaaccccgttttatgcggaaatgggcggccaggtagccgatcacggacaaattaaggcgcaagacggaacggtattggcagaagtgaccgatgtccaacacgcacccaatggccagaatctgcatacggtgacggttaacggtaagttggaaaaaggccaagcatactggctgagtgttgatcggctgcggcggaagaaagtatcgcttaaccatacggcgactcatttgcttgatcaggcactgcgcgacgttttgggcgagcacactcaccaagcaggttcattagtcgaaccggattacttgcggtttgactttacgaatttcgggcaggtaaccccgaaacagctccgcgaagtcgaaacgattgttaatcagaaaatctgggatgctttgccgattacctggaaagagatgccaatcgaagaggccaagaaacttggcgcgattgctatgtttggggacaaatatggcgatgtcgtgcggattgtgtcgattggtgattataacaaggaattcgacggcggcacgcatccaaccaataccaatgcattaggattattcaagatcaccagtgaatccggtatcggtgccggtattcgccgggtcgaagctgtgacctctaaggaagcttatgaatatctgacgcaacaacaggattggctgagagaaaccgcagatcatctgaagattgatcaggtgaaaaacgtgccaagcaaggttgcccaactgcaggctgatcttaaaaccgagcagaaaacagtgggtgggttgcaggcaaaacttgctgcccaggctgcggctggtatttttgatcatgctgaaacgattggtgactttaagatcattaccaaacaggttcaagttgccgggatgaacgagctgcgacaattggctgatgaatggaaaaccaaaaacgcatcggatgtacttgtgctgggaacggaagccaatggcaaggcaaacttgctggtagcagccaatgcaaccgcgaataaagccggcatcaaagcaggtgacctgatcaaagccatcgcgccaaaagttggcggtggcggtggtggccgtccggacatggctcaagcaggcggcaagaatccggctggcatcggggcagccttaaacgaagccaaggaggttattggccaacaagcttagtaaactgaagtcgttttactggtaatcatggtcagcttcagtgcctaaattgatcctcttgaatgccatttaaatagttgtaccgtgcgtcagaattcgctaacagttattttgttagtcgaaccctgacgcattttatttttggcgttatgagcgcgatgattcatggtagaatgaagaaaacgattccattgggggtgagtagcatgagagcgttgcggttggccttaaccgatttcttggggacgcgggaggtttatcaagtcgtctgtcgcgataacctggttaacatagattatattgttgatccgacaacgctggaaggagcggccgagaatgaattgacaggagcggatgctgcggcgtttattgccaaactatccgcgctcgacttcaatgcctggcgcaaaccgtcagctgaaaagtcaccgatgctggctgacacgcgctgggaattgacgatcactgacgatggtggtcagaaggatcgctacgaaggcggtcagccacttcctgaaaattttgaaaccttgcttagtttattgaagtatgccgttaccgttcccggcggtcattttttgccgcctacagcgtggcagatggattatgtccgttttggcaccatccagttgccgaagttcgatggaccgggccgctttttaaatcggcaattacgttatcggcgaacgtacctgattgatgcgttgaataatcaagtggttctgaaaactgcctacgccgagccgctttccgatcatgatgttgtctatcatgaccctgagctggtagcatccttagctaaaaaggtgaccgatgctgtggctggtttaggcgatttaaccgccatcactgtcgatcctgctcagcggccgcgagcgattctggtattgacggtaaagtatccgcacggcgagccaacgcaacttcaagtgaatgctgaaaccgacttgaagatgaagaagttatggcagacagtcactgcggccattcagaattttcggcggatcggtgaacgacgtgatctgcaggaagcttatcaactcggtccgcagttgatgcattacattaaagtcaacttccggcaagggtccaaggattatttgtataaaaccgatttgcctggactgcaggaaggcgacgtggtcatcgttccggtgggaaatgaagggcgtacgctgcatggtgaggttgtcgatgcgcaggttatgccgccgattcattttccagtgcatcctgataagattaaacaggtgatcggcttggctgattgggatgacgaggatgatgattgggtgtaacagacgctttcattgactttttacttacttttgctcaggaattgtacatttgcctggctttcaagtaaaatggtctgtgaagcggatagaatagaggtgtaagaatgagcacattagatcaaaccgttcactttgattttcgagataacaatccgaaaaatgttcacgaaacgttggaaactgtgtataaggcgcttgaggaaaaaggctataacccgatcaaccagatagtggggtatctgatttctggggatccagcctatattcctcggtacaatgatgcgcgtaacctgatccggaaacatgagcgcgacgagatcattgaagagcttgttcgaaactatcttggcaaggagcaagcttaatgcgcttaatggggttggacgtcggttctcggactgtcggggtagcgatcagtgatcctttaggctggacggcacaaggtctggagattattcggatcaatgaagataaacaacagtttgggattgcccgcctcaaagagttggtcaagcaatatgaagtgaccgcctttgttttgggtttacccaaaaatatgaacaattcaattggaccacgcgcagaaaagtcacaggcttatggtgatttacttaaagagacgtttggtttgccagttgactttattgatgagcggctcacaaccgttgaggcttcgcgcatgctgattgaagaagcagacgccagccgtaagcggcaaaagcaggtcattgataaagtggctgctcagatgattctacaaaattatctggatgcaaaaggtcccttgacgaagcaataatcatggcaggtggcaacacaggttccgcctgtatttaaggagaagcaagatggcgaataacgaacatgtaacgcccggcgatgacaatcagcagattacgctgatcgatgaaaagggcaacgaagagctctatcaggttttattcacgtttgattccgaagattatggcaaaagctacgtgcttttataccctgccagcgaaagcgataatcaggaagttgaaatccaggctttctcatttacgccggatgcaaacggggatgccagctcgggagatctttttcctatcgaagacgatgaggaatgggatatggtcgaagaagtcctaaacaccttcttggccgatgacgattcaaatctacaagattaaccaagtcatcccccctagcaggccaccggaattggtggtctgctttttgtgtgagcgcgagccggcgcggttagaaaccggagcataagtggccttgagattaaatggctgggctttggccatttaatctcaaggtccttatgtgcaggtttctgcgccggggagcgcgttatggagtgaggacgtatgttttcgaggcggtctttgccaatgcgaccaagttccttacatggaggtttctgcgctgggggagcgtgttatggcaaccgaacacatttcgagcagataactcccaatttcagtcgcatttacccgcacctgctcgcgaccggttaactatggtaaaatacaccttaaaagagtggaggcattcgcgtcatgactgaggagaagcgccgctttaaagccgttattggcggtaaagcgtatacgattatcggacccggatccgagcagcactttttgaccgtgacaaagctgctgaacgaacggctggatcaagttaaaacgctcgcaccggatctgaccgccgaagagcaggccgttttagttgccttcaatgctgtttctgatcaggttaaactgttagcggcccaacaggatgagccggatcaaaaggcatagtgggggaacgacttgatttcgattgcgattattttagtgttggcatatttttattacagtggggaacgtcgcggggctgcgttgcagtggctacacgtgggcggatatgccctgagttttttggcagcaactgccttggcccagccattaggggaacacttcacgttattaattccttatccgtcagcgactaatgccggtcaatttgcgttttattccgataaaatcggtttgacgttagataccgcgttttatcgcggctttgcttttttactggtactgacgatcggctggttaatgactcgaattatctcgttgtggtttcatgatttgacttataaggcaatgggtcaccgcagaagtgctgtcattggcggcattgccaatttggtaatcgggtatatttttttgtttctcattttggcgctgctggctttgattccgattgccgggattcagcagggcctcgaccattcgattgttgccaaagtcatgattaaatattcaccagggttaacacaatttgtgaatgccctttggttgtgaacacagtgacgctcaaggacggagaacggatgtctttgggcgcttcgtggttataggagcagaacatgaataaaaagattttaaaaacacttgaatacgacaagattcagcgagcactgttgcgtcaagtcgtaacggcgaaaggacggcagctggtccagaatatggtgccgttaacggatccggtggccgtacaacgggcgctggatgaaaccgctgacggagcctcagcattgcggctcaaaggtggcattccggttccccagctggaaaatattgatccggcattaaagcgcgtcgatatcggggccgttttgaatggccaggagttggccagcatcagtcgggtgttgcaaacagtgagtgccatcgataaatttttgactgacttacaggatcagattgactttcggcagttatatacgttgcaagaggaactgacagcattgccgcaattatctcggcgtttgaagactgccgttgatccagatggcactttaactgatgaagccagtcccgagctgcacgggattcgtgagcaaattaaacgtattgaaagcgatattcgtaacaaaatgtctgaatatacgcgtggcgcccagtcaaaatatttgagtgatccaattgtaacgattcgtgacgatcgctatgtcatcccggtgaaagcagcgtatcgcagcaaattcggtggggtcgttcacgatcaaagtgccacggggcaaacgctttttgttgaaccacaggctatcgtcgcgttgaataaccgtctgcgtgaggcgcagatggcagaaacagccgaaatcaatcgggtgttggctgagctatcaaatgagttggcaccctatacagggcagatcaaagccaacgcggcggttttgggccattttgactttattaacgctaaagccaagttggctaagaaccaaaaggcaaccgaaccacttgtttcatctgataatgatgtcttgttgcggcaggcacgccatccgttaatcgaccggcatcaggtggttggtaatgatatcccactgggagcagattatcaggcaatggtgatcacaggccccaacaccggtgggaaaacgatcaccttaaaaacgttaggcttattgcagctcatgggtcaatccggcctgtttattccggctgacgatgaaagccgcatcggcatttttgatgaggtttttgccgacattggcgatgagcagtcgatcgaacagaatctgtccactttttcggcccatatggataatatcgtgcacattcttaaacagctttcgcgcaatagtctggtgctgtttgatgaattgggcgcaggcacggatccacaggaaggggcggcgctggcgattgcaattttggatgcggtcggcgaaattggtgcctatgttgtggccacgacgcattatccggagctgaaattgtatggctacaacacccccaaaaccatcaacgcgtcgatggagttcgacagcaaaacgctgcagccaacctatcgcctgttggtcggtgttcccggtcggtcaaacgccttcgatatttcgatgcgattaggtctaccgcagccgattgtcgatcgggccaagtcgatgattagctctgacagtcacgaactcaacaatatgatcagcgatttggaaaggcaacgtaaggcagcagaaaatgcgcgggcagccgcgcaacggcaactggcagatgcccaagcgcttcacgacgaattggctgacgcgtataagacatttaccaccgaacgggacgctcagttgcaacaggcaaaagaaaaagccaatgccatggttgacaaggcgcaggcaaaagcggataaaattattaagcagctgcggcaaatgcaactgaccaatccgggatccgtcaaagaaaatcaattgattgcggccaaaaccgctctgaagcgtctgcaccaagacgagccactgcaaaaaaatcgggtgcttcgccgtgagcgggaaaagcaggccttacatgtcggcgatgaagtgaaggttgccagttatgaacagactggcactttattggaacagttcgacaaggatcattggcaggttcagatgggcattttgaaaatgaaggtgccgacgtcagaactggaaaaagtcaaaccaaccaaacaggcctccgcccagcggccagtggtcaaagttagtggcggtggcatgagcggcccgtccaccacgctggatttgcgcggcgaacgttatgagcaggcgatggccgatctggatcaatatatcgatgcagcactgttggcaggctatccgtcggtgacgatcattcatggtttgggcaccggcgcgattcgcaatggcgtgacccaatacctcaagcgtcaccgccaagtgaaaagctttggatttgccccgcagaatgctggcggatccggggcaacgattgttaatttcaagtagctggtagtattttaccagtgaatgtgctatgatttagttacaaaaagtaagaggaggaatccgttcatggttcaagcagttacagattcaaactacaagacggagaccgacaccggcgtcaccctaaccgatttttgggcgacttggtgcggcccttgtcgcatgcagagcccggtgattgaaaaattagccgagagtcgcgatgatgttaaattcgtcaagatggatgtcgatgctaacccggagacaccaaagtcatttggcattatggcgatcccgaccctagttatcaagaaggatggcaaggttgtcgagaagctggttggctatcaaaccaaagatcagcttgacgcaacactgaacaagtacaccgcttaattgaagcaaaaggaccaacattctggtcggaggctgcagtctgaataaggctgtggccttttttagaagtgtcaaataagacgcgtaactttttagcacacaagcaggtttgtgcgaaagttacgcgttttttctttttcataaccagattggtgagactcaaaaattgggggttaaagcaaataccgttcactgtggatataaaaaacatgataaaaagacgaatcttaatccaaatcgaggaaaatcagtgggattttgcagatgtaatcgctatattagggttatttcatcgtggtggtttagcctgggaaacgacctgtattgaacacgcataaacgcgtccgacgttggtataacaggaactttgagatgttaaacaattgtttgggttgaagcccggtagatagttgtctggttcacattacgaaactgttaggtgattgttacgcttttcgttggcgaggcgttttctgtaaaactataatagacgtgtaattaagaacgtggggtgacaagatgttcgcaaaattaaaagcggtgtgggaaaatcccacatttcggttcatcttttggaccgtcacgtatttcgtgattctgctggttctggtttatctatacggatacagtggcatcaataacagtaaattcatctataacgagttctaaaaagggggaaaaccgagatgatcgataatgtcatcacagcgattgatcgggtcgccgcagagcatccaacgcgcgtggcttatgattatgaaggtaaacaatacacatacgcgcagttaaaagacggcagtgatcgcttggccggtttctttgcggaaaccttgccagatggtcagccgatcattgtgtatggcggacaaacctttgatatggttgaggttttccttgggctttcaaaatcagggcatgcctacattccgatcgatacgcacagtccgaatgaacggatcactcaggtccaggatgttgcccatgcaccggccgtcattgaagtcgctccgctgccgattacggtgccagacgtccagattattaaggcaccggaactccatgacgccgaaaagacgcatgaaccgattcgttccttgcaacatgccgtcaccggagacgataactactacatcattttcacgagcggcacaaccggcaaaccaaaaggcgttcagatcagccatgagaatctgttgagctatgttaattggaatatctccgattttggccttcaggaaggcgtcgtttcgatgtcccaaccgccgtattcgtttgacttaagtgtcatggatctatatccaacgttggtactcggcggcacgttaaaagctttgccaaaagaagtgactgacaacttcaaagacttatttgcaacgctgccaaagctcggtctgaatgaatgggtttcaaccccgtcatttgttgaaattgccttgctggatccgaactttaaacaggaaaactatccgaacctgacgcattttctattctgcggtgaggaacttgtcaataagaccgcacaggagctgattacgcgcttcccgaaagcaacggtctataacacttatggtccgacagaagcaacggttgccgtgaccggtatggcgatcacgcaggaaattgtcgatcaatatccgcggttgccaattgggtatgccaagcctgacaccgacattttcattgttgatgagcaaggcaatcaagtaccgcctgatacggaaggcgagttaatgattgtcggaccaagtgtttctaagggttatctcaataatccggataaaaccgcgaaagctttctttaaagttggcagtaagcgggggtatcgttccggtgacttagcaacgatgacggcagatggcatgatcttttatcgtggtcgtaccgattttcaagtcaaactgcacggttaccgcattgagctggaagatgttgaccataacctgaatcaggtttcttacatcaagcaggcgtcaacggtgccgcgctacgataaggatcataaagtagcacaattaatcgcttttgcggttgccaaacctaacgacttcgatagtgatatgaagttaacgcaggcggtcaaagccgaacttggcaagatggtgatggaatatatgattccgcaacgcattatttatcgggatcaattaccattgacagcgaatggcaaggttgatcgcaaagcactgattgcagaggtaaatcactaatgctgaatttacaaccttatgaaaatccacagtattttctctatttgatcatcgccttgctgccggtcatcatcgggatgtttaaaggcttcaggatgcattggtatgaaagcatcttttcactggtgttcctggttctgatttttgatgctgataagtggccacagggtaaggcactgttgggatatgttgtcttcaacctgttgctggtatatgcctacttcaagtatcgcacgcgagaagggtcgaaaaactcgacggccgtgttttatctcagtgttgcgttaggcattgcccagctagcggttgtcaagtttaccccgttgttccaacatcacggctcgattctgggttttctgggaattagttatctgaccttccgtgtcgtcggaacgatcatggaaatccgggatggctcggtcaaagacctgaatatgtggaagtttgtccaatttctattgttcttcccaacgatctcaagcggcccgattgaccgttatcgccgcttcgttaaagattatgatcgggtccctgaccctgaacattatgcccagctagtcacaaaagcgatgcattatttgatgctcgggttcctttacaagttcattttgggttacatctttggaacgctgtggctaccttccgtcgagcatatggcgatggcaagtcgcggtggggcattcttgggactcagttggccagttgtcggcgtcatgtacgcttattccggctatttgttcttcgactttgccggttacagtttgttcgcagtagccatttcgtatctgatgggcatcgagacgccaatgaacttcaacaagccatggatgtcttataacattaaggacttctggaatcgttggcacatgagtctgagcttctggttccgtgattacatctacatgcggtttgtgttcttcgtgatgaaacataagtggttgaaatcacgggtctcgacggcgtttgtcgggtatctggtgttattcctgattatgggtatctggcacggggaaacctggtattacattgtctatgggctattccacgccatgctcatcaatctgaccgatgcttggctgcgctttaagaagaagcacaaagacttcttcccgcacaataaggcaacgcattactttgctattttcatgacagcaaatgcagtctgcctttcgttcttgattttttccgggttcttggacacactgtggttccattaaaaatgttgtggtaaatggccggtcgttcaatgaccgactggagttgaaaagaaagaggtagttgataatggcagacgaatcaattaaaaatggtgttttggatattttggctgatttaaccggttctgacgatgtgaaaaaggatttggatatgaacttgtttgaaaccgggctgttggattcaatgggaaccgtacagctgctgttggaactgcaaagccagtatggtgtgaacgcaccggtatccgaatttgatcgtaaggagtgggatactccaaataaaatcattgcaaaggtcgaacaagcacaatgaaaaaaccgatcgggaagatcctttggcgcggacttggcccgctgctgatcgctgtgatcctggtcgccgccttgatgctcgtgccatttaagtttggcagcagcagccaagcgacgatcaggcaggcagccagttcaatgtcggccaacgtgcttaaaggcgaaaatattaaaaatgaagccatggccgagaactatgtcccgttcattgggtcatccgaattgtcgcggatggatgctttgcacccttccgtattggcgcaaaagtatcatcgcagctatcgtccgtttttgatggggatggccggtactcaatcgctgacacatttcctgtcggtcaacgcgttgacgcatgcgaatgggaaaaaggctgtgatggtgctgtcgccgcaatggttcgttcctggtggtgtgcgcaaggcacagtttgacttcttcttttctccggcgcaactgacgacgttcctgttgcatgctaatccgaattcagaagcggatcgctatgcagcgcgccgactattacaatttccttcgactaactcggatcggatgtctaatggggctttgaagaacattgctgccggacagaagctgtcggatgcccagtattggtatttgaagcaagttaaaagtccgatggctgatcatcaggatgccttgttctcacagctgtttttaaataataatcagcctaagttgaataaggcggccaaacagttgccggctaagtatgatgttgacgacttagacggtgtggcgacacagataggcatgaaggacacgacgaacaatccttttggactcaagaatgacttttattcgaaaagagttaaaaagaatttgcctaagctggaggggtcacaagcgcactggagttatgtgaaatcgccggaatattctgatctgcaactggttttgaatacctttgcgaaaaagcacatggaagttttgtttgtcattccgccaatcaatgccaagtgggcagcgtataccggcttggatatgaacatgatccaagataccgtgacgaagttgaattatcagctgaaaacacaaggctttaatcatgtcctggacttaagccaagatggtgcgcaaccgtacttcatggaagatacgattcatattggctggcgcggctggcttaaaatggaccaaactgtccgtccgttccttaaaacgaataaggcagcaagaattcattacaaacttaacgaccagttttatacgaagagttggcaacagcggtcagccaatggcctagactgaggttctgaaaatagcgatagttaatattcgtgcctgacaaaaagcggccccgaagacgaatggcgtcttcggggtcgcttttgcatgattgcgtctaattcaaggttgttcggtcatcccttaagttgatggtcgacctgaaggggagttactgatcatcgggcgccagatcaatgagatgatcggcagtaggttgcgaatcttgattgtccatgacaacggttaggacaacgttttggtcgcgccgttgaatcgcactgccgccttcaacggcaaagcccaagacctgttgcaatgattgggctaaaaacccggcttcaagttgaaagtctgggtcatcgtatgtacgaatacgggttgccacgacgtctccagccagcaaatattggcgctcctggcgcttctgtttgagcggcgttagggtaccgaaaccgacctgggtaaagagttgcggcaaggcggtttcatcgactggcaatttggttgccaagtcgcgtcctgcccaatagagaatatggtgctgttcttcacccagcatattcggcaacatcagatcgcgcattgccgttaccgcaaagaatgagaccgagccgggaaggttcagcagggtggtataatcagattttgccatgttgtgcctcctgtttctattcgtctagtatagccgaaaaatgggtttaaaaacatgcttttctgaacgcttgctttttttaagatttaaactcacaatgaagtttcagagttttatcgcgacagataagtatcaggggccgtcacgtgctttcagtcggggtcgcgctagattttgcaatttagtaacaggctagcgtggcagtcgacattaaccaacggcgataccttaaattgaagtttcaaaaggagattcatcatgatgaacaagcaaccaatcggatttattgactcaggtgtcggcggcttgaccgttgtgaaagaagccttgcatcagttaccggccgaaaatacggtttatttaggcgaccaagcgcgtctgccatatggaccgcgacccgccgaacaggttcaggcatttacttggcagatggttaatttcctgctcaccaagcacattaaaatgctggtcattgcgtgcaacacggcgacagcggcggctttaccgttgattaaagccaagctatcgatcccggtgatcggcgtcatcaagccgggcagtcgtgcggccttaaaagcaacgcgcaccggccacatcggcattatcgcaacagaaggaacggttaaaagtggtgcctatacccaagctttgcggacgaaagcgccggacattcggctaaccagtctggccgcgcctaagtttgtatcactggtagaaagtaacgaggcgcattcgccaattgccaagcgggtggtggcagataccttgcagccgcttttgcacaccgacattgatacgctggttttagggtgcacccattacccgattttacggccgattattcaaaacgtgatgggcagcggcgtcactttaattgactcaggcgcagaaaccgttaatgatgtttcgatgctgctggactattttgatttggccaatgacagccatgaaacgcccacgcacgcttattatacgacaggagccccttccatgtttgatgaactgggtgaggcctggctcgagctgaaagcgcccatgcatgcccagcatgttaacattgaatcggagccgactcactttgtcgacatggcagacataacgaatggcaaaaccatcgtggtagccagcaaaaatcccggtaaagtaaaagaatttaaggcgatgtttgagcccgctggcgtcacggttaaaagtctggctgattttcccagcgttccgactgtcgacgagactgggacgacttttgaagaaaatgcgcggcaaaaagccgaccagtacgccaaagatctccagttaccggtgattgccgatgattctggcttgatggttgatgcgctggatggtcaaccgggcattcgttcagcccgttatgccggcgatgggcataacgatgcggcgaacaatgccaaacttttggcgaatttagccgatgttcctgacgatgcgcgaaccgccacgttccatacaaccttggtgctggcaaaaccggatcacccggaagccgatctggtggttcatggtgatctttccggacaaatcacagccatcccgcgcggaactgatggctttggttacgatccatttttcttggtgccatcactaggcaaaacgttggcagaactgactgccgaagaaaaaaatcagatcagtcatcggggcaatgccatgcggtcactggagaaagtctggcaggcatggttggaggaagagatatgaaaattctggcagtaagcgacacgcacggcgatcgtgaaattcttgcgacaatcttgaaacagcagccggatctggatggttatttctatgctggcgattcggagttacctgcggatgattcgctttttcaaacgtatcatgcggttgaagggaacatggactttgatcctaattttcccatgagtgtgacaacgacggttaaaggtatcacgattttcatgacgcatggtcatcgatttggcgtgaactttggattggataagctcatggctgccggcgaagctgcccacgctcagctggtgattttcgggcatacgcatcaacttggcgtggaggagcgcgctggcatggtgattttgaatccaggctcaattagtcagccccgcggtcagtttaccaatttaggcggtacttacgccacagtttcctggacagaggacaaagtgcacgttgactttttgaagcgggacggcagcatcgttgcgccattaagccgcgactttttgcaggcgtgatcggcatgtttgagataattaaaaatcggttctagcggcaattgctagagccgattttttatgagaatcaaaccgttgttacatgaagagttgtttgtaggtgaagaccgcgagaatggctgcaacgattggtgcgattacaggcacccaggcgtatccccagtcggaactgcctttgtgttttaatggcaaaagcgcgtgcagaattcgcgggccgaggtcacgggccgggtttaacgccggtccggttgggccacccagcgatgccactaatgtcgccacaaggaagcctaagcccatgtgtgccgttccaagattgtcttggaagaacggtgctttggtaataccaagggcgccgatgaaaagaatatacgaaccgataaattcgttgacgaaaccgtttagtttgctcttcgtcgcactgatcgtactaaatgtcccaagaatgtgttgggtattggtcgtgagatcataatgcggtttgtaagctgcaacgacaaacagctgtccgaccatggcaccggccatctggaccacaatatacggcaacacttctgaccacgggaacatgccagaggcagctaaacctaacgtaaatgcaggattgatgtggttaccggaaatggcgccaaacatcatggcaggaatcatgaccccggcgccgtagccgaccgcaatcagcagccagtccgagccatttcctttggtacccttcaaatcgacgttggcaacggagccatttcctaacaaaaccataatggcagtgccaataaattcggcggccaaacgcacgcctagatcatatgtcatttttacccctccaaatgattcgttcattgctagcatgtgcatggtgcttactttgatttgctttgttgcttgcgataacgtgttcttccggctctaagcgggctggctcacgctccaccataacgcgttcgcagtcgcagaaatctgcgtgtaaggacctcggtcgcaatggcaaagagcgccatcacgcccaaggccacttacactccgatttctaagcgctcctgctcacgctcacccataacgcgttcgccagcccagaagtctgcgtgtaaggacctcgatcgcaatggccaaagcccggccattacgcccgaggccacttacactccggcttctaaccgggctggctcacgctcactaaaaagttgtcgtatttcttatgaataacggcgatcgaaattccttgatgtcattcatggtaaaataaccatatggtgtttccgccttttgacggatggcaccggcatggataagcggtaaactgaaccaataaagttaactaatctaactttttgctcgatgtacttaaaccaagaatgttaaaaaggagctacccaaatgttaaatcaagccattgccaatatgctgattgaaaatcgtcatcactttatgatttctgcagatatggttgcgacggtctccgaagacaacccattaagtcatgcgtttcttgttcttaccaaggtgcgctatgcgaaaattccggttttggatcacgactcgaagtttaaagggctcatttcactgccgatgattaccgaaacgatgctgggtctggaccatatcagttttcagtcactagataccatgaccgtcaaagatgtcatggagactgatgtggcgacaattagtgacccctatgacttggagaacgttttacatttgcttgtcgacaacccgttcattccggtcgttcaggatggatactttaccggtatcgtgacccggcgtgaggtgatgaagggcatcaacaatattggtcacaatatcgacaagcatttccagttggaacctttagcgtcagtcgttgaaaaagaatcttaaccccttaaaaaccggcatgcggacaaacctgtgtgctggtttttttgttggccacattagttagcgtctgcgttggattccggtttatctaggaaaatggtcgctaaaacgccgatgatgaggctaaccacaaccaaaagtgccggaataaccatgccagtagccggccaataaggcgcgatgccagtttcgagcagaatgaccactgctgcggcaacaataccgcatacagcataataaacctgggtttcgaaatgctcgagcaaatacgccatcaatttggccaccgcaatcagaccggcaatggcgccaagcatgaagggcagcagcaacgccaccgagcccatcgctgcgttaaatgccgaccagttaccggaagcgaatgcccgggctgcatcgcctagctggctgacggcattgtagacggttccgtattgatcaatgaccatcagcatgacggagccggaaataccagggatggccattaacgataccgcaaagatgccggcaaaagccatcacaccggcgtcactaacactgctcaggcgctgaatggcaatgaggttctccggctgggtcccgccaatcttggctagtccgtaaatacccgcaaatcctccagccactagtaagaggtaccaccaagtgaagggtttgagcaccaatttgcgataaataaacgggccgatgccaagtactaacccgataaagaaaccataactaggtagcggccaatgcgtggtgacgactaggacggctttagtggaaaccaagataccaacgacagctcctaagccaatcggtgccaagaaacgcaaatttttcttgggattggcgcggaagtgattcactgcttgtaagaggcggtcatacaacccgacgacgacggcaaaaatactgccggaaagaccgggaatgacaagtgcaatgccgatgatggcacctttgatgaagttgagcatagcatctccttataaatggattttggtgtgaatattggtaaaacgccaaactctttatgagccagactgtaaattgatcggcggcgttatcacatgaatgccggcggagtttaatgcagcaatgtaagcagcgagaaatgttcgctgtaaactgagctgctcaccgttttcagcgtaaaaaagaacttggtaggtaaacgtgccatttttttcctctgtcagacccagaatatccggaccctcagtgatagtcgtgaactttggaactaagtcgtgattgacgcgttcaatagttttgcggaccaaatcgagatcagcagtcggctcaagtggcaacttaatgagtacctgcatattgctgcgggaaaggttgctgacgattgtaatgttgcgattagggatgaagttaaccgtaccgtcataactcttaaccaccgtggtgcgtaagccaaggctcgtgaccgttccggaaatcttgcctaattggacaacatcaccaacgtcaaactgcgcctccagtagaataaagaaaccagtcacaacgtcattgacgaagccttgagcaccaaagccgattgccaagccggccacgcccgcaccagcaagcagtgtccccaccggaacgcccaacgttgataggatcgcgtaaaaatagaagaagagcacaaaatagaaaaatagatttcgcgaaagggtgtggatggttttgacgcgcgtgcctgataaatgggcgcggcgttgatagcttttaaaagctcgattgatggcaaactggcctaaacgataaagtgcaagaaataaaatcgaaaagaatagcaacgacagaaccttatcaattacggtcccggcaattttatcccagttgatgattttaaaataccgtaaccacacattgggttgttcagttacggccgttgccgtgaacatcatgcctgtcacgtgacgacctcctcttggtgttggctttattttaccagaaccggggcggatctgctggggatttgtcatgatgcggataagttttaacttttggtgggagaaggggtgggtgagggtggtagggagtaagtgtggtaaggtaattcggtttcggatgtgttcgatggcgcaggggggcggcgtgtgagggcattggtcgcaatgggcagagccgggccattgggggaataagctttgcggggcaatccggcccgaaaacgcgctcgcaggcccagaaatctacacataaggacctcgaacctaaatggccaaagcctaggtattgggggaataaattttgcagggcaatccggttccgaaacgcgtttgcagtcgcagaaatctacgtgtaagggcctcaagcctaaatggctaaagaccagccatggggggaaaataaggatagaaaggcaatccggctctgaaacgcgctccctggcgcaaaaatctgcatgtaaggacctcaaacccaaatggccaaagaccagccatgggggggaaaataaggataggaaggcaatccggttccgaaacgcgatccccggcgcagaagcctgcgtgtaaggaccttggtcgcaatggcaaagagcgccatcacgtccaaggccacttacactccggcttctaaccgcgccggctcacgctctttaaatcttttgcaccactctcccctcgatgttatgattgatgtaaccaactggtttgaaatggagggtgttgcatgtcaggtggagagattgcttggatcattgctgcggttgcttttttgattattgctttggcgattgccgtcattgcgattcgggtttcgggtgtgaccaaggaagttaaggaaacggttgccgagacgaataagacgttgaacacggtcaacggggagcttggcattttgacgaaggaaatcgaaggccttcttgcgaagagcaatacccttcttgaagatgtaaatggcaaggtggcggcaattgatcctgtctttaccgcaattggtgagcttggtgaaagcgtttctgatttgaatcagtcaacgcgtaatttgaccgaacgcgttgcccatggtgctaagaacggggccaaggcgacggttgcgacacgtatgggtgccaaagcattttcaatgttgaccaaaaagaaacatcataatgaatagcagggggaatcagcatggctaaaaaaggacattttttgcttggatttgtattcggagctgccagtgccttagcaacgacttatttattgacaccgcaaaccagtgacgagttgaaacgacgcgtcaagcatgcttccgcgaatttagccgatcgtgcggttgattattatgattacgccaaagaggctagtgctgactggaagcaaagcgcaacggattttgtcgatgacttgaaggcgcgtgggaatgatgccgatgggtcagaagcgttggctaattatgacgctgcgactgagcaattgcgtgatcaattgaataccgcagcggatacggatacttcggctgattttgatgacattgtgctggatggtaagagtgcgtttgcccaagccaaagacgatgatgagggtagtgaaacccgcaccgatgaagtgcctgaaccgaccgaaccaaagccggttagtggtgcagcggcatcagaagccaaaccggcaagttctgaatctgaagctaccgattaatcatcaccagtaacaccggattttgaatattaaaaatggcgacaaacgaaagacaccccgacgtgagcgcctttcgtttgtcgcttttagcatcgtagctgaatttgtttgaagcattttgatcatgaatgagggagaatactatgctaaatagcgaacgtcaggcacacatcaaagccactttgagtactgctgccgaaccgctcagtgcgtcgagttttgcgcggcggtttaccgtcagtcggcagaccatcgtcggtgatattgcgcttttgcgggcccaaggcgaaccgatcattgcaacgccgcgtggttatacgttgtcacatccagcggctcatgagtttttgattccttgcaaacacacgccggagcaaacagaggaagagctgcagctgatcctcgacaacggcggatggattgaagatgttttggtcgagcatccgctatatggtcagttacgcggccagctgaatattcgcaccgttgccgatatgaagctgtttttgagtcgcctagcgcgttatcagggccgcctgctgtcggagctaaccggtggcattcatttgcacacgattagcgttagaaatgaacgaaatatcgccaaaattaaagaagcactgcgcaaggccggtattttatatgaacagtcggaagcagactagtcaatttcggtggtagagacaaaaatatcagcagtcaacaacataaaaatggtcccgaggaggcagcgtctacctctttgggaccattttcgatattagcgcactgttcagtttttaccgacgagcgatccggcgtcatcagcctttaatgacagtgaattcctttgatgtgtgggtaaacggttcgcagccggtttccgtgacgtggacacagtcttcgatccgaacaccggcgacaccaggaacgtaaataccgggttcgatcgagaagcacatgcctggctgtagaatcatgtcgttgccttccatgatggatggaaattcatgggtggacatgccgatcccgtgtcccaagcggtgattaaagtactcgccgtaacccgctttggtaataatgtcacgggcaatcttgtcgagttcggatgcttttaatcccggcttaacggcatccatagcagtcaggttcgcttctagacaaatatcaaaaatttcacgcggcttaccggtgacctgaccaaaagcgacggtgcgcgtggcgtcagacatgtaaccatggttgtccgtaccaagatcaaacaagaccagttcatttggagcgagctttgttcccatcggttcgccatgcggattggccgcatctacgccagcttggacgatggtgccaaaactcatgtgcatgacgccttccttcatcatcgcatagtcaatttcagccgcaacttcctgttcagtggcacctgccttgatcgccttaaaacctgcttggaacgcgcggtcagcctgagccccggcaatttccatttgtttaatttcggcaggtgttttgattaaccgttgcttttcaatgaaacgggaagcatcaatcggaaaagtcgcatcaggaaactgcttcatgagggcttcaaatttgaagactgcgaggttatctttttcgatagcccacttggtcggattagggttcacgtccttgatatgggtcgccatgacggcaaacggatcttcgtgatcaagatagccaaatacctgataaggccagccggtttttttaacttcctcaatggtgagttgcggggtgaacaggaacggatccttgtccggggtgacgattaaggcggtgatccgttcttcgggatcctggaagaagcccgtgtaataattgatattgaccgggtcactgatataggcaaggtcgaggccttcttcgccaacccaggtttgtaatgctgctaaatgctcgttcatcgtgttcctccttaaaagggcccaacacaaaatatcatgcaaaacgaatcttttaccatatttgtgctgcaccgtgatattaacgcgccagttgctcaggcaccgaaaatgacccgcacaataaggggaccaatctcaatgcctgatgcaactttctctaacagtatatcacgagcaatacgccggactttctgaaaagcctgtttgtgaaaatttcatggaaaattcagtaaaacgcttgcattgcctttctcattctgctattttggaatgtaaatagatgtttcgtgattttcatactcacgactaaggagaaaataaagtggaaaaacaaacaataacaatttatgatgttgcccgcgaggcaaatgtatcgatggcgacggtgtcccgagtggttaatggtaacccgaatgtgaagccggctacccgcaagaaggttttagaggttatcgaacgcctcgactaccggccgaatgcagtagcccgtggcttagccagcaagaaaacgacaactgtcggcgttatcattcctgacgttaccaacatgttcttctcaagcctggcgcgcgggattgatgatgtggcgaccatgtacaaatacaacattattttggcgaactcggatgaaaataaccaaaaggaagtttccgtacttaacaccttgttagccaagcaggttgacgggttgattttcatgggtcatgaactgaccgattcgattcgcgcggaattttcccggagcaaaacgccggttgtactggcaggttcgattgatccggatgaacaggttggcagtgtcaacattgactacgtggctgcagttgaagaagcgacgcaccaattactggagagcggtaataagcgggtggcattggcgaccggctcgctcacccatccgattaacggtcagttccgcctcaagggctataaacaggcacttgaaaaagccggcgttgcctatgatgaaagcctgatctttgaaaatgagccaagttatcaagcagggttggcattgtttggtaaactgcagaaagtcggcgcaaccgcggtgattgccggtgatgacgagttggcagtcggcattttggatggcgcactggacaaaggcgtgaaggtgccggatgattttgaaatcattaccagcaacaacaccaagttgactgaaatgacccggccgcaactgacatcaattgatcagccgctttatgatatcggtgctgttgcaatgcggttgctgacaaagatgatgaacaaagaagagatcgaagaaaaaaccgtgatgttaggtttcgatattttgaaacgcggctcaaccaaataaagttgttgcgcgaagtcggctttggcacctcgtgagcaataaaaaatcggttctaaagacagatgatgtgtgtctttagaaccgatttttgcgttactggattgagtggccttcaagatgacgcatgaacttactgaccgctgccagttgtagcaggtgtggtttgctgattattggttgttgtgccgccggtcgtgttaccgccagtcgttgtcgtgccagtgccggttgtttcgccgccagtgccagttgcgccgtttgtcccgccagtacctgtggtttgtggttcacttggctggttttcggaagttccctgctggtttttctgactggaaggcaccgtgacgctaggcgtttggctgctttccgtcgtggccggtgttgtggtttcaggcgtgattggcgtttcctgatgttcttttttggcttcggtcgagcggccgttagcgtcagaaacctgaccatagccgttacttttgccgttgagatggtcatagaacaactgataattgtctttgctgccgccgatgccaaattcggctttcgcagttggctgccaatcattgtaaaggctggtaacagttgatccgcctgtatgataagtccggccgttaaaagtaagggtgccagccggttgtccggtttgcttatcaacagtgacagacttgacggtacttggtcgagctagttttttgtcaactttaaattgcttagggatggtgtgataaaccgcatttgccaacttcgaccaataagcttcgttggtcattgaactattttcatcaagcgtgtagttggtgccgttgctgttgtcatagcccatccaactggcaatggtgacaccaggcgttgaaccgataaaccaaatatcacggaaatcgttgctggtaccggttttcccgatcaggttatcggtgttgaagcgcagctgatagttcaggctctcagctgtccctgattcaaccacgtttttcagcatttgattcatgatgtagttagtaccttcagagaaaactttggtctttttaacatgatgccggtagacggcatggcctgaagggtcaacgatttcagaaatgacataagccggaacgtgttcgccttcattagcaaaagtggagaaggcgctggcttgttccttgacgtcgacgccataatcggtaccgcccaaggctagaccgagctggctgtaatcgttatcggtgagggtatcgatgcccattttttccatgtaacttttgacattgacgttcggcttgatgtgtttatacagattaactgccggaatgttgtaggattgggcaagcgcttcggtggcagggatgaaccgattttgaatctggtcgccgtaatcggtcacactgtaattgttgccaaggttggttttgaagtcagccaaagccgtctgcgaaccgatgactttttgatcgatcgctggtgcatacaccaaaagcggcttaatcgtggagccgggagaacgtaaggtgtaaatgtgattgagttcgcccgagaccccgccgacgaacccgagaacagcgccggtttggttgtccaacacgacagagccgttttgaaccggatgtttaacggtttcggtttcgccggttttaggattgatctgggtgctggtataggtttggccgaatgtgtttcgcgtggcgcgcatcacaaattgcatccggtcgtacacgtctttgttgatggtacttttgatttggtagtttttcgaagcaaaaaggtcgcctgcctgccttaaataatcgttgttcaaggcattgtctttggcaaggtcggcagcagagtgaccatcattttgggctaacttctcagctaataatgatttagcttcactgagtaccatgttgtagacatacccatactcattgtcatcctgctccgcgttttcaggcttgaggaacgcgccttttagatcgaatgatttggctgcaacatactgcttgtgactgatgacgccagcccgatacatccggaacagaacggtctgttgccgattaatgccggatttgaggctggcttttagttggccatcggcagtatacggtgtgtaaacaaacggactctgcggcagtccggcgataaaagcggcttccggcaggttcacctgactggcagagacgccaaaaagtccttgtgcagccgcttcaacccccgcaatgttttgccccttgttattccgacccagcgtggcgacattcagataagtttccagaatttcgttcttgctgaagtggttgtttagacgccgtgccaacatgatctccgcggctttacgtttgaaggttgtctctgagttcaaaaacatcattttgacaacctgctgtgttaaagtcgagccgccagtttggttacccatgccggttaagtcggaaaagaaagcccgaatcaccgccttaggcaccaccccgtcatgacgataaaagtcttcgtcttcagtggcaatgatcgccttggtcagccacggcgacatgtcactaagactgacctttgtcgaatacaaatcgcttttgacatcgctcagcttgacgttatgtgcaaaatacatactggaagtacggctggtgttggatagcgttgccttcatcgctgcttcggtcggaatcggcgttgcatcgatgatcgacacaaaataaccgccaaataagccgaggccgaaaacagctgcaatgcctaaaacgcctaataagtaatagacaatacttttgatgctttgaagcgtgacattaccgtaaaaaacaacggcagttttacccgttaaatgtttggaatcagctttggaatcaggacgccgcgtcacgaatgccgtgaaccagcggcgaaatcgagtcccaagcgtcttgacccgatcgacgaactttttcaagtgcttgtcccaccttaaattttggtctaatactccttagtataccgtaaaaataaagcggattctaatactgtaaaaagagcgtgagctggcgcggttagaagtcggagtgtaagtggcctcaggcgtgatggcccgggcttggccattgcgcctgaggtccttacacgcagacttctgcgccagggatcgcgtttaggaagagcgtaagctggggcgcttcggaacctgattgccttacaacccttattcctccacgagccaccgttgcccattgcgccagacaacgcacttcaaagccaacttacctgtttgccctcacaattcatagtttcaagcggcttcacttgcgacccgcgttgtgttgtgcaagactgataactatataaataagcgtgcgagaacaggggttaaacatgtatcgagttattttgtttgatgtagacgacactttgttggactttaaagcaggggaactaaaaagcctggctaagatgtttgccaggcttaaattaccatatacgccgcggattgaggcgagttatttgaaaatcaatgctgatctgtggcgtgattacgaagcaggccggattacgcgaccggaattgtttgacgtgcgatttgccaagctgtttcgccatcatcatttgaacgccgatccccatttggcagagcggacgtatcaccattttctggatcaggaagcgattttgctgccgcgcgtgacggaaactctggatgctttaaaagactatcggctgtttatcgtcagcaatggcattgagccggtccaacgtgagcgcctggcaaccagtggcttaattgattattttgaggacatttttgtttccgatagtgtcgggagcccgaagccgaccgtggcgttttttgattatgttgccaagcgaattccccggttcaatcggcacgaaacattgattatgggcgattcgttgacgtcggacattcaaggcggcatcaacggcaagattgattcaatctggttcaatccgcattttcaacctaatcgcgagcagataacgccgacttatcagctgaatgaattcagtgatttgacgaagttactgcttgccaactagacgatgtgtggcttaatcggctaagcgaatggtgccagttgtaacgaccattgttccttgggccgtttttaacagtaaggcaccattatcatcgaacccgctgatgattccggtcagcgggttttgtgtaccgctaaccgtgatttgccgaccgatccaggcagcctttttccgataaatcggcataatggtgtcaggattcgcaaacaaccgcatgagattcgtcaagaaacggccggcaaactccggacgtggatcgctaccgggcttttcagtaagaagggtagtgattggctgatcggtcggtaacggcgctgtcggggtcggaaaaatattaacgccgacgcccagcaccacagcattttgttcgagcaatgcttctgccaaaataccggcaaccttttggccgtttttttgcaagtcgttgacccatttaatggcggtggcaataccaaattgggtttcaatggcttgctgcaaagcgatacctgcagccggcgtgattaaggcacggctgatttgcgggtggaaggcgtaactcagataaagacctgcatctgccggactagcaaagtgtttgccatggcgacccacaccggcagtctgttcaccggcaatcagaatttgcggtaacgtagcaccattttggacggtttgttttaaaactgtgttagttgatgtcaccgttgcctgcgttgtgacggctgcacgcaaatgtggatcatctaaccatggatttaagctatcaggcgttaacataagaaagcttcctttctgggatcaatcgcaagtgcgccagaagtcaggtgacagacttctggcgcacaggcacgagcatgaatttcaaaatttgccaagaactgtaatcagtaatgtgaatactgattacagtttaaaaatacagagacttagcttatttgactaagcggctgatggcgtcggcataaatggccacagccgtgatgatatctttaatcggcatgtactcattcgcctgatgcatgacattttcctgtcccggcatctgggcgccgaaagcgacaccccgtttgataattcggccataggtgccgccaccgatgacttgttcgtgtccggcaataccagtgtggtcagtaaaagtttgcagtaaggtcttaactagcggatcgtcaccaggaacgtaatgcggttcctgtgcatggccactcaaggatacgtcgaattggtcggcaccgaccgcgctttcaatttgatcacggattttatcagcatcggtgccttgcggataacggacattgaccaatacactttgttcgccatcctgggtaaacgtgaagatatccgggctagcagttagctcgcccattagtttgtccgtgtagttgatacctaagtggtggccgcgtgaatctaaatgcaggtatttggcgaccatggtcagatacgctttgcccgccggatcaaaaggcagatcagctagcaagcttgccagataagtggcggcattcttgccatcctttggttcctgggcatgtgcacctttacccacgatttcgatcgtcgtaggattgcccagcgtcaaggtgagtttgacaccttgctgatcagcccaatcgctgacttgggtcgcaaagctttcaggcaaatcgccggtgatggttgcttttgcttcttgcggcaccatgttcggtcgaatgcccgccgaaaactcattcaaagtcagctcggcttctgctgcagcaaccggcttttgcacgattttgaaactggcgatgcctttttcaccattaataattggaaattcggcatcaggagagaagccaaagtccggtgcaggttcgctttcgagatagcggtgcaggccaacccagtcggattcttcgtctgtgcctaagatgaagtgaatctttttattgattggcaagcccagatcgcggatgagtttcaatgcatagtacgcggcgatactcggccccttgtcatcgctagtgccgcggccgtaaatcttgccatcgcgaatcactgggtcgaatgggtcggttttccaaccaggtccagcgggaacgacatcgacgtgaccgaagagaccgaaaatctcagaaccgctgcccaattcgattcgacctgcaacatgatccacgttgagcgtcttgaaaccatcccgctcggcaatagccaaaaaggcatccagcgcttttgccggaccgggtccaaggggatattctgcggttttgtgctcggtgtcgcgttcggaattgatcttcaacagtgttgtgagatcagaaagaagctggggttccaatttttctgcttcctgctgccaattaattgccatgaggttaacctactttctttctatcgttgtctttagaatagcatgtttgttccacagaaacgactgaatcattcagagaaaatagaaaagcggtcagaacacggtgaaaagcttgtcatggcgcgattgtaagcacacccatgtctgggggtatttctcaaccgatgtcagtgacccgagcattaagcaaaggtgtatcaaatgccgtgttacctaatgcccagtggatgagcggcttttcttttagtggaatgctgcgatagagcatgagccaggttgccatgttttcggcagttggcaacagttgcacgtctttggcttttagccagccagctttggtttttaaatagagccggctattttcgtagcgtgcggccaggacccgtgcgcgggtattgtccgcaacgtggccagtaacgttttgctggtgcaacgggtcggcataaaccggcgcacgaaaaccgcggctggtgacgacgattttttggtggagaaacaggctggcccagccggcttgaggggcgaggttgatcgttgtagccggcacgaaggcattgtcgccgatttgataataggtgctgccagcaacagtgaccatcgcagaaatcgcaatcggtgtttgcggtgctaactgttcaggacgtaagagcggctgataagggttttcgtaaaccggaagcgccgaggtactggagttagcaccaaggtcattgatactggtagtgacggctgcagctttcagcgcctgaaattcatgcccgagactcgtgtagttggtcacgacaccgtcaatgttgaggttaaccagccatgtccaccgatcccgatcctcgttcatctcatcccagacatacacttttttgccaaggtcatgcagctgattgaccagctgcggcgtgaccaaatccgagcttaagttaatcccgtccacataggtcaacacatcaaaattgatccgtttaagagaaccgacaattaaaatccgcggcacagacggtaaatccgcctgcaagcgcttaagactggcagctgaaaacgaatggaacatgacgcggttttccatgtggtactgtttaatcaaagccgtaattttgtcttcaaggtggggatgcggttcgcctttaacgattttggtttcaatcaagaatttgtggtttgtctgttgctcgtgagcgaaaagctcctcgaggctgtgaaccggttcgccatttttggtatgatattgctgaagttgtgcaaaagtgctcttggcaatggtcagattggcgccggtcatccgctgaatggttgaatcatgttgaatcacgaccacgccatcagcactttcatgaacgtcaagctcgacgtaatctgcaccattgttaaaagcactatcgaaactttgaaaagtttcttccggatagttcagcggatcgccacggtggccaaccagcgtaaaccctgaaagcagaagaaataatggcagcagcaaaactgccacagtgaatcgtttgcccatacaggctgctcctttccagaaaaaaacatcataccataaacaatagcatagtgagcgcgaacaggcgcgttcagaagtcggagtgtaagtggccttgggcgtaatggcgggctttgtcattgcgaccaaggtccttacacgcaggtttctgcgccggggagcgcgttatagaaggaaatgccaaaacacaaaccattcgctgccgacagagcgacagacaccaaccgcgtgacgataaactcaaaccgaaatcagcaaacaaataaggagcgtcaaagatggcagaaaaatatcaggtttttgatttgattcaggaaattacccggctggacgggagtcgctattttgaactggggaacgtcatgctgaatggccgtgccgaaaaggcttctatgaagggctttattaagcgggtgcggattgttcagctgaacattgcccactcaaccgctgtggcaacttatgaaaagtatatcaacgagcattatgaatttccgccggctgatttaaccagttgggaagaatgggacaaaccggaaggcccgattcgcgatgcttaccatgagattctccggcaaaatcatgtcgggtaaaataggacgatgagggtttctgccggctcggcactcgagggatagattttaataaaaacctcaattttttgaataatttccgtgattatcgcataaccgggcttgtcagcgtgacaattttcgcggataggtcggacacgcgctttgcgtcacattgatgctacttatataatgtaaggcatatgaaagcgagggatctgcgtgaagtatttaggtaaatggcttatcccgttcgtcgcggcgatcgcggtttttattggcatgcaatttgatagcggcttctataccaagccggttggtcaggttgaagcggttaaggtggttaaaaccaccacccaccaagacgaagacgaaaatcgtgatcgcatggttaagcagcaggttcagatacgcctactcaacaccgctaaacggggtaaacgcatcaccatgcacaatacctactcgtttagtggtgcattggacaatgaacttcgcgtgggtgagcaggttttcctggatgttgacaagggtgcctataccttgaacaacgtgaaacgggatgcgattctggcggcgttgttagtcttgacttttggtttgatctttttggtcatgggccggcgagcgtggttaacgagcattagcattttactcaacacgttaatcttctttatcgcagttgagtgggagatcggcagtaagcagtggcaggcgtggtggttatttgtcattttggcggtgattttcacggtgctgacagcagtgtttattgttggaattaagccgattgccgcaacaatttcgttgggtgccttgttggctaccacagtcgcagtggcgctcggctatggcattatggccttgaccaattacagcggcatccactttgaagaggtcaaatacgccactcaaacgccgcaactcttattctttggtcaaattgtgattggttctttgggcgctgtgctagacgaggcgagtgacatttcggttgcgatctttcagcttcatgacacggccaaggagcggtttcgggcagggatggctattggccgcaatgttatgggaccgctgatttcggttctgtttatgattttcatcgccgatacgtttatggaatcggttttgtggattcgcaacaataactcgattgcgcaaacggttatctgggtgatggggctgggatttgcccagagcctcatcagtgcgtttggcattgtactggcggtgccggtgacgagcggaatagcggcgatgatggctaaaattaagaaggtgacagcatgaacgccattcttgcattagccttggttctgcttgtcatgatgtttattgtcggcggcaagcaaggcctgtcaaatttctttgctttagccgtcaacgctttgttgatgatcctggtcgtcattttaatggccagcgggtttaatccgattattgtagccattatttttgggctgattattttggccagcacgattttcctcagcaccagccagctttccgtagccggaccggcgtttgtctcgtctttgttaatcatgacgttattggtcggactgattcttttgacgatgacgttaagccagacagccggatttggaccggaagattccgaggcactggaaggcttttccgtgtacatcggcgtcagtttcccgcacattttgattgccaccaccttgctgggtacgcttggggcaattgctgaagcagcgattgccgttgcagccggaatggatgagattaaggatcaggcaagtgccaccgggattaaacaaatggggcacgagattatcggaactgctttaaatacgctattctttggcttctttggcggtttttcttctttgtttatctggtttgcctcactgcgctatccattttcacaggtaattaataacaagatttttgttggcgaactcttgcaggtcttgatttcggtgattgccgtcattttgaccgtgccgatgacgacttgggtggtcacgaccagacatgcacatcgccgaaaggagcagtagcatgcaatattttattgcagatacgcattttttccacgcggatcttttaggaaacaacgattttgctccgcgcctgtttccaaccgttgaggcaatggacgcggcgatgattcaggcatggaatgcgcgcgttgatgatcgcgatatcgtttatcatttaggtgacattgccatgaatccggagcattttccccaaccaccggaagtgttggcgatcctattgcagctgcacggccggattgtttttataaaaggaaatcacgactacgaatcactgtttaaatttcttcatcgccatgacccgggcgtgaacggcttgcctaagttcaccttccattcggttggcacgattatcaaggatgaccatacgcagtttatcatgacgcattatccgttgatgatgggtattgtgaagcagacgctgaatttacacggccacattcaccataatagcgtcaacattgcggagaatatcaatgtaggggtagacgctccggaacgggatttgttagtgccacatctgccttttggaaccccactgacggcggctgaagtgcacaagatttaccggttgaaggctgcagcgttagctaaggaacgctgagcacaatgtgatgtttgacccgttgtcttgcagggcataggatgaaactagggtattagtttagaaatgtcacctgaaagaccgattagggaggtgccttgtggaaaagttagtgattctgcacacgaatgatctgcattctcactttgaaaactggccaaaaattcgccggtttatgttgggaactcgcgctgcagaacaggcagaaggggcgagcgttttagcttttgacgatggcgatgcgatggatcgttcggtaccgttaaccgaagcgacggacgggcagattaatattcaactgttgaatgaaatcggctatgatgcggtgaccattggcaacaatgaaggtgtcggcaatccgcaccaggtgttggagcatttgtacgatcatgctaattttcccgtggctttggctaacttgtttgagccggatggcacgcgtccgcattgggccaagcccatcgtcatgaagcagacctcggcagggacgcgaattgccattgtcggctttacggcaccgttttttctgacgtatcagccaaatggatggcaggttaagacagtagcagacgttttcccggcaattcttaagaagcttgagggcacctatgatgttttgattgtgctatcacatttaggcattgaggctgatcgtcatttagcccagcaatatccgcagattgatgttgtgattggcgggcatacgcatcacttgcttgcagaaggcgaattacatggcacgaccttattaaccgccgccgaaaagtatggccattatgttgggaagattacgctaacgctggatgatgaccacaaagttcagacgcgtcgtgccgaaacctttcaaactgctttgttgcaaggagcagcagcagatccgcgagaaattcaaggctatgaaagtaaaggcattgccttgttaaagcagcaaaaagttgctcgcttgcctaaacacctagcgattcagtatgatcggccatcaccgttacttgattttggcttggcggcagtcgctgatgctgctaaaaccgatgcggcgatcctgaatgctggtcttttcttgacaccacttggccccggcgttgtcacgcaggctgatcttctgacatgtttgccccatcccatgcatctgttgaaagtaactttaagtggcaaggaactctggcgtctgatcatggaaatggaaaagaaccgcatgtttctccgccacttccacatgatcggcatgagttttcgcggcaaaatttttggggacatcggttatcgtggcatttccgttaatcgtgaaaagcgaacggttttgtggcatggccagccgctggttccggaacggcaatatacgttcgcaaccgtcgacaactttctgttcattccgttcttcccaaccatcgaaattatgggcagcaatgaattcctttttccaaaactgatacggcaggttgtcggcgattatatggcaaaggtttttcctttataaattcatgctatacttttacaattacgagtcgaatgatttttttaaaaggagggcgcgacttgggtgaacgagaagcattatccgaacaaattgatgtcgccttgactccggacataaccaaagagatgcgggttgtcaaagtcgaccatgatctgataacgattgatggccgccgctatcgcattgtcaaagaccaccgtgatgcttttgaccttgaacggttaaatgaacgatacaacgatattctcgacaagtatgattttattgttggcgactggggttacgatcagttacggttgcgcggtttttacaaagacgatcgccgcggtgcgagtaaggatcagcagatcagcacattagaagactatctctatgaatattgtaattttggctgtgcttattttgtgctggcccgtttggataaaccggcaactaagttagttgatcggcggcacgatcgggagcggaaatcggcgacaggcaaaaccgcgcaccggcaacaatccaagacgacgcagcggcaacatcatggcaaacgtaagccttatgccaaggcaaacaagccatatacggaaaaaacgacccgatcgccgcattttcatggcgaacaggccaaaacagtcaatcaaacacaaccacgcaagcggcattttacgatccgtcaacgtgagactaacaagaagtagggacagacttgaagtataaaggttatatgatcgatcttgacgggacgatttatcgtggcaaagaacgcattccggcagctaaggattttgtcgaacggttacaggcggcgcaattaccgtttttatttttgacgaacaatacgacgaaaagtcctgaagatgtggtgaaaaatctggcggagaatcacgatattcatgtgtcaccggcgcagatttacacgccttcacttgcgaccgcggcttatttgaccgatctcaatcatggcgacgtttccggaaagtcggtatatatcatcggtgagctggggctgaagcaggcacttttggatacgggattgcggttgaatgaagtggatccggattatgtggtagtcgggctggattatgacgtgacgtaccataaatttgagttggccacattggcaattaaacgcggcgccaaatttatcggaaccaatgcggataccaatttgcccaatgagcgtggcttggtaccgggagcagggtcattgattgctttagtggagcgcagtacgcagcaacgggcattttatattggcaaacccgaaccgacgattatggaaaaagcgctgaagaagatgggactgccaaaagatgcagtggccatggttggcgataattacaacaccgacattaaggcaggcttgaatgccgggatcgatacgattttagtgtataccggcgtttctacccgggattatgtttccaagcaggtccaccaaccaacgcatcagattgatgccttgacggactgggaggtctagatgaaacgcatcgttcattggctgacgctttggctagcgattgtcagtggcgtcattttcgtgacgattttcagcacgctgctgacgttcccgatttatgcacatatggataatctgccacaaattgctgccatgtcgctgggacggttgtatcataattacttgcagctcatggcatacttagacttgccatggattggtacgctgcatatgcaggatttccccacaagcctgcatggtgcgcttcattttgccgacgtgcgccatttgtttattttggatattgtgattgccattgtgacgataccgtttgccattcggtgggtgcatcagcttaaagcagccaggaagcgatatttgctggtccggccgtttatgatcggggcggtggtgccgatcatcttaaccggattgctaagcattaactttgatcggttcttcatcattttccacgaggttctgtttcgcaatcgtgactggctgtttgacccagccactgatccgatcatcaatgtcttacctgaaggcttcttcatgctttgctttctcacagcatttgccttattcgaggctatcatgatatggggtatctggcgcggtcgccaagatgcccggcgtcagtcaccattttaaaaataaaaaacgcatgttcccaatatcgttgtgacgttggggacatgcgtttttgcatacatggaaaatgcgatggatagattaacgatccacgactttagccgtgcgagttttaacggcagcaatgaccattggcaagagtgaaatcaaaacgatgccaagcgctactaacgaaaaatgctctttgacgaacgttacgttgccgaagtagaagccaccgagtacacacaaggtaacccagaggaagccgcctaataagttgtagtggatgaacttgccataatgcatacgcgagccacctgacacgaacggtgcaaatgtccgaatgagtggcatgaatcgggcaatcgcaatggttttgccaccatgcttgtcaaaaaaagcttcggcttgcagcagcttgtcgcggttgatcaggcggccaaaccagcctttaccggtagaagcggcagaccccacgcgtttaccgatttcataattcacggtatcgcctaaaaccgcagcagccaaaaagactgcgaaaaggatccaaacgtttaagttataagcagcgttggcggccaaagcactggcagcgaatagcagtgaatctcccggtaggaacggaaagacaacaacccctgtttcgatgaagaccatcgcaaagaggatgacataggtccaaggaccgaagctattaacgatggtgatcagatgctcatcgatatgcaggatgaaatcaaacagttgggtcattgggtaagctcctttaatgaatttacatttcattatacgggataatatgaaaatttcatgaaacaaaggcaaattttagaaaacgtcaataaatgtcgtcttcgatttccggatgcgaatgggccagtcgactagccgccgctgccgccatggctcccacgatgtcatcaaggaaggtgtggataatcccgggctcgtgggcattgagcttagctagaatacctggcttaatccgatcaatgtagccataattggtaaagccaattgaaccataaacattgacaatagaaaaggccaagacttcatcgacaccgtaaagcccttcatcttcggcgataattttctgcaaaggctcctcaagctgattggcttcggctgccttatccagtgcaatgccggtcataaccgcgttttgcacttcgcgtttgcgtaaaacgatccgaacattttgcgttgcttcttcaatggttaagttaggaatgaaacgttcctgcagaaacatgacaagctcgccaatatcgctcaagctgacgccacgttcatgcaacagttggatcgtccgttcataaagcttctcttcattggtcataatctcacgctttccttttggctgagtgggtaaggctgacttttatcgataaagctgggtactgtgcaacgcttgccgccgttccggataaagtcggctaagtgcttcgttaatggccgttggtgcttcaccgaagccactggcaatcagcggtagttttcccgcgtaactgacggcatcgccaatagcaaaaatgcccgagcgactggtttgcatctgtgaatcaaccagaatgccgttacgatcggtcttaaagtgccaagcctggagatggcgcttgtcggtgacaaaaccataattaaccagcaacttatcgactgttaaaaccggctcgttgtcaccgcgaacttcctttaactgcaaagcgagcttgccattttcctgtttaaccgcctcaatcaaataaggtgtatgaatggcaacgctgcttttttccagtgctgccacacttgcctcgaggccacggaatttagcgcgccggtgaatcagactgacatgcttggccaccggttccagcgccaaagcccagtcaatggccgaatcaccaccgccggcaatcgccacgtcctgattgcggaaggtttccagatcctgaacaaagtaaaacaattgcctgccttctaatgccggatcgtaatcaacggctaatttgcgtggcgtaaaggccccgccacctgttgcaacaatgacggctttactccggaagtccccttgacttgtatgcagaataaacgtcccgtcttctgcttcatcaatcgtttgcacttccgtagcggttttaacatccgggtgaaaatgcataagctgcgtcttcaactgtgaaaccagatcttttccgctaacatgggggaagccgccaatatcgtaaagaattttggctgggtataaattaccggtttggccaccaagctcgtccagactctccagcaataagacgtctgcctgacgcaagccagcataaaaggcggcgaacataccaacaggcccgccaccaatcacggtgatttcatatacatgttgcactgacatttgcaatgctccgtttctatatagtatgacgttcataccctaccatattttacgaatagttaccaagttgacgaaggcggagagtgccggcaatttagggagattaaagtgccataaagcgcgggcgttgcgataattggggaaaaagtgtaaaaagcgcagcaactgatttttaatgtcaacgttaagtctgtagaagggttccatctattcatttgattggcgcgagttgccgatgctggtatactacgcctagaacgatgcacgttatttgactaaagaaggagaacgaacatggactatccacaattagaactggccgatttcaaaggcccaaaagcgatctttaaaaccagtgaagggcaatttgaaattgcactatttccggaacaagcccctaaaaccgttgaaaacttcatcggcttggtcaaaaagaactattatgatggcgtcatttttcaccgggtcattgaagacttcatgattcaaggcggtgatccgactggcactggcatgggtggtgaaagcctctggggaaagccgtttgcggatgaattttcgaatcagcttttcaatctgaaaggtgcgttgtcaatggccaacgctggacccaatacgaacggcagtcaatttttcatcgtgaccaattcgcatttggacccaagcatgaaggctcaattaagcgaggcaggcttcccggaaccgatcattgacgcttaccaacaaggcgggacaccatggcttgatcatcgccatacagttttcgggcaggtattgtctggaatgtcagtggttgagaagatcagtaaagtcaaaacgggtgccaatgataagccagttgaacccgtgacgattgatgaattgacgattcaagactgatattggttgcaagtgatttttagggtatactcaaagagaaatccaatgaaatgaagtgtcagaatggaatatcgcataggagatatcttgactggcaaagtcaccggcgtccaaccatacggggcgtttgtgatgctggatgagcacacgcaaggattagtgcacatctcagaatgccagcatggttacgtcaaggacaccagcgatatttttaccgtcggccagcgagttgaagttgtgattttggacatcgacgaatatacccataaaatcagtttatccttacgtgctttacaggcgccgcctagattaagcaagaaacgccgccgcaagcactattggaccagtcgtaaatttcacaccggctttgcgccgattgccgctcacttagatgggtgggtcgctgaagcacttgaacatttaaacgaagaaaccactcaaaaatgagtggcttttttctttcgttgatgcgataggcaactgtcaaagcatgagggcatggcaaggaagaacggacctttttgggagggtacggggccttgcgtggctggtttgcggaaactagtagactttcattgagaagtaacgatgcaataatgatcggtggctgatttgtaaagctgatataaacgcgggcactgcacactattgggatgactgggtatcaacgattagaatcggttagctaagaaaagcgattttcaagatttgaagtttagctgaaatggcgtttattattttagatgattggcaaatacatgtgagcgaagtgcgtccagtgaccgttttgctcagtagttagggcaaactgcagcatacacggctataagcgctatgagtttagtgaactttaaacgcgtttttctgaatattgttcgcgatcaatgcgaatatttatacaatttggattaaaatgttcgctatttatcggaactgacaattctttgaaattctgcaatttttttgttgactagattgttgaagtgctggtatgatacttgttgttgtcaaaacaaagacgtcgattcatgacggatgaaataaaccactcgtatgatgaagccacaattgaaacagattgaataaatattcactctaaaaagttgttgacatgatacgttggtcatgataatctatcaaagttgtcttttggcaagatcgtcctttgaaaactgaacaaagtttcgtttaaatgtgcagggtccttgatacttcggtatcgaggcaaaaagtaacatttgcgaagtc

SEQ ID NO: 303 - DNA, 15405 bp, Lactobacillus casei
gccctgtatcctccattgagccgttagctcagttggtagagcaactgacttttaatcagtgggtcgacagttcgagcctgtcacggctcagagaattattggttttaaatggcggctcaagtcgatatttttgccgacttagctcagttggtagagcatctgtcttgtaaacagggggtcgaaggttcgaatcctttagtcggcatggcaccaataatttgataagctttttgtttcatgcggaagtagttcagtggtagaacatcaccttgccatggtgggggtcgcgggttcgaatcccgtcttccgctttccaaacgcagtgccgagggtgcgtttggtcgaaagattcctcggtattatcatgatttgcacccatagcgcaattggatagagtgtctgactacgaatcagaaggttgtaggttcgactcctactgggtgcatttgacgggaaatagctcagcttggtagagcacctggtttgggaccagggggtcgcaggttcgaatcctgttttcccgattggacgctagtccatatggttttttcgcggtgtagctcagctggctagagcgtccggttcatacccgggaggtcgagggttcgatcccccccgccgcgattgagcttggacctttagctcagttggttagagcagacggctcataaccgtccggtcgtaggttcgagccctacaaggtccatctttacagggtggtcactgttcggtataatcgatttgttactgttatcgcgggatggagcagttcggtagctcgtcgggctcataacccgaaggtcgcaggttcaaatcctgctcccgcaattatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccattttcataatcacccttatgcgggtgtagtttagtggtaaaaccacagccttccaagctgttgtcgcgagttcgattctcgtcacccgctgcgattatgatatgggcctatagctcagttggttagagcgcacgcttgataagcgtgaggtcggtggttcaagtccacctaggcccattgttccattaattttatattgcacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatggttagatggagaattacccaagtctggctgaagggaacggtcttgaaaaccgtcaggtgggcgtaagtccacgcgagggttcgaatccctcattctcctttattattatcgcgggatggagcagttcggtagctcgtcgggctcataacccgaaggtcgcaggttcaaatcctgctcccgcaattacatggttccatggtctagttggttaggacgcctgcctgtcacgcaggagatcacgggttcgagtcccgttggaaccgtccccctctaattgaggggaacatcaacttcataaaaacgatctaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccatttatagggatatagtttaatggtagaactacggtctccaaaaccgtcagtgtgggttcaactcctactatccctgcttatcatggcggtattggtgaagcggttaacacaccggtttgtggcaccggcatacgtgggttcgatccccacataccgcccttttactggggtatagccaagcggtaaggcaacggactttgactccgtcatgcgctggttcgaatccagctaccccaattttctccaactgccataggagaaacgcgcttaacttgatgaatatggcggtgtagccaagcggtaaggcatgggtctgcaaaaccttgatcgtcggttcgattccgatcaccgccttatcttgcggttaacgcccagcaagagagtgccattttacattatgccggtgtggcggaattggcagacgcgcgggattcaaaatcccgttccagcaatggagtatcggttcgaccccgatcaccggtagacttgccccgttttggggctttttttgtaccttgaaatggctttaaaccgggatttttgattttctgggggtaagtaaaagcttttaaaaattttcccgttaccgaccactacgaccatttttgctttttgagcgttattcgttaaaagtggtcggtagatagtcatagaactttgacggtttttgtatcttgaaatggtggcagggttccaataaaaaacgatcggcatttgacagaaaagacaaacggccgatcatttttcatttatgagccgttttcggtcctgctggtcgctggctgacttttggctgcgcagcacagcttttttgacaggttcctgacgtggcctgaatggcacttttcactgtgcataggacttgtcttcatttgccgatatattgggcctaaaaggggcttactgtccatttgccataaatttaagaatgacaatccctaaaccaatgatgataagcagtattgcaatgagattaacgccgcggttgacgcttcgatagtgagtgaaaaacccataatcaatgcgtgtgtttacggctgcgatcaacatgcctaagacaaatagcgcaccaccaatgagaataacaatgtccattttgatttcctccatttctgcgtggaaattgactgctgaatgatttggttctttttaaagagccggacaggcagtcataaaaatgctcattcagcattgctgtgaacgcctaagtgctatcttaggcgttttcaatgccatttaattagaccaagtaacggggagacagacactttttatggatcgatggttatgtgctcatgttggtgttcttttgtgcattgagtgcttgtgaaacgtgcagtctttaatcgcacatgtcgaggcctgttactgtttcctcaccgtggcttggcacctttgattgatcatatcaataatggcgccaaaaatcgactcttcggaatcgaactttttgtgtatccagtgatttggcagggattgaaggcacttagttgcgatcgggctgattccaatcttgaataaataaggtttttaaagatggtgtgttttacaaggatttaacaataagtttagctgaatcgtcgtgtaatgatccactatggcaaaatttttacggttgctgcctaaagtccttgagctggtagcttctttgacggagtgagattattgcttcttttgacacttcgaaaacttgcatgtagaaacagcaaactaagctgaatgtcggctcataatccagttttctagcgaaacaaattcatgccacgcaaaaactgccttaccatgtccgtcgtgaacggtcacgataaggcagcatcttagtgatctcgggaagttttggagttcttgttactcgtcttcccgcgagaacttcagaatcttcgcgcgagcgcgttccaacgcgcgtcgatgccgatcaagcatgggctttttggacggatatagaatggccgcctcaaatgcctcatattccaagggtgacaaactttccagaaactgtaagaattcgacgcgcattagcagtccgtcttcaactgagcgaattgccagtcgatcatgcaaggactcgagtgacgtgtcattgaccggaatagcgttggcgtcaatgcggcgtttatgggcaaagtgtttgcgcaacaccgagcgcaggtgggattttaaaaccatccgatagtaggggccaaactgtgagccgctgctgccgtcatagcgaacaacggctttaagcatcgcaatccgggcctcctgcatccagtcgtcgtatgaaaagtctctgagatggtaaggttttaaaaccgtcaacaccaatggccgatactgagcgaacaatttgccaaatgctgccgaatcgtttacagcttcacgtatgagttctatttctacttgtttcatatcgcctcctccctccgattaactagcagtattaccctgtaatgacaagattattctacaataaagcgtttgcaattgaatagcgaacaattgttcagttataccatttaatcacttgtatgctcgcgaaaaggagaacagatagcacttttgaaaatgcaaaattaataacattattttcttattttttcgcgaaaaaatgagagcgcgcgtatttaatgccgaagtgacagcttttttaaatgagatcccgcaactgaagcttcaactaaatcccacattaacgattgccaaaataaaatcggtatgtgaggacagatcgtttctatttttcgtttcaggtgacaaggatgattgatttctgcaaagaccccaaaaaatctcaggcacgcgccaccagtcccatgactttgtttgtggcgccatcctacgagtcaggttattttacatatggagaaatctgcgttaaattataaaagtcattttataaggagggttcatattatcgcttctaaaggaaaaaataataaaattggtctatttcaattagtcatgctggcgcttggttcgttgatcggttccggctggctttttggatcatgggaagcagccgcagttgccggaccagctgcgattttttcctggatcattggtggcgtcatcattggggtcatcgcttataactatgtcgaactggggaccatgtttcctgagtctggcgggatgagcaaatttgcccagtattcacatggttcgctggtcggtttcatcgcatcatgggccaactggatttcgttggtcaccttgctgccgatcgaagctgtggcggccgtgcagtatatggcgtcgtggccgtggcaatgggcaggctttactcgcggctttttaaaggcaggcaagataacgccggagggcttgctagtcgtctttgcgtttattattattttcacattgcttaattactggtcagtcacgctgttgacgcggtttaccagcttcatttcgatttttaaaatcggggtgccactgctgacgattattttgctggcaatgtcgagcttccatcccgaaaattatggacactcgtttgccaccttgatgccatatgggagcgcaccgatttttgcggcaacatcggtatcaggaattattttctcgtttaatgcgttccagaccgtgatcaatatgggcagcgatgttaaacgcccgcagaaaaacatcggacgcggcatcggcatctcgctgttaatcagcggggtgatctatattttgctgcaaagtgtcttcattacgacgatctcgccgaacatgttggcaacgcacgggtggaaaggattgaatctcaattcaccatttgctgatctggccattttattaggaattcactggttatccgttttactttatatggatgcctttgtgtcgccatttggtacaggcgtctcgtttgtcgcttcatcagggcgcgcacttcaggccatggtcgggaacaaccatattcctaaattcatcggtaaaattgacgaaaaatacggaacgccgcgagtcgcaatggtagtcaatgcagtcttgagtatggtcatggtctcgattttcccgtcttggggaacactggcaagcgtcatttcgacggccacgctgatcgcttatctgactggtccggttacggttatctcattacgcgacatggcacctgactttaagcgaccggttaagtcagccagattgcgtttcatggcacccttggcgtttgtgttaacttcactggcagcatattgggcgaagtggccaacgacagtggaagtcatcggcgtcatcttcttaggcattccactgtatttattttatgaatggcgttcgggctggcgttcgacatggcaacagctgaaagcgtccgcgtggatgatcggctacctgatcttcctgtcggtcatttccttaattggcagtcgtgagtttaatggtttaaactggattcactatcccatggactttgtggtgattgtgataggtgcgattgttttctacttctggggaatcaacagccacattttttccaagtatttccgcagagcacggcgggtcaatgccaaagttaaaatgccgccatctgatgacagcacccatgccgagcagacggctaaaagatgattgctttattggctattattaaaaatgttatggatagcgaatggagaagatagtttataaaaggcttggcttcaacaatgcttacaaaacgactgggaaaaaacttacgacttttgcctgatgaggttaatttgacggcaaggtaagataattctaaaggtttgtgagaaaattgcatttagctaagcctatctttatacttatactaaacaaatgacgtctggaggggatcaggtgaatatcgggatttttacagatagctactttccgcaagttagcggggtcgcgacgtccatcaagaccttaaaggacgatctggaacgcaaaggtcatcaggtttacatttttacgaccaccgatccacatgtgccggatgatgctgttgagcccaacttattccgttttacgagtgtgccattcgtgtcctttaccgatcggcgaattgcggtgcgcggattgttccatgcttatgccgtggctaaggaactgaacctggatattgtccacacacaaaccgagttttcaatgggttacatcggcaagtttgtggcgaagcaattaaagattccgaccatccatacttatcacacgatgtatgaagattacctgcactatgttttaaatggtcatctgctaaagccttatcatgtgaagcaatttacgcgtgcctttctttatcatgtcagtggcgtgattgcgccgtctgaacgggtttacgatacgttacggcgctatggtgtcaaaacgcagattaagatcattccgacgggggttgacctaacccaatttgccgaacaaaaagatccgcatcttcgcgaaaagctgggccttgctgacgtcccggtactgatctcgcttagtcgggttgcttatgagaagcggatcgacaaggtgatcagtgcgatgccggccattttggcgcagattcctaacgccgtgcttttaattgttggcgacggtccggcgcgagaagatttggagacacaagcagctgagttaggaattgcggatcatgtgcggtttaccggtgaaatcaatcatgatgacgtaggtgattattaccgcgtcggcgatgttttcgtgtcggcaagcgattcggagtcccaagggttaacctacattgaagccatggcggcagatcgaaaagtggtggctttggcaggcgattacaccgatcatttactcgatgacccggcgcttggcacaacgttttcaacggaagcagagatggtccatcaagttgttaattatctgcggcatcccaacgcttatgacgatcctaaaccaagggcggaaaagttggccgctatttctgcggatcgtttcggggatcgcgtgcttgatttctatcgtgatgttatcagtcattattcgcctaatgaagctgatgaatctgcgccatggaccgatgaaagtacgagtaaacggaccatgaaaggctaactatgatcgttattaacatgttttcgtccgctaataaagtggcggggcaaggcgtgggagcagtctacacagaattaatggggctgctcaagcatgactttgccaatgagtttcaaatcaatgtgaatcgttatacgcgcagtgacattagtcattatcatacaattgatcctaagttttacgcctcaaccttttccaaaaagcgaggtcgaaaaatcggatttgttcattttgttcccagcacgttggatgccagcttaaagttgccgcgagttgcgcggtggacgcttgataaatatacgcttgccttttataagcggatggatgaattagtcgtagtcaatcccaatttcattccgaaattggaagcttatgggatcagtcccgaaaaagtgacgtatattccgaattttgtttcgcagcggacgtttcatccggtgtcagccgagaaacggcaggcattgcggcatgcaaatgggtttaagcccgatgactttgtgatttttggtgccggtcaggtgcaagatcggaaaggcgtcggtgattttatcaaattggcccaaaagaatcctgactttcggtttgtatgggctggcggattttcatttggccggatcactgaaggctatgaacggcttaagcaggcagtagccaatgcgccggcaaacctggactttaccggcattatgccgcgggaaaccatgattgattactataacatggcggacctgtttcttttgccgtcttttgaagagctgtttccgatgtcggtggttgaagcttttgcaaccggtacgccggttatggtacgtgatcttgagctttaccagcagatcatcaccccttatgccattaccgcggctgatgtcgatgatatgcaggcgcggattcgggccttggcggatgaccgggagttgttggcaacttatgcgactaaaagtcatcaggcagcgcaggtttatgcggaaagccgccttgaaaagatctggcacgatttctacgtaaagcaagccgcgttagggaagcaatagccgaggagttatatgacacggaagaacaaactggccgtcctaatcatggttctgattggcgccggcatttttatttacgaagcgcgtgatttgaatggcgccaagctggtgcacgagttattatcacttgatctcaagtggttgctggtggcctttttgctcatgttcggctcatggattgtcgaaacgtttgtcgtccagatttttatcaagaacgggacggatacactggattttaagacggcgctgcgggttccacttgtcgaacagctatttaacgcgattacgccaatggcttctggcggtcagccggctcagttatttgcgctgatgcaaagtggcgttgaggccggtcgtgcgagttcggtgctcttgatgaagtttgtcgtgtatcaatttatggtcctgatcaatttcatcttaacgttggtcatcggttttgatcaggtttccagacatttcggcgcgctggctttatttattgtgttcggctttgtcattcatgtcatcgtgattgtcggtttgttgatggtgatgtactattacaaatttaccaagcggctggtcagactcatcatggtgccggttggctggtttgtgaagccggaaagaaaactggcgatgcagaccgatcttgatcataaaatcgatacgttttatgcggaaagtctgcatttaaagcgggaaaaagtacgcgtgatcaaggcttgtttactgacgctggtgcagctgttgctttattatgcggtgccgtattttgttcttctggcactcggggttaatcacgtcagcattgttgaggtgattgttctgcacgtcatgatcgttatgatcgtcagcctgttcccgattcctggcggtgctggcggtgcggaatacagctttaagacgctgtttgcgacgtatgttgcctcgccgtccaagttggtgttagggatgttattgtggcgttttttaacttattatctcggcatgatttgcggcatcattgcgatggccttaccacccaaaaagtcggataaggtttcctgaacatcaggtgttgcgctgcggtttgcgcccagcgactcagacaaatcaaaagtgacgttagagacatgaatcaagattgcctctaacgtcacttttttaggtgctgtgctcagtcagtacatttttggcagcaatcaggcagtgcgactggcgatgaaagcgcgcagccgtttgaccgcttctttaaggtcgtccattgaggcggcataactgatccggatgtagccttcaccaccagggccgaatgcagttcctgaaatcagggccagcttctgttcattggctagcgcttgggtaaattcacgcgaatgcatatgaagccgttcgggaattttggcaaaaaggtaaaaagcaccatcagggcgggccacttcaaagcccatttgaataagggcagcataaacaaaatcgcgccgtttgatataggctgccttcatgacctgggcatcgtcggcaccattcgttaaggcttcgatgccggcacgttgcgcaatggtagttgcagcagtaacgagatactggtgcacctttttggcttcagcgattaagtgacgcggacccatcaggaaaccgatgcgccagccggtcatggcgtgggatttagataagccgttgacgacgaatgtccgatcgtaagcgtaacgccccattgaaatatgggtagcgtcataagttaactcagaataaatttcgtcacaaataatataaaggtcgtgtgcttcggcaatcgaggcgatggccttaacttcggcggcgtggtaggtcacgcccgtgggattgctagggtaattcaggatgatacccttaattttggcatcagggttggcagcaatggtggcctcgatgagttccggtgtcaatacaaaatcggttttgctggtgtcgatataaatcggcgttacatgattcaaggttaaaagcgggatgtagccggggtagatgggggaaggcaccaggatcgcatcaccaggatcgctaatcgtggtaatcgctgttgctaaggcttcagtcgcgcccacggtcaccaggatttcatccgcggcatcataatccgttccatacttagttttgaagaaatgctgggccgctgcccgtaattcagggtcaccaaccatgccggtgtaatgggaatagttttcctgaatggctttgatacccgcctgtttaacgtgttctggtgtgttaaaatcaggctcacccaaggtcaatttcaaaatgccgggaattttactgacgctttcgtcaaattgccggatttcactgacctcaatcgccggtaattgttcatttagtggttgcaatatcatacgcgcgctccttatatgtaggttgcaaatagcatagtccatttacccgtcgtcgcgcaacgttatcaaagcggataaaactgcaatttgaagtgatatttctcccacagaggcggcggtttatgctaagctatttcttgaaataggaaaattaggaggccattttatgaaacaatcacagctcgtggccatcatcaaacgcctcgaagccatgcagacaggcgacggcgagacacagtcacgccgcttcgaaaaaaatggtgatgaaaagggcctcgtgacatacgatcccaagaccgaaacttatgaactcgaagaactaggaacgcaccagactttccagtttgacaacatcgatcttgcggccatggaaatctatgatctgatggattttgatgaagacgaggacactaacgatactaacgacagcgaccaggcataagtctgagtgctgaacgaggcggacttgaaagggttggcctcttttttatgtgagcgtgagcaggagcgcttagaaatcggagtgtaagtggcctcaagcctaaatggctgggttttgccatttaggcttgaggtccttacacgtagatttctgcgactgcgaacgcgttatagaaagcgaaaatcaattagctttttgcctctaatagaacaatccccagtaagaaatcatcggccattgcgccaagacccttacaatgcagacttctgcgccagcaaacgcgttacagaaagcaaagttttgcatgcacacgcgccgtaaataatacaacacctgttctgcagcatatccggacgtcccattttaaggcttctttaagattgcccataattaagctttaatcaacggtgaacatttgtcttttgagaaacaagcggttatcctagcgaatgtgctatacttttgacattaaacaatgacttggaggctccaaatgaaccagatcggcactaaacttcgaggttttttcaatacaagactcggctttttggcccttgccattgtcttattctgggcaaagacgtactgggcatatcaagccaaatttaacttgggagtcaccggcagctttcaacatctgattttggcgattaatcccatcccgacaacgctttttctttttggcattgctttatatatgtccggacgaaaatcgtatgtcacgatgctggtgattgattcattgacgtctgtttggctttttgccaatgtgctttattatcgggaattctcagacttcttgacgtttgcgttgatcaaaggatcgggagcagtttccaataacttaaacaaagggatcatggggattgttcaaccaacggatttcctggtttttgttgacgttgtggttttgattttgttgctggcgtttaaagtgattcgcatggatattcgcccgatcaaaaaacggtttgctctcggtgtttcgttgctggcggtattgatgtttggcgccaacttggcgatggcctacagcgatcgttccggtttgctgacccggacatttgataacaactatatcgtcaagtatctcggtttaaacgcctacacagttgttgacggcgttaagacagcaaaaaacagtgccaccaaagctaatgccgattccagcgatgttaagtcagtgttgaactacttaaacaaaaatcgtgttgcccccaatgcggaatacacaggtgtggcaaaaggcaaaaatgtttttatcatccatctggagagcttgcagcagttcatgatcgacttcaaatgggatggccaagaagtcacgccaaacttgaataagctgtatcacgaatctgatactttatcgtttgataacttctttaatcaagttggccaaggtaaaaccgcggatgccgaaatgatgatggagaactcattatttggcttacctgaaggcgcagctatggtgacagatggcacgaccaacacgttccaggcagctccggctattttggatcagcatggctacacgaccgcttcattccacggggatgtaccaagcttttggaatcgcgataatacgtataagtcttgggggtatgattacttcttctcgaagaattacttctcaagcggtaagaattatgacgtgggctatggtctgaaagacaagatcttccttaaagattcggctcaatacattgaacagctacctcagccgttttatgccaaaatgatcacggttaccaaccattatccgtatactctagataaggccaaccaaacgatcagtaaaaccgatacaggcgatgacacggtagacgggtatgtgcagacagcgcgctatcttgacgaagccatgggtgaatttttcaattggttaaaagaaaccggattgtatgataagtcaatgattgtgttatacggcgaccactatgggatttccaacaaccataaaaaggcgatggctaagttaaccaacatctccggctttaatgactataacaacgccatgtatcaacgagtgccgtttatgatccatatgccaggactcaaaggcggcattaatcacacgtacggtggggaaatcgatgcgttgccgaccattttgaatttacttggtgtcaaggataacaacactgttcaatttggttctgatttgctctcaccaaaccatccacaaacagttgcattcagaaacggggattttgtgacgcctgactttaccaaggtgggaagtcagtactttaacaccagcactggcaagaagatcagcaaactatcagccagtcagaaaaagacagttgatgcggctaccaaccgcgtgacgactgaactttccttgtcagatcgcgtgattaacggcgaccttctccgattctatacgccaagcggctttaaaaaagtcgatcgcagtgacttttcgtataagttaaccgatacgaagaagaagctcaaagctgcccaaaaagacggtacgagtctgaaggcacaaaataagggtaagtctacggtggatgaatacaaaaccgatgcgcccgaacttaaaagcagtagtgatgacgatagcagcgatgactcaaagtagtcacgatgattatggtttagcagtgcccactgaggcgctgcttttttcaattgacagcctgtcttcataggggcgctttgtaatgtgtaaaggtgacaatatgatcaaagcacttggccaaattagatgtatcagggttgtcgctgagggatagtccgttttggtgtacacaaattcatgcgtgagtcttaagtatctagtactgagaaattctaaacttttgtaagtaaaggttgtgctacattagaaaaaggcgtacaagtttactagatgataatgtttataaattaggaggttggcgatgaatcaggcagtttataacaagacaattaacttgctcaaagcaaagcagattcgggtcacaccacagcgtgaagcgatcatttcatacatgatcgacagcactgcacatccgacagccgagatgatttatgcaaagctttcaccgcaatttccgcatatgagtgttgccacggtgtataacaatttgcgtctgttggtggaccttaatctagttgaagaaatgtcttccaatgatgcggcaacacattttgattttccaattgaaccgcactaccatgcgatctgtacaaattgtggtaagatttttgactttacctacccaggagtgacagacgttgaagccgttgctgccaaagaaactggatttaaggtgagcggccatcaccttgaagtctacggtatttgtcctgattgccaggttaaattgggtatgaagccagcaaagcagcatacaaagtgaacaataatttgcatcgaaaaagttaagttatttcagtttatgcggttttcaggcctaacctgattgccgcactttttgattttgcaagaaaagttgtgagtgagtggatacttttcctttgtgacaagcattttacgaccatgaatcatgcagatattttgagaaaaatgcttgcgcgccgacgaggttactggtattatattattgctgtcaaaaaccgaactttctttttagaaagtgatagaaggcgcttcataatcttgttgtgaagctgattaataaaaagtgttgacactcgtttgttggcatgataatctatcaaagttgtcttttgacaagatcgtcctttgaaaactgaacaaagtttcgtttaaatgtgcagggtccttgatactccggtatcgaggcaaaaagtaacatttgcgaagtc

SEQ ID NO: 304 - DNA, 36300 bp, Lactobacillus casei
atcaggtagataggctggaagtggaagtgcagcgatgcatggagcggaccagtactaatcggtcgaggacttaaccaagtaagagcgtgaagcggcgcggttgcgccggtgaacgcgtttcgatgaaatacgccgattctcagcaaagcaaaccagcaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctgtttattccggtttagctcagttggtagagcacctgactgttaatcaggttgtcgtcagttcgagcctgacaaccggagttttttatggagagttgtccgagaggctgaaggagcatggttggaaaccatgtatacgggttttacctgtatcaagggttcgaatcccttactctccgttttgttgtctctacatactttccaaaagaacccgaaatgctgattcgatagcatttcgggttttttttttgccctattttgattgttttaaactttcggtgcacaagctgtgcacaaatcgagatccttcaggtatttgcaacagctagtttactgattattatatcaattttgtgtaaagtggctacgttttaaacgttactttagtccaagatcaatgataacagcctcattatggcatcatggcaattttccgcttagttcaatctacttgcgaactttaacgaacaggacaacgccaattaatgttagaaagctacctaacatggcggcagcgattttcaggcgttcgccagtgtccggcagacgacgctgattttgagaatgattcgtgcctccgggctggttgttagatttggatagcagctcggcacttgaattagaagaatcacttatggatgtagaaggctctgaccatgttgacgggtacttgggtcttgaggtagaagaactgcttacagatgtgggggactctgacgaggtagatggcagcttggaacttgaattagaagaatcactcaccgatgtggaaggttctgacgacgcggacggatccttgggtcttgaaacagaaggattgcttactgatgtggaaggttctgacgaagtggatgggcctttgggtcttgaagcagaggaatcacttactgatgtagaaggctctgacgatgttgacgggcgcttaggtgttgaggtagagggatcacttaccggtgtggaaggttttgatgaggtggatgggagccttgaacctgattcagaaggcttgcttgcagacgcagaaggcatggatgaagtcgagggtttaactggtggcggggtcacggaagcttggtcgtttgcttgaatggtgacttgcgggtgttggatattaattgtaaagggtaacggcgtttggttgcgttcgtagccattaggtgcttttgtctcaacaaagtaatagctgccagccaataattgacgaaccgttagctggccctgggtgtcggttgttaggtttgcgtgaaccaaggtgtgattggcacggtaaagtgcaaaaaccgcgcctgttaacacctttttgggttggtcttgatcacgtttggttagtgtgacttggccaactttaccgttaccgctgccattatctgtccacacgattttgccttttgcgtttgttggcaaaccgctgccttgattctggccttcagcagatacttgatttgtccacgttgtcgtttgggcaaaactggttgggtttggatttgtccataaatcaatcttaatggtttgatcgatattacctagttcaattttaatttggttgccggtgatttgataattcggatttatggtgccgctttggtggaacgctccttgggaatagctgccagtttcaacttggatttttcgagtggcgtcaaaagtttgaccactgccaagggtgtcattgagaactaggtggttaacttggaccatttggggattgacggtaatttcccactgcagaatcttaggtcggccaaggctatcgacatactgagctttttcagctgctgaagcattagcgggtggcaggactgcccatcctgatttagcaatataccagccgacttgatgatgctcatggtcatcatatgtaccttgggcagtaaaggttaaagtaccagttcgccctacagtggaatgactgaagaagtcggtgaacgtcaaaagagctgtttggctgcctgctttagcggaaaatttgccgataacggcgcctgttttgggatctttcactggaaaactaagatcggtttgaatgacgaccgtggccggtaagttaacttttgccatatcgccagccgcaatgacaatttggtcgggcacgcgccaatggtaattaagggtgtagatgaagtctttggaaagtttaggctcactggtgacatcatggccattcatatcggtaatcgtcgcatcgttgctattcaatccaatcatcggaatacttttgtcagcactcgtggttgcagctttgcttgacgtgaatgccaaagccgaaaccaacaacgaaaaaacaaacaagataacaaagaaccgacgtgaaacgcggttgccttcacgactttgactttgcacgggaacacctccagtcaatttctattaaataaattataacatgatgacatctgcttgattgattgctttcgcacaatgtatcgctaacctccatataaaggcgtcaaacggatcagttttataaaattacttatttagcaatcaactactcacaagaagcttaactgacagtcagtaattatgaataactgaaatttaggcgagtacggtgactgttactatttgtctaaaactcaaaaaatgaacataacgagtcagaaacaataaaaaagcaatttggagcttgcaatattcacataaaaattaaaaacacggtgttttcataaaagtttatggccttaatagtttatttgggaaaccagaatataaaaacgggtattatattaacttataagttatgaaatatacataatattatgttgtcgatgtttaactgtcttgttatagttatcgtacggtaagattcgataaaagaaaacgcttttaggaattgttgaaaagttgggggtgaagtgggtgaaacgtgtactgacgattgctgggattttcgttgcgatgctttttatgttattgtttccgattcaaaaggccgtagcggcggatgatgatattccacctgattcgggtattccagattctgcattaaaggcgccggattactttttcaagagcacggcaaagccggaatataaccagaaccgttcgtcttttagtacaacttatccgcaagcattgattgtgactgggtcagcgaattatcaaaattggcaaattggtggtatgtggagaaacagcggattgatcttaacagcgcctttacctacgagactgctcattactttggttcgcggcctggttatgatgcagacgggatgacgtttactttgcaaaatgatcctgaaggtattgccgcttatggtgcgccgggcgggggcttaggcgcgtatccgtggtccagaagcggtccgccgaagcaggagttgatcagccactatattcaaaatgcactgtctattgaaatggatagttactggagcggcgatacggctcaatttgatgatatgtatgattatgattatcccaataccaaaatgaccggccatttaggggtcgttcgaccgggtgagaccccattgaccaccaaaacatctagagacgttgggcatcttcaatatgttcccttaacggatgcgacgaaactttcgaatggtaagtttcgcccgtttacagttaaatggaccccatcggtaacttacaaagatggggtgcgaattctgggtggcgatcttcaatactatatggatggtaatccggcagagggaagcatttttagaattaacaacgtattggattacttcaaatcagacaaggtgcttttcggttataccggttccagcggtacgcatccgactttccaagcagtggcgttgcttaagatgccgcaaaatgcccagccggtgactgttaactttgtagacacggcaggcaatgcaatccaagatccgctcacgattcccggcgatccgggaaatcagtgggatgcggctaagcggcggccggagtggattcacaaaggcgacgactggtatcagtacacaggtaaatatacggcgaatacgccagatcaaaaggatgccggaacgttttcagccactgtcccgtataccgtgacctatcaatatgaagcccgccgacccccgttgagttatgtcttgaaaaaggcggttcgtaacgatacggctggggaaacggattttaaaacatcaactaacgcaaaagacggtgatctggtcacttatgagctgacttacaccaatttgcttggcggcaccactggtagcattaaagaccaacttgacgccaaccacacttaccaaaatggctccttacagatggccaacgctgacacaggcggcgcgtttaaaccatacactgcggctgaagaaaattttaaaaccaatcatacgattccattcccttacaccattaaagacggcgacagttttaagattcggtttactgccaaaattgcccgccaagatactgctgaaacgattcttaatcaagcgtcggttggcggttccgggagtgatcaaatcacctcaaatcagaccacgattcatttaccggccacaaccggtaaagttactttcagctatgtgaatcgggctagcgatatggctaagccggaagtgatcgcacctgaagtgacagtcacgggcaaaatcgggcagaaagtttcagacgttgatgctagcgcaattcggcctaaagcgattaaggactggaccgtcattgatcaggccagcagctccgaccttacccaggcaacgtttgatcaagctgcagttgtcgatccggttttcaataaggaagaaactgtgatcacttatcggtatgagaaaccgatgctgaaattgacggttgacccgtcgttggattttggtgattttgacaccaacagtgttgatcggacctattacattggcgagaatcaggcaaaaaccaaacagaaattgccgtttggggtcacgattgaagattattacggggtttcccaatggcaacttagtgttcagcaaaatggacaattcacttcggaggtaaaacctgacagccaaaatcctgatttgcacgtgtcgcatacattagataatgccacattgcattttctgaatccgcggctgcaacacacgatggtttccggaccggcctgggcgcaacaagacaatttgatttataaagcacctgatgactttgctttggatccaacagctacaaaatccactgtcttggctgcaattgataagcgaggtcattatctcaaggacgatgctgaacaagccgaagcaaccggcacccagtatgacaatagcggggcaagcacgtggcgattgaatttcggggacgctgacagtgccccaacaagtgtcggtctgcatgtaccagcaagcaccaagcgttaccaggcacactacaaaacaacgttgacctggaatctgtcgatgttgccgtgagggtcgagttggccaacctgccgcatttggttaaagcggcaagcgagggggaatgaggtttgaaatggaaaaagtcgtggtacggcatgctgcttattttggggcttgtgttttttggaaccgtaccacaacgcgtgtttgcagaaaacgaaagtgaaaagactgattttgaagtgcaaccggttttgcccgatgcccaaaccaatacccagttaaattattttgacttggtttatccaaaagattccacccataccattcaaatgcgggttcagaatttttcagataaaaatattacggtggccagcgacttgcgcaatgcctatacgcaagatggtggcgggattgaatttacgcctaagaccagtgatttggatccgagcttgaaacatccatttacaacggtggcaacgttagaccgcggcagtgccacgattaaactggcgcctaagcagatgaaggttatcactgccacgattaccatgcctaagaccaattatgacgggatgatttacggtgattggcatttcattgagcgggtggataaaggcaaatcaggcagcacggcgatcggttcgaactatgcttattcagtcggtgtcgttttgcggggacagaactatgaggtcttcccggatgttaaatacgacgaaaccaaaccgatcttgtttcaaaagcatccggcgttaggggtgaccctgcgcaatgttgaaccgatggcgatctcacaggcaaaagtcaacgttagtatcggtgccgatcaaggcgaggttcgcacttaccaggccagcaacgtcatgattgcgccaaattcaaaaatggttttccctgtctcttggagttacgacgagatgaagccggggacttatcacattaaagcaacgataaagggcctgagtacttacaatcgttttccagtgaattggacatttaagaaaaccatgaaggtgacgacttcgcaggccaaaaccgttaatgaacgggcaataaaaaagccggttaaccactggctctatgccaccatcggcagcggcgtgctgttgctagcgagttcaggggcgctgttatgggtgcttaaactgaggccaaagtcatgaaaaggcgattacgctgccagcaattggcattcattgcgatgttacttgcgtgtttgttatttagcggttatcagataaaaacagcggttgcagctgtcaatacccctcaacagacgcttatggtggcgcctgttattcccaacgataatcaggttaaaaaagcggcaggatactatgagcttcaattgccgaaaatcgaagatcggacgattaccgtacaagcctataacgccagtgcaaaagctttaactgtcggggtatcgattctcgacgcccaaaccggaactaacggggttgtgcagtatgtcaaacccaaacaagtgaatcggcagtatttaaccattgctggcagtgacctagtcaaaacgccagcgcagatcacacttgcaccgggtgagacaaaggatgtaccggttgtcctaaaagcgagtaaggcccggccaaaaggcacttacctgtctgctattcatctaatcgcactgacacctaccgacacggccaacgttcgtcagcgcattgcgtacaccatcgggctggttttgcatcaaggacgtgattcccaaagtctaaaggcgctgcgcctaaagcagacgagtttagtcaaaaggtcatccggatttcagttgcgctaccagtttctgaatccagagcgccattttttaaaagatgcaacggcatccgtgcaactgaccaatgcctccagtcgctttttctcgcttaaaatgcagcagccgttgtcacggatcgcgcctcagactcagtttgtgatgacgcacgatattcaagggcaaaaacctgtatccggtcaatatcgactggttgcggaaattaaacagggacgccatttaaagaccatcacccagtatgtgcgcattaccggtgatggcaaactaatcgccggctcgcgcatcgcatttcgcctggcgcaacaaaaatggaatttgctgaaggttgcgatcgtcatcgtggtgttgggcatcatcggttttgtccttttccgctggcgtcaacaccgtaaagccaaaaaatcggctgagatctgatcgtaacatgcaacaaaggaggtgatgcaggtgcaggcattgatcacgcgtttttcgtatcgtcgtgtcaaatggttcttaatcggcttgacgatcatcttattgattgcttttgtgatttgtctgagtttaacgattaagacttacaacgatttcaatacgtggaaaacagttaatctattttagctgatttagctgggggacacaggttttggatgattttatctcatcatcacgcattcactaaggcgttcgcaacgatgatgggattgaataactaaggagggttttcatgtttaaagtgacaaaaatgaccagtgcacttgctactggggcgctgcttctttcgggactggcgattgcaacaccggctgcggttcaagcagcaacggttgacggtaacgcgaatgttaacggtggccaggcgttaccgcaggaaggtaaaacaactgcagggatttcctttgggcaaacggcaccatctgggaacacgggttatctgcgactacagatggtgccaaagattcttgacttcgggaatcacgaatcatttgtttctgaatatccggtcttcactgccgacgggatcaacgccggaaatgcaacgaacaaccggtatcctaactacaagagtggcgacacaaacctcaccgcgattttaaacaccgatgataaggctctgtctgccgttaaaggaaaagtttggaccaccgttgttgacaagcaaaccacgcggaccgatgcagaaaataagctggatgcaagtggtaaaactgacagcaaggccggttcctggacgcttaatgtcaaagctgattctccgttgacactgaaaaacgataacggtggggacaccggtaaaaccattgatgatgcaactttgaccttcaccaacacggcttatggccaaaccggcagcgtctatgccttgaccaacgaagtgcaggatgacggcttcacccctgtaggcccgctgacaccggtggctgacattgccaagaccacaacgttgaatctgggcacaaacgatacaagtcatcaagttgcctatgccgcacctgaacaaggtgaaggcgcgaacgtctttgcttgggacaagaaaaatatcaagctggtgctacctaagaccgcagttgttcaaaacggtatctatgaagcaagtctgacatggacgctggcatacggcttgaactaatcaaaagctatgggctaatgccaacaaggatttgctgaatcaatatcagttgttaatctaaaaaatgcctgcagcattcaattaagttaagcgtcagcctcccgaaaaaggagctgacgctttttctgcgactgggagcgtactatagaaaaacaaattgatgcccagtattttaactggggaaagcgtaaatttaggctgaatttcgacacaaaagcccgcaacaaccaccgtcgcgggcttgaataagttgacatatttagagatggacaaccgaagtgctactacccatgcaaccgcgttaagtaaagcagtaacgccaatacaagaggactgaattgatagctgtaagccggtaacttaaaggatcgacgactgctgatggcgagcgctacaaccaacataccagcaatcgcaattaggttcatgcgctgttggaaataaccgatagccccgacgaccagtagcaggattaagtcagcccattttggcaggtggacggcccacaatccaatgagcgcaggtaaataaagaagcgctaaatccaataacatcgtccgattgaagaagtgtaggcaggcatatatgatgatgacctgcgctaaaagtgcttggccgaagatcacggtattcatccattgggagggcattttctgagttcgtaaaagtaacgtgatcacgagttgcaccacaattagcggcagcaatagccattgattgatggcaccgagaatgcccatgatggcagctaacagcagcatcaggtcgtaacgtttcacaagccccgtgccggcgagacagagtgtcataagtaaaagtgcgatcagctggaagttccaactgatttgcaatccggtggcaattaagaatgggtaagcaagtacctggccaataaaagctgctgcataggcattttgattgaactttttcaatatgaatgtcctttccgtaacaatttcattttacaaaaccctagtggcatagacaaagattttcggaaattttacaaaaattatgttatgctactatagttgcaaaacattcccgatggggttcgttatccgttagcgaacatgccttgtaaccgaaaatcatgagggggaaacaaacgatgcaagaacgccatttatttacttctgaatctgtttcagaagggcatccggataaaattgctgaccagattagcgatgctatcctagatgcgatgctagaaaaagatcccgattcccgggttgcgtgtgaaacaaccgtgacgactggcttagttttggttgttggcgagatttcgacgaatgcctatgtcgacattcaatccgttgtccgcggcacaatcaagaaaatcgggtatacgaaagaatccggttttgatcctgacagtgtcggtgttttagtggcactggacgagcaaagccctgacattgctcaaggtgtggatgaaagccttgaagcccgtgaatcggataccgatcctttagacaagatcggtgccggtgatcaagggatgatgtttgggtttgcgattgatgaaaccgatacttatatgcctttgccaatttcgttagcccatgcgttaatgcggcggaccgataagttgcgccataatggtgaaatcagttatttacgcccggatgcgaaggcgcaagtcacggtcgaatatgatgacaacgaacaaccgattcgcgttgattcggtggtcgtgtccgttcaacatgaccctgacgtcacccttgaagaaattcggcgtgatgtggaagccaaaattattcgcaaaatcattccggctgacatgatggatgatgatacgaaaatctatgtcaatccgactggccggtttgtcttaggtggtccccaagccgactccggtttgaccgggcgcaagattattgtcgatacctatggcggctttgcccgacatggcggcggtgccttttccggtaaagatgcgactaaggttgatcgctccgccagttatgccgctcgctatattgctaagaacattgtagcagctggtttagccaagcgcgttgaagtccaactggcttacgcgatcggcgttgccaagcccgtatcggtatccgtcaatacctttggcaccaacgccatttccgaacaactgattgaacaggcgatccgtgagaactttgacttacggcccgccggaattattaaaatgctagacctcaagcggccgatttacgaacaaacggcggcttatggtcattttggacgtacagatgttgatcttccttgggaacacctcgacaaggtgcaagcacttctcaagtaccgagattagcgagaaaagaggcggccatagccggaaaaaaccggttgggtcgtctttttgtgtgagcgtgagccagcccggttagaaaccggagtgtaagtggccttgggcgtgatggtcggtctttgaccattgcgaccaaggtccttacacgcaggtttctgggctggcgaacgcgttatggagagcgaaagtgcggggctgggctttggccatttaggcttgaggtccttacacgtagatttctgcgactgcgaacgcgttatgaagagcgaaagtaaggggccgattctttaacctacagacttccacgctagcaaacgtctcccacacttcaccgctgctgctcgaccatcaacatcgcatcaccactttagagaggtagttatgaagcaaagaaaaacaaatgttgcacttgtcaccacggccatcttcatcggcacttttatgaccgccattgaaggcacgatcgtctcgaccgcaatgccaacgattatcggcagcctgcatggtgtgcatctcatgaactgggtcttttcgattttcctgttgaccaacgccatggcgacgccgatttatggcaaattaagtgacaaaatcggccgtaaaccggtcttcttaattggtctgactatttttgtcattggctcgttattatccggcttatcgcagtcaatgatcatgttgatcatcttccgggcgatccagggcattggggccggggccattatgccggtgacgttcacgatcattgcggatatttatccatttgaaaagcgggccaaaatgctgggctttaacgggtcaatgtgggggattgcctcggtgattgccccgctgcttggcgggtttattgtcgaccagttgagttggcattggattttcttcatcaatgtgccactgggcttgctgacgttcggcattgtttggttctttttgcaagaagatcgacggcaggtgcggcagccgctggatgttcgcgggaccgcctggttactgattgcgttgctggcgttgatgtacggatttcaagcccttgcagaaccaaacgcactttggcaaattgccggcatggccattgtggcagcttttggcttttggcaattctggcaagcggaaaagcatgcgattgatccgatcatcgatcttaagttattcgagaaccggacgtttgtcgttcacaatttgattgcagcgctgatttcaggattcgtgattggttttgaagtctatatgccgatgtggattcagggtattctcgggatggacgcctcgctcggtggatttgccgttaccccgagttcgttgatgtgggtcgtcggttccttcgttgctggtaagttgctcggtcgcctccagcctaagccgatcctgaccggtgccatgctttggttgcttggcggtagtctcattttggcgcttgtaccgcagtcaacgccttattttgtcttcttgctggtggctggcggtcttggctttggttttggcttggtgattacgattacgactgtgacggctcaggccattgttgcgcctgatcaggtaggggtcgcaacgagctttaacacgttatcgcggacgttggggcaaacgctgatggtctcgatttatggcattgttctcaacttgcggctgacacaaggtgttgccgctgatggccgcttaaatagcaacatgcttaatgaactcatcaatccgcacacggctcggaatttaccagcggctgttttgccgacacttcgtcagattctctatgaaggactccacaacatctatttcttctccatagtgatcgttgcgctggctcttattgcgaaccacttcgaagcaaaaaaggttctgtcaaaagaagcaactcaggaaactgacgaggaagcttgaattgttggtaaaagggtcttttagcttgtgagatggtaaaagccatcctgcgctttatgacagggcaaaaaaacgatcctcgatagcaagcaaattttgcgttgctctcgaggatcgtttttgcctgaaaatggttgctgatgctagttttgccatcgcggacttataaagttgacctacctgtagcatctttattttcgggaagcgagccttgatgcggtggcataggtggttggatggcttttttatacagcttagcagtattttcctgaaccacggcaacgacatcaaaaccagggtcattttccagcgggccgaaatttaaaaaagtttgatcgtcgtcatactgaatgccttgcaaacgggtgctcatgaggacgtgtagcttatcggctttttggtgtgacttttcgatttcttcactggccttggctaaggtgtagccttcatccagcatggatttgatcatgacgatcaacgcgatattagaaagcgaataacgcttgttgccatttgcttcgtgtcgcagtgagtggatcagatgctttttttcccaatagcggatttgggtcggggtggccccggtaacccggctggtttcgccgatacctagcgaaatatcgagtgagcgtaatcgttcattgaagagtcccatggtctggtctgcctcctttgccttgacaactaatcagtttaattgtaatattttatcttgtcaatattacattgtgtgatatagaaaacacaaaacattataaagaaatcaggcgaagttatggacgttaaagatatcaacgggaagcaggttaacgtccctatgatggtcatcacgctcattgtcgggacgtttattacagtactgaaccagacgatcctttccactgcgtttccgacgttgatgaaagccttcgacatttcgaccgcaacggtgcagtggttgtcgactggctttatgttggtcaatgggattatgatcccggtttcggcatacttgagcgcgaaggtgccttccaaatggttatatatgagtgccatgggaactttctttgttggcacactggtcgcttttgttgccaatagttttgcgattttattggccggccggttgattcaggctgtcggtgttgggatcacgatgccattattacaaaatattatgatgtcgatttttccgccaaaccgacgtggcgccgccatggggatggccggcatcgcgatcggggttgcgccagcgattggaccgaccctttccggatatatcattgataatttcggctggcgggtcttgttcgggatgattctcccgattgccggtttggtcatcatcgcggcgttgttcttcttcaaaaacgttttgccgctgtcgaatcccaaattggacgtgccgtcactgattgaatcgtccattggctttggtgccttgctatacggattctccgaagtcgggaacgatggctggggtgatccgatggtgcttggttcaattgccgtggggctgattttcatcgtgatttttggctatcggcagctgcatttaaaagagccctttgtcgagctgcgggtgtttaagagtaaaatctttgcgctgtcaactgttttggggacgattgccaacatggcgatggtcggtgttgaaatgattctcccactatatttacagattattcacggtaaaagtgcgctagaatctggcttgacactgctgccgggggcacttttgattgcggtcatgagcccggtcactggccaagtgttcaaccgtatcggtgccaaacggttggcgcaattggggctttttctcctcacgattgcgacactgccatatttcttcttgacgacaaacaccccgtcaatcttcattacagtgatttatgcggtacggatgtttgggatttcaatggtcatgatgccattgacgaccaatgggatgaatgcgttgacgcctgacatgattcgccatggcacggcggtgaacaacacagtacgacaggttgcgacttcgatgacgacggcggttttgatctcagtcctgtcaaacgtcaccaatctcactaaaccggcagccagcctggtaaaaagtaatccgctgcagtataagcaagactttttcaatgctacactcaacggttatcacgcggcctttttactggcagtcgggtttagtcttgtcggctggattctgacattcttcctgaatagtcacgccatgtcgcaagaagtgacgattaaagatgaaaagaaggtgaaggcatgattctttggtttttagggttgatggtcgttggcctttatcttagtttcatcatgatgcaccgttcgcttaaacgcaccgcattgatcattgtgtttggtatcggcgtcgtgggcagtttgttgcttatcacgctgaatgataatgcccattttgggatggttaagcgaacaacgaccgacgagcagactatttatactgcatcgcctaatgcgcaaatgccgatgcttttgaagcaaaccgtggggactgccggcaaacacgccgtttatatttacaaaacggatcctaagaaaaaggccgtgcataccaaagccgacctagccgtgcataataaagtttccagaacgtctgatacgtccgcttcgttaaccagtaagacgacacggtgggaatatcaaaatggcttttatggtgcactattcaatcatgaaggtgccgaccagttcgtctctcagcataaccagctcgccattcccaaaagctggttcgttttgaccacgacgcaggccaagcagctgagcaccaagttaaaagcgttgcagcacccaactgcgcagcaaaaagccgccttggcgacaaaggtgaaagccaaagcagcagaattggtcaaagccgatccgaagttggcgacggatcagaccacgctaatgaagcaggctcaaaaagccgtgcaacaagagctgatccagcaagacgtgcaggatgtgcaggcacataaatagttaatgacaatgtatgtggtgcagtgatgcacgcacaatagtcaactcaaggcattaaaaaagcagatggcgagttttctctcagcgatctgctttttgcttacgttgatgctggcgagataagtagggattgaaaaaccaccaactcagcattaacaaggcgaatcccaacgaaaagccggcaaagacatcggtcggatagtggacacggacaaagatgcgtgaatagccggtcaagccgatcatcaagactgccaggatcgtgatcagccatttgccagtcggatgtttgagcaatgtccatgccaaaagaataatcgtgccataaaacatcatggtgccactggaatgcccgctggggaaactgaatccgctggctttgactaaggcgcgaatttgcggatcggcgatgaacgaccgcggccgttggatcagatatttgatgctgacattgagcacccccatgatggcgccaacgctggctgtaaacacggctgcactccgataacggcaaattaaaagccctgccgccaagaccatggttaaaacaattaaaatgctggggtttcctaattcggtaatgacgagaagcagcggtttaagcgttgctgcgtgaaattgggtcacaaaggcgataacgcgctgatcgaccgtatgaatccagtttgcgttgttaacaatgccgactagtaaggtgatgaaaatgattaatgcagatcctgatagataaagtggtagtgaacgacgttgtgccaaaacaaacctcccaaaataagcacaatcgactgtaacgaatgcgctaagaaaatgcctaatataaatagaatagcataatgaccattgaacacatctaaggtttttgctatgattgacgcaatcatcaaacgaacaaaggagtagtaagtcgatgcggggatcagagagcaggcggtggtgcgagcctgacgatgctaagactgaactggcctttgaagttgctgcggtgaagccagtaatcgcagccggtcggaccgttatctccttcgagcgctgtgcaaacagaacttaggtggtaccgcggctgagccgtcctaatgaagatagggcggttttttgtttgaaaaattagtgaactagttcacgttatagcgcgccggttcacgctcacattaacgcgttcaccggcgcaggagcctgcgtgtaaggaccttggtcgcaatggcctaagttcgggccatcacgcccaaggccgcttacactccgacccctaaacgcgccggttcacgctcacattaacgcgttcaccggcgcaggagcttgcgtataaggaccttggtccacgcccaaggccacttatacttcagctcctaagcgcgccggttcacgctcacaaaaaatcaggaggtaaagaaatggcatacgatcatcatgagatcgataagaagtggcaacgttattgggcagagcataacgagtttaataccacgactgatccgaaaaaaccgaatttttatgcattggacatgtttccatatccgtcaggccaaggcctgcatgttgggcatccggaagggtatacggcaaccgatattgttgcgcgaatgaaacggatgcagggattcaacgtgttgcatccaatgggctgggacgcattcggtttgccggctgagcaatatgccttgaataccggacacaatccgcgtaccttcaccaagcaaaacattgaaacgttcaagcgtcaaattaatagtcttggcttttcatacgattggaatcgcgaaatcaatacgacagatccaaattactacaagtggacgcaatggatttttgaacagttgtataaacatgggttggcctatgaagccgaagtgccggttaactggagtccggacttaggaaccgttgtggccaatgaggaagttatcgatggcaaaaccgaacgcggcggctttccggtcattcgcaaaccaatgcggcagtggatgctgaagattacggcgtatgcggataagctgcttgctgatctcgatgacctagactggccggaatcgatcaaacagatgcaacgcaactggatcggcaaatccaccggtgcgcagattacctttgcagtcaccgacagtcaggaaaaattcgacgtgttcacaacgcgtccggacacgctttttggcgcgacctatgtggtgatggcgcctgaacacgaattggttgaaaagattacgacaccagaacagcaggcagttgtcgatgcctatgtggaggaagctgcgcataagtctgatctggatcggactgcgctggataaagaaaaaaccggcgtctggactggtgcctatgctaccaatccggttaatggcgagaaactgccaatttggatctcggattatgtcctggcgacgtatggtactggggcaatcatggcggtaccggcgcatgatgatcgtgactatgccttcgccaaaaagtttgggatcgaaatcaagcccgttatcgaaggtggcaacattgacgaagcggcctacactggcgatggggttcacatcaattctgaatttttggatggtttaaacgagcaggatgccattgatcggatgattagctggttggaagacaaggagattggtcacgccaaagttaattataagttgcgcgattgggtcttttcccgtcagcggtattggggcgagccgattccggtgattcattgggaagacggcgaaaccacactggtaccggaagatgaactgccactggtattgcctgaagaagtcgatatcaagccaagcgggactggtgaaagtccattggccaatttgacagattgggtcaatgttgtcgacaaaaacgggcgcaaaggcaagcgggaaaccaacacgatgccgcaatgggccggttcttcatggtatttcctgcgctttgtcgatccgcacaataaagaagcacttgccgattacgacaagctcaagcagtggatgccggttgatctttatattggcggcgctgaacacgccgtcctgcatcttttgtacgcgcgcttctggaacctgtttctttatgatattggcgcgattccgaataaagagccattccagcgcctgtataaccaaggcatgattctgggcgacaatcatgaaaaaatgagtaaatccaaaggcaatgtcgtcaaccctgacgatgtggtcgacgaatatggtgccgacacgctgcgcctctatgagatgttcatgggcccgctggatgcaggcatcgcgtggtccacaaagggcttggccggtgcgcgcaagttcctggatcgcgtctggagtgcctttatcgatgacgaaggcaaactgcgtgatcgcatcacaaccatcaatgacggccgtttggacaaggtttacaacgaaaccgttaaaaaggtaaccgaagactacgaagccttgcattttaacactgcgatttctcaaatgatggtcttcatcaattcggcccgaaaagacgacgatttgccgcttgaatatgtcgaaggttttgtcaaaatgctcgcgccgattgccccgcacttgatggaagaaatctggtcgcggctcggtcacgatcacagcctgacatacgcgccatggccgacttacgatgaaagcaagctcaagaccgatacgtacgacatgatggtccaagtcaacggcaagctccgcggctccatcactgccaatgtcgacgaatccgacgacgatatcaagcaagctgcactggccaatgaaaacgttcagaagttcacggccggtaaggatattaaaaagatcatcgtggttccaagaaaaatcatcaacatcgtggccaagtaatgagatgatattgcgagttattgaagatccgtgacgtcaagatcttacgacaaccattcaacgttaggttccagcgaaacaaaatcggtgccaaagactgagaaggtcgatgggactgatttttttgagcgcaagtcagcgcggttagaagccggagtgtaagtggccttgggcgtgatggcccgggcttaggccattgcgtccaaggtccttacacgcaaggcttctgcgctggcgagcgcgttatggcgagcatcaaccagccccctaacaactataaacacaagttaaccccccccaagcaaagcccgtcattccagactatcccagactattacgccaagtcggtctttaaacatcttttgacgtggtatcatattaataattgtgttatcgacaattatcaaagttttcttttgattcaccaaagaaatccgggaaagattgcaagtgaggcgtggattgcctaaaatataaaggattacgcaacacgacaggagcttatcatggaaaatttgctgggcagcggtaatcagccgccgcgttcagacaaggaaaaaatgatccgcggttcggcgtggatgactgccggcagtgttttttcgcggattttaggagccatctatgtcattccgtggcgtatttggctcggtgcagcttttctaacggcaaatgccttatttaccaagggctatcagatttatagtctgtttttgattatttcaaccgcgggtgttccaggggcggtttccaagcaagttgcccggtacaacgcgatgggcgagtataaaacgggcatgcggctcttttatcatggaacaatcgccatgctgcttatgggtgttttgtcttgcggtgcgatgtggcttttggcaccgttattagcggcaggggatgcgcggatgatcccggttttccggtcgttggcgtggccgttgttgctaatcccatcgttgagtctgattcgcggctttttccaagggtacaatgaaatggcaccaagcgcgatcagccagtttgttgaacaggtcgcccgaattttgtacatgctggtgatgacgtatgcgattatggttgccggcaatcatcattacttagatgcggtggttcattcaacatttgcggcgtttattggcgcagtttttggactcggtctattggttgtgtatttcgttcagcaaaagccgcgcttagatgcgttagaggcgcaaagtaaacaggctctgaacatcagcgtcaacgagattttgttggatgtggtgcgtcaggcaattccattcatcatcatggattcgacgattaacatttactacatcatcgatcaatatacgtttaacccgatgatgaaggctttttatcgcgtaagtgaggatcagctggatcggttctatgccttatttgccggtaatgcgaataagttgattatgattattgttagcttggcggttgccatggccattaccgttgtgcccttgctggccggtgccaaaacgcgtggtgatgttgcggggttggcgcggcaaatcacgaacaccttacagctgttctttattgtgatgattccttcagcctttgggatggtggcggttgcgcgtcccttatatgttttgttttatcgtgatatggattggttgggcatcaggctattacagtggtcatcaattttagcaattttactgggcctatttacggtgttagctgcgattcttcagggcctgttcaacaatcgtctggcaattcaggaaatgttagtggggatggcggtcaaagtcatcgcgcagtggccgatgattttctttttcgatgtctatgggccgattatcgcaacgatgcttggcatgacggtatcaagcctgttgatgctgtattcgacgaatcggatgtacaatattcacgtgcgtcaaacgattcgtcgcggtatcggtattctggcgttttcattgatcatgtgcgccgtttgctacctgatcgtgaacctttccggcatgatcatcaacccgcaaagtcagtttggcgctgctttggttttgctggtagcggttggtgtcggggtactgatttatggttatttaattttaaaaacgcgcttggcagatatgattattggcgaacgagtcagtcggttacgcgaaattttacacattcggtgatgttatgcgattagataagtatttaagtcatttgcaatttggcagtcgaaaagaagtcaaggcgctcattcgtgataaacgcgttcgggttgccggggaactcgtaacggatccgggctacaatattttaccgggcgttgcagtggaagtgaacgatgcgcaagccgatgggccacttgaagtcgattatttgatgaataagccggcaggggtcattacagcaaccgaggatccggtacaaccgactgttcttgatttgattcggccgcatgattaccggcctggtttatacccggttggccggttggataaagacacgacgggactattattactgaccaccgacggcaatttagggcatcgactcttggcgccgaatcatcacgttgccaaaacctatacggctacactggcaaaagcgctcactgatgacatgaagcgccaattagaacaaggcgtggttttagaggattttacgacagctccggcagaagtaacggtggtgccggcaactgacaataaagtgatccaaatgacgatcacggaaggtaagtatcatcagatcaagcggatgctgctggcggtcgataatgaggtgctggctttgacccgcatagcgatgggaccgctgcgtttaccggaaaatatggcagctggcgactatcgcgcgttgacggatgaagaacgggcacagttggcacagatatcccaataacggctagattggtttggagcgtaaataagctggcgttaataaaaagcggcggcaagagtggaaaaatctgctcttgccgccgcttttaatctgacttgcctacttatatgaaggaaatgctctgaactgggcgacaacctttttaagattcagacaattgtttcagataggcaggcagctcccgaatcaccatcgtgggtaatgccacgtagctattcatagcgacaatatcagcgacgtgtgagtggacgaatacggctgctaacactgcctgtttaagcggttgaaactggccggcaaacgcagcaatgatgccggttagcgtgtcgccagagccgcctgtggccattgccggaccaccggccatattttcataaacgtcatcgccaacaaaaacatgcgtctgggaacttttggccacaacgatgccagggatgtggctggctgcctgttgactggcggtgacagtttggtcggggagtgcaaggccagacaaccgctgccattcgacctggtgcggcgtccaaatgagctgcgcgttcgggtagtcaagatgatgtgaagccacaagggtaatggcagaaccatcaatgattagaacctgcgtctgctcaactgccgcaaagactcgctttaaaatcgccaaggcagcgttatcggttcccaatcccggaccgacgacaattaccgtggcttgacgaatagccgtttctagggcagatgaggcagcatcgagaatcatggcttcaggcaagcgggcgtgcaaggcgctgcggttgaccggatcggtcgctacactgactaatccggcgccggcataaaccgccgcactggcactcatgattgcggcacccccgaattgagcgttgcccccgacaatgagaattttaccaaaactacctttgtaagtattgcgttgccgcggccgcacgattgcctgcgctaactgttccgttaattgcttcatgaatcagagccctccttcaagacagtccattcactaaatgttttagtggttaaatccgcctgaccggtttgtaaaaagctttttgcaaacatgaccagtggcgaagcattatcccaagttaatttttccagtgggacggcctgtgcgccaagtgaatcctgaccgatgaattgcggtacggttttagctaattgaccaccggtgatcgtgagtgtgtagaaaacacagatatgttgattaatggtccagtgctcatactgccaaggataaacaaaactggtagcgcccaactgacgatcaattgtggtggtgagccccgtttcttcgttgaactcccgcaggacatcatgttcgagcggctcgggtccgtctaagctgccgccgggaaggtcaaagcggtggatgtaagggccgccatttttacgaatgacgatcaagcgttgatcaatggttgcaatcccatagcagccaaatgcgcggtgcgttttatgtgtcattggttcgcctccatcttttaaggttaagagtgtttttattgacatttgggtgatctccggtaatactgatatcgagtaagcatcttgcttagtatgagattgaagggggtgttagtcatggctacgaagagctttcaaacggattttaaattcacttcgaaaaccgcgagtgctttggctaatgcgttacaacagtctaagcgtgttgatgttgagttgacacaaaaggttcgacactactcaagcactgacttaagtaaaactaccaaatttgattctttttttggtagtggacatgagaggacgaaagttggcccttgatctcgtttctctaaatggaattataaaaaagtatcctgaggagcaggttcgtgagagcctctcctcttttacttcaatcaataaagacgtagaaaatttcttacatgagcgttgcattgagtttgaaaaaatctcgttagcacggacaacacttgtgttcagctcatacaaaggtagaagcgtgcttgttggttatttttctatttcatctaaaccactgaccatatcaaagaagaattggcgtggactttcgaagtctgtgcaacgcaagctgatgccgatgggctacaggacagagcaagagaattacgccgtttcttcgatattactagggcagcttggattaaactttcagtatcatgacactcatcttattaccggggcagaattgctgagtttggcgtataaaaccataaaaattgcaaatgaagtggttggtggacttgttttatacgttgaagctgacgacgaacctcatctacgtgaattttatacaaacaacggtttttcgcaacttgtggtgaagcatccggataactcgaacaatggacacacccatccatatcttacagcaaacggtcaacacctatacacaaaaaagataagtgatttataaagatacaaggtggcgtgaatcttagatgcagtattggcgataagcgttcgagcacatttgtggccatttgcttttttgcatttttgatagtatttgagctgagcagtttagttccagcatacacagtctcgatgattcgtttcttttgctcgaggagacttattttgtccccttcttgtccccccgaaaacaaaaacaaagccctcctaagataacctaggagggctaaaacgttgatatataggcatttcattttctaaagaagtctaaaatatcctatgaaatgccgcgaacaggaatcgaacctgcacgggaataaatcccacagcgacctgaacactgcgcgtctgccagttccgccatcgcggcaacaacataaatgattatagcggaagcacgtaggccacgcaagcaaaagttttaagaattttttcggtaccgtttgtttcgccaaaagtgttagtataaggcatcaactttgattaagaaaggcggaccaactatgtcaatttatgatttcgatgcaactttggaagatggcgcagagtactcattaagcaaatataaggggcaaccgttgctgatcgtgaatacggcgactaaatgcgggtttgcgccacaatttgacggtttggaaaaactgtataaaaaatacaaagatcaaggattagtcatcttgggtttcccttctgatcaattcaaacaggagttggcggacggtcatgcggcggcggaggcgtgccgaatgaagtatggggttagtttcccgatgcatcagcttatcaaagttaacggtgcgcacacggccccacttttcaaatatcttaaaaccgaagcgcctggtgagttgggaaagtcaatcaaatggaacttcacgaagtttcttgtggatcgcgatggccgagttgtaaaacgttttgcaccgaaaacaacgcctgaagcgattgagccggcgttgaaacaggttcttgcttaagtgcattagctgtaagtcgatagcaagaattcggtctgaccgtggtggacacaccctgacaggatgcgtacaatgacaacaaaagcaagaaagcagggatcgttgatggaagaattgccagctgacgttgcagcctttgttgatgcgcacttggttgatcggcgaaatagtaacgccgtcaagtgggatggcttaaaagaagaatttggccgggatgatttgttgccaatgtggattgccgatacagaattcaaggcgccgcaagcggttttggatgcactaaccgcccgtgtgcaagaagggacgtttggttattctatccgcccacaatcgtattatgatgcgttcattaattggcaaaaagagcgccatggcgtgacagtcgaaccggaatggatgcggtttggcgtcggcgtggtgaagtcgttatatgccatggtcaactggctgaccgaccccggcgatccggttttaatcatgcagccggtttattatccattcatgaatgcgatcaaagacctcggacgccgcgtggtttcggttgatctgcaattaactgccgatggctggcgaatggatttcgatcaactggaaaagacgctggcaacaacccacattaaagcgatgattttgtgttccccgcataatccggtcggccggatttggacccgggacgaattgaaccggctgtttgcgattaccagtcagcatgatatcacggtggtttccgatgaaatccatggcgaccttgaagtcagcggccctaaatttacgtcagccttgcaggtggcggaaggcaaagcccgccaaaatctcgtggtgttgaatgccccttcgaaaacgttcaatcttgctgcgttgctgaattcccatatcatcattccggatgaagaactgcgcgccaagtatgacgattttatcaagcagctgcatccagttgataccagcctgatgggccaagttgccggcgaggctgcttatcggcatggcgctgcgtggctggatcaggtccttcaggtggttcggtttaactaccggcaattgttggatggcttagcgcaggcggctcccaaagcgaccgttgctgatcttcaagggacttatttagcctatgttgatattggtgcatacgtggcccctgatcacatcaaagcctttgttgagggcatctgcggtttggcagttgactacggtgcatggttctcgcccaaaacggcgacgtatattcgcttgaacctcgccactgatccgaaactcgttgctaaagcgatcactcggttaacagagcatttaagccagccgcaattgtgatcctagtctccagaagccattcgttcatcaatactgataaaagcaggacttagattaacgcttttggcgttgacgctaaggcctgctttttagaaaataaaacattgccgatgaacagtattagggatgcttgatgacaagatgttgatcattcagattgtggtcctgcacaatggttttaagatagcgacgcaacttcggcgagcgttcgaggacagcccaacctggatcggcatgaagacgcttgagttcagccttgctcgggtggtcatcacctgtgaaaaagcgccagttaaggatccccatcagtctggccgctgcatctaaatcgtgttcattggtcacaccgttgtccatcaaatcaccatatgccaaaccttcaccatcttgaaggaagagacgttttaagtatcgttgataatgcaataaatcaggattttttcgttgcgcagacgtcaggtaaggcgttagatccgtagcttttttctgataagtaattttattcggactgaaactaacaatgccataacttgccggactgattgaaaaagccccgctgacgacttcaatcgttgggcactgaccagtcggatcacgactgatgtcctgggcgtggatatgaccagaaaacagtagcggaacatgatatttggtcagtaacttctttaacgcatcactattgtctaaaacatagccctcattcacagcctcattatggttgtataggttgtggtgcataaaaacgattgacttgcgatgggcatgagcgccaatggcaagctgctgacggacccaactcaatgtttgcggcgagagtttgccacctgtgttaggcgggcgattggatggctctatcgtgtaaatattgctgtcgagaagcagtagctggtattggtggttcagattcacgcgatagctcagactgttcgaatcctgagccgccgcctgtgcataactggtatgaaaaatctgccgccagtcgctgggactgatttgctctgtcatcagttgctgcttgcctttgtaagcacgtgcccagccgtcgtaaatgtcatggttacccggaatgatcaaaaccttggtgccattgtcgacaagcggttgcaggcgccgcatcaagctttccgcgctggctttttcgccattaaatgtcacgtcaccggtgatgatcaaagctgttggccgcgccttaagcgcgctttgtaccaaggcatgaatggctaccggttgataatccatgtccttaccggcagcggatttcttgatttcagtgtaagcggtgcgctcatcgtgcaggctaggcgcgatgaagtgggtatcgctcagcacccaaatgttggcgtgagtatcattgattaaaggcgcgttgtgatcgggatgtacctgacttaacacgaatgcgaacagcaccatgccgagcagtgccgcaaaatatttaacgactttcattttctgcctccacgatttagtttatcacggcatttgttcagtgctgccttgaatcttaagatagtttgattgaaaaaataatttgtcgatgccaaggtctaagtacttgaagatctccccaagtttcgaagcagattatggtaaaatgagacatcgttttaagcaccaatcaaaatgaagcttttagagagaggacaaatcatgcaagtcatcgtaaccgttattggaactgataaagtcgggatcattgcccaagtgacaacggcattggccgacctgaacgtcaatattttggatgtatcgcaaaccatcatgcgaggagcttttaccatgatgctgcttgccaagatcccggatgatgccagcttcaagtccgttaagcagcatctgacggctttaggcgacaagatcggtgtggagattaaagtttcccgccaagaaatttttgatgccatgcatcggctttaatcaccatcaatcagctcaatgagggagtagtcatggaaacgcaacagattaaagaaacaattgaaatgatcagcgaggaaaacctggatatccgcaccatcacgatgggaatttccttgctggattgtgtgaccggcgatttacagacaacagccgatcacgtttatgccaaaatcatgcgcaaagccgccaaacttgttccggttgcagaggccattagtgatgagtacggcattccgattgtcaataaacgtatcagcgtgacaccggtcagtctattggcaggtgctgacccaacgttggattttcgtccggttgccaaggcaatggaccgggcagcgaaggatctgggtgttgacttaatcggcggctattcggctttggttcaaaatggcagcacggatgcggaaattgccttgatgaaaagtttgcctgaagtattggcaacgaccgagcgggtttgtgcctcggtcaatattggcagcactcgcagtggcttgaacatggatgccgtgaagctaatgggtacggtggtcaaacaggtcgccgctcgtaagccacagaatgcaatgaaactggtgatcttctgtaatgccgttgaagataatccgtttatggccggcgccttttggggtgtttctgaaggtgatgtagcgattaataccggcgtttccggtcccggggtcgtgcaacgagcgttagccgctgaaccgcgcgccagttttgaaggcgtgtgtgaaaccattaaacagaccgcgtttaaagtgtcacgaatgggtcagtttgtgggcaaagtggcggctgagcggctaaaagtaccgtttaatatcgttgacctgagtctcgcaccaaccccggccaaaggcgattcggtggcccagattttagagacgatgggcctcagccatgttggcacaccgggaacaacggcggcgcttgctttgcttaatgatgccgtgaaaaaaggcggcattatggcagcagaacgggtcggcggtttgtcaggcgcctttattccggtatccgaggacgcaaacatgattacggccgcagctaacggccagatcggtttggaaaagttggaagcaatgacggctgtttgctcggtcggactggatatggtggcagttccgggtgatacaccggataccacgattagcggcatgattgccgatgaggcagcgattggcatgatcaataataaaaccacggccgtccgcgtcattcccgtgccaggcaaacacgtgggtgagcaggtagaattcggcgggcttttcggtacggctccgatcatggcagtcaataacggtgatgccactcagtttatcaaccgcggcgggcggatcccggcgccaattcacagttttaaaaattaatttgggtgtccattttaactttgcaaaaagtgtctaattcaatagctcgtaaccgaaatgccttgtccaaccgatgattagcggagggacaaggcatttttgattgttggcgtaatctgtagacgaggtgaaaatgatgtttgtagcgttagacgagaacaatcgccgcatcacattaaccagtcatcagcaggcgcgtcaattggctggcggtcgttttcattgcccactttgccaacagcgggtgttcatcaaaaatggggtcgtactgccggcacactttgctcatcgccaccgcccagttggtgaaggcgaaccggaaagtgccgaacatctggccgggaaaagctggttggcaacctggctgcgtcagcatgagcgatcggcaacactggaatactatgatgccgcgatccgccagcgtgccgatattctgattcaccaacaaccacctaaagtgttggaatttcaggcgagtccgttgagtattcctgacttaaagaaacggacgacgatgtatcatcgccgtggctggcaagtgagttggatcttaggacgtcggtaccacgattcacaagggaaaagacaagcccgcaaattcttgacgctagaaaatgatcggttaacgttgtggtacttaaacgtacagatcggaactttgtcgcggttacagctaaaagaaacaggtcggctttggacgcactatgcgcatgaccactcgccaagccaacaatggcagtccgaatcagttgatggctatcgacaggctagacaaatcgctttaagcttgcagaagcgcgctcatccatggatgagtctccaagcattggcatatgaaaggcggcataatttgcaaggtgccccctgggtggttcataaccaaccgcatccgctgcagcattttggcgtgccggaattacggttgcggattcagtggctactgacatttgaaggtcggagcttcacagcagcgcaaagccggcgtttctgggtaagcgcgttaccagatgtctggacgcctttgttaccagccgggacgcttgctagggcgcttgatacgcattggctggcgctgattaaagatgctggcctcatcggttttgatggttcacgttatcgttggcggcaattgccacaatggtttgcggatattgaccggaagctggctaacataacgcgcttatcaggaaaagattgcggatgagtggttcagcatttaaatggttaaagtctttgtgcacgatggctaaaattagcctgacttaacgcacgccataacgcgttcgctggcgtaggagcctacgtaaggaccttggtcgcaatggccaaacccgggccatcacgcccaaggacacttacactccggcttctaaccgggctggctcacgctcatataaaaaggaccttgcatgatcgcaaggtcccaagtacaccatagaactattcagctaaactgtttgctgccagatgaaaccgatcagctaagaaacccgcaagttatcaagccaggtcgcttaatcgtgaaggtgggtgacgacgttagaggcgtttaaaagaatcggaaatgaccgcccatattttccggttgttcagtgaagaatcgcgccggatctgttctgatgaggtcacaaagttgcggaatgagatcggcatcactgatttgctcgattaaaacagcatgaccgtcatcaacggcgcgatccgtgtccacaatgacaagagaaggggtctgcgtaatgcccatttgattggcggtacgctggtcggagtcaaaccccattttgacttcagtacgctgccgatcttcatagaacatttcatgatctaaatgacatttcgtcagcattttggcaacgaaggcggcatcgtattgatactgaaccagcggcgcgtgttgttgtaaacgcaacagcaacatgcgcgccttcttattgccttggtactgggccgctttataatccaatgcaaggttataagcggcacgcaacaactgatttcgtttggcaaggctgtgaacgtttaattgttcgtactgcatgaattgttcaataatgtccagattgagaaccggaacaaaatgaacttttacctcttgttggaatttatccagttggtgtagcagcttctgctcggtactcagacagatactgccaatcggattgaaaaaaagaaaaatttctaacacggtcttggcctccaatgtgctggcaacaaatttctacacttactttatcagaaatcgcgcaagtaacaattatttagcttgtgaatcatgcacatgctcatatgcacgttgtactttattgatgacaggttgtttttttatgtgaaaattctgtagcaagttatcgtagaattttttggcttcatctaggttttgatactccatttccaattcaaaatcggaagtttggtcgatataaaaggtctgatcgagtgttaacaagccagccggcagatgtgcgagtcgtctggttgttttggcttgtgtttgcggatggacgcttgccgggtcaatgtggcgggctgccaatgcttgggtgacctggccgggcttaagctcaccccgctcaattaaattttgcgcttccatcgatgtgagcggatcggtaatttcctgaagatcgcgatgttgactgttgttgggaacttttagcgtttgctcggcgtggtcggcaaactggcgaatccgcaagccaagacgtgccgctttgacagcgccgtcagctgtgtcataataggtgttcatttgggaaaaagccgggtcaaactcaaaatgattcaaaatcgccaggaatgcggttttggttaaacaagttttaaattcctgttcgcgggaaatagccatgggttgcctccaaacgcaacggcaccggttacatgccaaaaatatgatagaatggtggtcgtgagtgctgtcgttagctgttggcaagtcaaccgattgaacttggacttgttgactgacaaaacacataccacattattagtagtttagtatgggagggccagtaatgcaaagagactgggacagtttcttaatgccgtatgaacaagcggtcggggaattaaagattaaatttcgtggcatgcgtaaacaatttcaacaggccaatgagcatacgcccattgaattcgtgacgggacgggttaaaccggtcagttcgattattgagaagcagagtcgccggttcattagcgatgagcttttggaacaggatatgcaagacattgctggtctgcgaattatgtgccaatttgtggaagacatttatcaggtggtcgatctgcttcgtcaacggacagatatgaagatcgtcgaagaacgggattacgtgaccaatgtgaaaccttccggctatcgcagctaccatgttgtgattgagtatccggtgcagctgattcacggcgaaaaaaagattctagccgaggtccagattcgcaccatgtcgatgaatttttgggcaacgatcgagcatagcctgaattacaaatacaatggcgagtttccggacacgctaaaagcccggcttaagcgagcggcggaagcttccttcatgcttgacaaggaaatgtccgatattcgcgaagaaattcaggaagctcaacatttatttgtttatggcaagggacaacaaccgtatcccgatgcgactgacgaaaaaaagcctgacagtaaaaaggatgaataagatgcgcgtaacggtttttcataatagcatacctgcctccatcacggcagcccaaaagttaattaaactgttaaaaaacggccattttgaactggatgaacggcaccccgatgttgtcatcacaatcggcggtgatggcacgttgttgtcggcctttcatcggtacgctgaccaactggataccattcgctttattggcgtgcataccggtcatctgggattttacacggactggcgtgattttgaaattgaagatcttgtcattgccttaaaagaagattccgggcaaagcgtgagctatccgcttttggatgttcgtgccatgtatgcggatgctacgagtgcccattatttggcgcttaatgaatcaactttgaagcgattaaacggtacgatgcggacagaagtttatattaaaggcgatttcttcgagagctttcgaggcgatggcttgtgtgtttccacaccgaccggttcgacagcttacagcaaatcaaacggcggtgccgtcatgcatccgcggttggacgcgcttcaggtaaccgaaattgcgtcgattaataatcgggtgtttcgaacgctcagctcaccgatcattacggcgcctgatgaatgggtgacgctggagccaactggtcgggatgattatgtgatgacagtcgatcagttcgtcatcaatccgccaacgatcaaacagattcgttataagattgccaaagagcggattcattttgcccgttatcggcacatgcatttttgggatcgggtcgaagatgcttttattggagcgaaacattaatgcgttttgaatggcattacgaagggccaccgcttaagttgggggcttttttaagacaacagggcttttcccgtgcccaactcaaaaagctccactatcaaggcggttttatttttgtcaataaacggcaacgcaataccgcgtatgggattcgcacaggcgaccgaatcctggttcaaaccgctcccgagcaagcggcagacagtgttgttccgtacccgcatgatctgacaatttgttatgaggatgatgattatctagtcgtcaacaaaccagccggcgtggcgtcgattccagcgattggtcgcaagaatgacagtatggccaatatgatcaaggcgtatttgattaaaacccatgcggaaagtcaggcggtccacgttgtcactaggttagatcgcgataccagtggtttaatggtatttgccaagcacagtctggcgcatagtctgctggatcgacaactgcatagtgaggggttcctgaagcaatacgtggcaattgtcaccgctaagtcgccgttgcctgcccatgggtggatcgtgttgccgattggggtgagtcaaggcttttatatgcggcgaatcgtgagcacgactggcaagccatccgcgaccgaatatcgaacgctggcgcagaattcgcaggcagcggcggtgttggtcacgctgcacaccggccggacgcaccagattcgggtgcattttgcggcgatcgggcacgtgttgttcggggacgatttgtacagccggcaacgcgtcagctttgaacggcaggcgttgcattgtgcccatctgcatttttggcagccgctgaaaaagcaatggctggatttgcgggcgccattgccaaaggatatggcggggctggctgagcgtttgcagttatcactgcgaggatgagtgggaaaattttacacatttccaattaataaattcatctatttttgtatataaatacgaccaaagccggctttaaacggtcatcgactttggacgtatttgtat

SEQ ID NO: 305 - DNA, 30901 bp, Lactobacillus casei
atttttgtatataaatacgcccaaagccggctttaaacggtcatcgactttggacgtatttgtatttagcgcgaagctttagaaattacctttgtggtaacctgaatcagcatcaaatttaaattgtttcttgagtccgtttgttaagtagatctttttgtcgttggtaatgaagatggcttgaatgtgctgatcgtttttagcattcatatattgcaagccatctttgagtcccttgtcaaaagcggcgtttgacagcgcatcgccatccacgctttttttggaaacaatggtgactgaagctagattattgtcataaggataaccggttttgggatcaaaaaggtaaatgtatttatggccgtgggaaatcagatattgctcgtaggtaccggcagtgacgatcgattcatcactttccggaatggtgccaacagcggtgccgcgcgcggcagtcggatcctggatgcctacatgccagtcgcgtttggcacccagtggcgagtggcccatgacaaccacgttaccgccaagatcgataatggccgcggtgacgccatctttgcgtaacacttcgcggactttatcagccacccagcctttagcaatgccgccgaaatcaaggcgcataccttttttggtgagataggcggtgttgttctttgaatcaagcttgacatcgcgccagttaaccagcggtaatgcttggtcgatctcgctttgtgccggtacccgcgcccctggtaagccgatttgccacagattcgtgaccgcaccgatcgccatatcaaaactgccatttgagtttttggaaaagtaataagctttctccaatagcggcatgaagtcttttggcactttgaccggtttaatgccggcattgtcattgattttatcaagcaccgaaccaccgcgtgtcagcgtcgcttcatcgtcaacatggtggatcatgtcaaaaccatctttgagcgccgattttttgcctttatcataaatcgtcaaggtacaagtcgtacccatcacaaattcgttttgggtatatggcgttttgaggtaagttggttgggcctttttctggcagccggataaggtcaaaaggccgaaaaacgctattataccgataaaaaattttcgcatcatgcgtaaccctcgtttcatttttccctctagtatcataccgcgcgttatctaaaaagaaaaaccggtttgagctagttcgaagcagtttatcaatgtatcaaaaaatcggttccgagacgaaaggcgtgttggtgggccttttgttccgagaaccgattttggtgtagccttattcaatcgcgtctagcacaggtgagaagcgatcgggtttggtttaaaattgaatcaacttagtaccgtgcaattctttgacgcctaacttgtcagcaatcgccgcggcgttttgactggtgatcccgccgccgggaagaatcgtgatttgatccgcggcgtgagcgatcagcgtttgtaaatggggcagagtggactcgattggggtcgtgagcggtccgccatgcgttaagatgcggtcaacatgatgggccgccagccagtcgatagcggccggttgctggtcttcggggatagcatcaaaggccatatggaaaaccacactcatgccggcactcgcagcaatcagactggtcatcgcgtcttcgtcgatcaggccatctgcggttaaggcgccaaaagcaacgccgtcaacaccgagagcctgggcttcaaacaagtcggcctccattatttttaattcggtgtcattgtagacaaagtttccgccccgtggccgaatcatggtcacaaggctgcgaccatgttcgtgaacatattttgcactttccgccataacgcctttcgaaaccgttgtgccgcccaccgccagattatcgttaagttcgatgcgatcggcaccggcagctaaggcttggggaatatgcgtataattttcaacagcaacttctcgtaacataacatcctcctatggcataattaaaggaacatcacaagcaacacgatagcaccgagcgcgattcggtaccagccaaagggtttaaagtcatgtgtctggacgaatttaagcagccacttgatggcgacgatggcaaccaggaatgaaacgacggagccggttaacaagaccatccactgctcaccggtgaagccgttgccttgtagcaagtacttgccgatttttagaatcgacaccccaaccatggtcggaatcgccaagaagaaagagaactcggtcgcaacataacgggatgtaccgattaataaggcccccaggatcgttgcaccggagcgggaagtgccagggacaattgacagaacctggaaaagaccgatcaacagcgctgtttggtaagtgatgtcagccaatgtcgtgatgtgtgacggtttatttttgaggtagttttcaacgatgatgaacaaaaccccgtagacgattaaagtagtggcaacgacaagtggtgtatgtaaatgtttatccatccaatcgttgagcggcaggccaacgacgacggaaggcaaaaccgcaatgatgacttttgcccataactgccaggttgcgttttgttccttaacggttggcttggaaaatggattcagcttattgaaatataataaaatgacggctaaaattgcaccgaactgaatgacgtattcaaacatgttcatgaattcgcgtccctgagacaacttaacgacctgatcaaccaggtcaatgtggccggtggaacttatcgggagaaattccgtcagcccttcgacgatgccgataatcacggctttaataatatcaaacataataaccctccaattctcaatgttaacagtatacaaggttttagcccgcttgccacattgaagccgcaatttattgggatcttagagaatccggtggcagtggtggttgtgatggtcgaagacgggtacgggggatgtcgtcaaaaaaatcggacagcatttgctgaccgatttcatcatatgtggtaattaagcaggttccacgcgagttaaaaactcagttacttatccgctaagaacaagacattgacggcttccggtgtcgggatgtcgcgttgctgttccgtgagtgtaccggttttcggatcgcggctgtataaggttccgttgctggtattttgattgacggccaaaatgtaatgttcagtcaaatcaaaattgaagtcgcgtggaaagtcgccagctgtgctgatttgctgcaactgcgtcaaattgcggccgtcggggctgacagcaaagaccgttaagctgttgaaaccgcggttagagacgtaaagaaaacgttggtcactgctgaggcggatcgcggcggcaccattgtggtcggtatagtcggtcgggatggttggcaatgttgtaataagctcaaagctgccggtagcggcgtcgtagcttaaaacactgactttgctggataactcaccaagcagataggcgattggctgattgtgattaaaggcaatatgccgcgggccaaatccgggttcggtatggaagacgacgggatcgctgagtttgccggcatcgctaacggcataggtcgtcaaggtgtcgttaccaagatctacaactgcgagtcgctgaaaatccggtgtgactgccgcaaagtggacgtgcgcactgtcctgttccggacgggggccgttgcctgaatgaacgacctcatccgttgccgttagactgtggtcgcggttgattttataaacattgatgcggccttcgtggtagttactggcataaacgagctgacgattttcatcgatggaaacatgggcgggtgatgagccgggcgctaaaacccggttgatcaagcggggaggattagtattcagatcatagctggcaaccccgccttcatcaccttctgcatcgatggcatataaaatattgtcatcggatacagctaagtaggtcggtgagcctaaatcggaaatcagtggggtaggcgcagccaattgtccctgagtatcgtcaaaagtacctgcgtaaataccggcaccgccatggcgcgtataaccgcctaataagagtctttgcttcatgaaccgattgctcctttcgaatttatgttgagtatagcatgttttgactttgcttatgctatgatataaagcgtgacctgattggaaatagcggacgaccgggcgtggcagcaagttctagttagcgaacttggttgataagcgttgctttttccaggatgccaaagtaattattttacacttcaagaacgcataaaattttatggttatttaccgtgactggcttaacgagccggttcgcgctcaacaacaatcggaggctttaacatgcaatttaaggcaacagtaacggcaattggcaaggatgcattgagttccaaggatcccatgattattttgtttggaccgcaagcaacggacgcattacgtgacgtagcggtgattcagcaatttgctgatcccacatcacttgcgcagttctcgattcaagcaggcgatcggataacgattgacgagacaacctttacgatgacctacgttgggcaactggcgattagcaatctgaaagcaatcgggcacgtgaccttattgtttcaggatgtacctgcagacaagccaatgcaaaacgcgatttatctcaagcctacgcaccggccgatctttaaagttggcacgaccttgctgtacgaaacacagaacgagctgaagtagcggtttccataacgcacccataaaaaaacacctagcatggcttgctccgccaagatttggaggacaagccagctaggtgtctttttttaccaagatgccttgcgaacgccggggatctgacctttatgggccaaatcacggaagttcaagcgcgacatcttgaatttacgcatgtaagcatgtggccgaccatcaagctcatcacgactatgggcacgaacaggggacgcattacgcggtaacgcctgtaacgcagcataattgtgctcagccttatacttggcacgcagcggtgcgtatttggcaatcgtcgcttcaatctttttttccttggcaatctttgactttttagccatgtatgctatcactccttgtttgtggtttgttttttaacggttatattcgaacagttcaacccacttagcatagcacagccgcagtcgactcgcaatacttacaaaaggtaagctttttagtattgatcaccattaaaaattgaatttttaacgatgacgtaatcaactttggttaaggcttcaaggtcgcggccaccagcataggaaacagcagactgcagatcttcctgcatttcttttaacgtgtcgccaatcttacccttcactggcaaaagaatcttcttaccttcaacgttgtggtgggtacctttttgatattccgatgcggaaccgtaatattcctggtattctttgccatcaatcgtgacgtgtttgcccggtgtttcctcatggccggcaaacaaggagccgatcatgcacatggtcgcaccaaaccgaatggacttggcaatgtcgccattattgcggatgccgccgtcagcaatgatcggtttacgggcggcttttgcgcaccagcgaacggcagccagctgccagccaccggtcccgaaaccggtctttaatttggtgatgcagactttaccggggccaatcccgactttagttgcatcggcgccggcgttttcgagttcgcggacagcttcgggcgtacccacgttgccagcaatcacaaaagcatttggtaggtagtgtttgatatgttgaatcatgtcaatcacaatttgcgcatgaccatgggcaatatcgatggtgatatagtccgggctcaattcattagctgccagtgcttcgataaaatcaaattcttcatctttgacgccgacactgattgaagcaatcaggccgcgcttcttcatgtcacggacaaaatccatgcgccgttccggttgaaaccggtgcataatatagaagtaatcgtgttcggccagccagatcgccaaaggttcatcaatgatggtctgcatattggcaggaacaaccggaatcttaaaggtgtgtgggccgaatttcacactggtatcaacctctttgcgtgagcgcaccacacatttgttgggaatcatttgaatgtcttcataatcaaaaatctgcatgccgttgttcatcggattcatcctttcgcaaaagccgaacattgttaagcatttttggcgttattcaaaacaccaagtgctaagatacgcgaatcaaatgtaaaagtcaatcaaaataggtcattttctttttaatgttcggattttacctagagaaaaagaaaagccggtgattccggctgggtaggacgcgctcaaaagtacttgttgcgccaaaattgaaaggccaggacaacggcgagcgcgatggagatggcaatagtgatgatccaactgactttcatatctgccagcggtaaatggacgttcataccataaaaagagaagaccagcgtcggaattgtcagtagaatcgagtaggaagttaaaaacttcatgacaccgttcatgttattgttgataattgacgagtaggtatcagcggtttcattgatgatggaattgctgatttgcgccatctcaactgcctgctgattttcgataagggtatcttctaaagaatcctgatcgtcttcgttgagatttaacggattggttcgtttgagttgttccaaaacattacgatccgtccgaagactcatcatgaagtaaaccagggaacgttggatgcccatcaacccataaagttcttcgttacgcaggttatgttgaagtttactttcaatggcttcgcgagctttgtttaggtcgcgcagataagtcaggtaactaatggaaatttgataaagaatttgaatcacggaacggctttggtgttcagggttaaagttactgatcttgccttcagaaaaaaggcttagcagcggaataggctcttcattgatcgtgatcaccgcgatattggtgataatgatggctagcgggcccgttttgtaaacgacttttttgcgtgcatcccgcgtgacggtgggcatatcaaaaataaataggtggctgtcattgtcctcatcaaattcgtaacgggcaccttcatcgggatcaagtccgtacagtaggaaagcctctgaaaggttggctttatcctgaagttgctgacgctcttccggtgtgggattgacagcattaatccagacgccggggcgaatacgcgattgcggattcagctggccggatttctcatcaaagcgataaattgaaagcatggcacgctccttggcttttttcttttagtttacaacaagcgccagtaatgtacagaagggaaaataatgcgaaaacgtgaagcaaaaattcaattagccgcgcagcaggagccactttttgcctgtccggtttgcggcaacgcgatgcggattgagaaggactcgctggtatgttcccaggggcatgtccgtgattttagtcgaaaagggaccgtgaactttttaagccagcaagtcgcaaccgaatatacagcgacgatgttggcagctagacggcgaatgcttgcggccggcttgttcaggccatttttggatgctatggcagcacatttgcaacctcatcaacgcttactggatgttggctgtggggaaggcactccgactgcttatttggcggaacaaaagcagcaggtggccgtgggctttgatatctcggcgccagcgattaacttagctggtagcttggcgacgccggctttatttgcggtggctgatttggcccatttgccatttgtcgatgctgcttttgacacggtgaccgatattttttcgcctggcaactatcaagaatttcgccgggtgttgcggccgaacggtcagttgttgaaaattattccgcgcgctgggtacctcaaggaacttcggaccggtttgtacgccggaaccgccaaggcaacttacgacaatcgcccggtgctggatcgctttttggcgacttttcctcaagcaaaaattcatccgattacgtatgactttccgttagcagccgatcagtttgccgatttgttgacgatgacgccattgtcttggcaggcaccggctgaacgtcgccgcgcgatgcttgcgaatccgctttcaagtattcacattgaagtcgatctgttaatcgttgcacatcttgtcaagtaaaggggttgaaaacgggggtagccggtgttaatattcttttaagctatttatttcgggcttttatcagggctagcttttgggtaattgataaaagtttgcgataaattacttcactaacgtatcgcttcgctgagtgcgctccgaagcaatgcgtttttttgttgcccaaaaacggccttgctcagagcttctcgttgttttgccactttgggtcatgaaacgtctgagatgccaaagcgaaaatcaattgagagctgaccacaaagttgcggtgatacggacggactgtgcgctgcaagtgtgctacactgaaagcacttgtgttgaagggacgataacatggcgaatcacatagttttatttgaaccgctgattccggcaaataccggcaatattgcgcggacctgtgccgcaaccaatagctacctacatctgattaagccgttggggtttgaaaccgatgataagcacttacggcgagctggcttggactattgggcgaaggtgcggattatttatcacgacagcctggatgattttatggacacagtcgcggatccgcagcacctgtatctcatcactaagtttgccgatcagacatactcagatcgcgattataccgatacggatgtggatcattactttttgttcggcaaagaaaccaccggattgccagagggttttatgcggcagcatgccgaccagtgcttgcgtattccaatgacggaaaatgtccgggcacttaacctgtcgaactgcgcggcgctggtggtttatgaagcgctgcgtcagcaacagtttgccggactggaaaccgttcatacttaccaacatgataaactgaagtaacttacctttaggaggcgcgaagatggaagcaaaacgttacccaattaccgtcgaatcatttcattatgatctcgttaaatcagacaccccggctaagaatgatttacaggttgcgatgcggcagattcagtggtctgatcccaaaagacaggaagaactgaaaaaaggcaatctttttgaaatgatgatcccgtttgacgttgttcctgataatagcggttttgaaatctcagggaagattacccagatcgttcaggtgatggactactttggtgaagccaatgaattgccgcaagaagaactgggtaagcttagccgaccgttagtcgaaacaattgaaacgttaacttatcaagtgacagcggtcgctttggatcaaggagttaatctgcagttcggggccagcgatgaacaacccggccagcattaatggcggttgatacttaaagaagcaaaaaaggcggctgcgtggctgccttttttaattgcggcttcagctcgtgtataataggcaggaatggaaggagtatcaacatggcacaaaaacgcggcgggcgcagaagtccgcgcaaaaagcgaccgactaaacaacagcagcacaccctgagttgggttggggcgctatttgtggtgttctcaagcctagcgtttttccgtttgggaatggttgggacggtgctggcgaatgtttttcggttagttgtcggcgacagtttccttgttgtgagtgccgcaacgattgtgaccggcatttggtttcttttagctgaccgcctacctaaactagcccgccatgtgtgggtaggattggcgattgtcctcattgccgcgctggttttgttgacgtcgatcacgatggcgaccttaaatgttcacagccattatcttttgaccacttggcggctgctgcaaaatgatttcggcctgatgacgaccgcttcgcaagttggtggcggtttactcggagctagccttttctcactactagcgccattgttgagcagtcttggtgcaacgattctggcatggtttggtgttgtcgctggtgtgcttgtatttctgggagtaggtgccaaccaggtttttaactggttgcaagcattgggacaggcttgcaagcgaggggtacttcaaattcatagcagcttcgttgatttaaagaaggaacacgccaagaaagcggcagcacgaccgacaacatcggcggtaaagcctaaaccagcggcagtatcgactgatactcaagcagatccggcttcggaacgagcggatgactttacaattaacgggcctgcgccggtaccgccagcaccacagagcgagacaccggcaagggttaccccgccaagttcaacggctgcgcatgtttcggcgacaagcccaaagcccgccgctgttcacgatccagaaatgccggccgcggattatcaactgccgagtttaaacatgctaaccgcgacgccgccagttgatcaaagtgctgaataccaagcgatcaagaccaatcgaaccaaattaaaagacacatttgaaagcttcggtgtcaaggtggctgtcaaaagtgccacgttaggtccatcaattacccaatacgagattcaaccggctgttggcgtgaaggtttccaagattgtgaatttatccgatgatctggccttggcgcttgctgctaaagacattcggattgaagcaccgattccgggaaaatctctgattgggattgaagtgccgaatcagcacattgcgaccgttggctttaaagaagtcatggccgaaacaccaaaagcaccgaaccatccgttggttttgccgcttggccgcgatgtcaacggtaaagtcgtgacgtttgatttgactaaaatgccgcatttattgattgccggggcaaccggttcgggtaagtcggtaatgatcaacgtcattttaaccagcattctgatgcgcgcgaagccgaccgatgtccgcttaatgttgattgatcctaagcgggttgaactgtcggtttataatggcgtaccgcatctgttgacgccggtggtcactgaagctaaaaaagcgccaagtgcattgaataaaattttaacggccatggacgagcgatatcaacgatttgcagcggctggtgtccgtaatatgaaggaatttaatcaaaaagttgccgccgatccggccagcgggcagacaaaaatgccctacatcgttgtcattatcgatgaattgagtgatttaatgatggtcgccggtcatgagattgaaacggcgattgtccgactggcccaaatggcgcgcgccgccgggattcatgtcatcattgcgacccagcgtccgtcggtagacgtgatcaccgggctgatgaaggccaacattccatcccggattgcgtttgcaacatctagcgggattgattcgcgcacaattttggatagtaacggcgcagagaagctgcttggccgcggtgacatgctattttcgccaatcggggcgtcaaaaccgttgcgaattcaaggtgcctttattccatcgattgatgtggagcgggtcgttaaggcgattacggatcaggtctcaccggcgtatgttgaaagcatgacacccacggaaagtgttgaaaccgagcagcaaggtgattccgaagacgagttatacgatgatgccaaggcgtttgtcattgctcagcagagtgcgtcgacatctatgttgcaacggcgttttcgtatcggctataatcgcgcggcgcgactcattgatgatcttgaggctaatcaaatcgttggcccaagcgaaggcagcaagccccgaaaagtttttgcgacaccagaatcggcaaccaatgctaatcagtcatgagggagactatgcaaaaagaaatcaagccgggcgtttggctcattgttttgccaacgacccaattcaaaacaacacgcattaatgttcagtttttgacgccattgcggcgcgcgacgatcaccaagcgcactttattgaccagtttattggaaacaaatagcaagcaatatccgacacaggcggcaatggcggcccatctagaagcactgtatggcgctaactttagtattggtgttgcgcgggaaggccgattgcaccggatcggggtcacaatgagcacggtcgatgatcggtttacggatcagccattgttaccgcaagcggtcgcctttttgcggtcggttctttttgcgccaaattttcacaacgatcaattcgatcaggtgacctttgatcgggaaaaagagaatctggatcattatctggctagtttggatgatgatcggcagacgcaggccgtgttgggcgtccagcgcttgtattttggggttgatcccgatcaggccattccgagttttggtacgcgggaggatttagcaccgctgacggcggcagatttgacggattactatcatcagttgatgagtcaggatcaggtgattattacggttctgggggatgtgcaggagcagcaggtggagaagctgtttgctgattggccgctggcagcgcgtgcccggacgatgccggcaatcgcctttgatctgcctccgcaccctgaagtgctgacccagacgaaaactgtggtggcacaacaggccaaatttgacttggcttaccatatcacaacggatttgatgggccccaagtatactgctgcgctagtggctgaggaattatttggcgggtccagcctgtcgcttttattcaccaatgtgcgtgaaaaagccagcttggcttattacgcaagctcgatgttagacgcgtttcgtggcctgatgttggttcaaaccgggattgaaggtaaagcccatgatcaggttgccgacttgattcagcagcaactggcagcggtcgttaatggtgacttttccgataagcttttgcagtcggttaaagacggaattttggatcatcaacgggcagcgtacgacagcccacggtttttgaccaatcaggcactgtatcagctattggtgccatatgcgcctcaagattttgaaagctttgcgcgccgtattcaagcggtggatcgccaagcggttcaggaagcagcagccggcatgcaacttcaagccacatattttctgactggggaggacagcgaatgaagacgcaatattttagcgatgttgacgaaaccttggtcacgacaacgctgcccaacggtttgcgactgcaggtcgtgccgcggccggcgtatcataaaagttatgcaattatgaccacggactatggcgcgatcgatacacgatttgccccagatggtaagaaaatggtcacttacccggccggtattgcgcattttctagagcacaaactttttgaaaaagaagaccatgatgcatttgatctttttggtgagactggggcctcggccaatgcatttaccagcgcaaccaaaaccagtttcctgttctcggcgacgacgcagttaaccaagaatctgcagattttgctggattttgttcaggaaccgttcttctccgaaagttcggttgccaaagaacagggaattatcggctcggaaattcagatgtaccaagacgatcccggctggcgtgtttatgctgggctgttggaaaatctttttccaaatcatccggcacacgttgatgtggcaggaactgcagacagcatcgcgcagatcacaccggaaatgctttatacgattcaccggattttttatcaacctagcaatatgacgttggtgattgtcggcaatattgatgccaccgaaatcattgactttgttgccgataatcaggctaagaagcatttcccggcaccacagcctattgtgcgcggcgtcgaggcggatttacaaacagctgacattatcccttatcgcgagttgaaaatgccggttagtcggccgaaaacgctagtgggcttcaaaggccaggtagcgatcccacagacaacggaagggtggcggtatcagctgaccatcaggctgttactggaagttttatttggcgactcatcccagctataccaggaatggtatgatcaggggctaattgatgattcatttgattttgactttaccaatcagcgcagtttcagttacgggcttgtcggcggtgataccgatgatcctcaagcgttgagtgccgccattaaacaggttttgctgcatgcaacggcgcagtctgatttgacgagcgagcgagtggaactgataaagcgggcttcgttaggcaagtattatgcggggttgaatggcctgaatggggtcgccaatcaattgagcgccttgagttttggccaggcacggctgtttgattttccgcagattttgaacagtatcagctttgatgacgtcaaggacctgattccccaaattttccaatctgacgccttaacggttttgaccatgcttccggagggtcaatcatgagatctgcactgattattggcgcttctggtgatattggccaggcggtcgctgcaaaaatggcggcagatggctggtcgctatatcttcactattatcgtcacgagaaaatcgtaacggatcaggtcaaaacctttcaggcggcctatccgcagcaggactttattccgctccagtatgatctgaccgatgatcagcatttagacaaattaaccgcgcaactattcagccttgatgcggttgtttttgctgccgggatgacttattatcatcttttcaaagaaacgaccgtacctgaaatgacggcgttgatgcgggtgcatttgttgacgccgatggtgctgttaaccaaggtggaacataagctggcacaatccggacatggccgggtgattttcattggttcggtttacggtggaaccggttcggcgatggaagtggcttatagcacggtaaaaggagcgcaaagtgcgtttgtcaaggcttatgcgcaagaggtagcgagccttggcatcaccgtcaatgtcgtggctcccggcgcagtgtcgactaaaatgaatacgcagatgtttgatcagtcatcgttagccaaggtccgggccgaaattccggcggctaggtttgcgaccccgcaggatattagttactatgtcactatgttaactgccgaagatgccgcttacctgacaggccagaccctttacgtcacaggtggctggcgcatctagcaaacaaaggatttcttaaggcttacagatggtttttcatgctatactaaaaatggttaataaaaaatagcgggtgaagaaaacatatggatgaaattgggcaaaaattacgggacgcccggattgaaaagggttataccattgatgatctgcaacagatcaccaaaatccaaaaacgctatctgattgctatcgaagaaggacatttcgatgcgctgccaggtgatttttatgtgcgtgctttcatcaaacaatatgccgatacggtcggtcttgatggcgatgagcttctaacgcagttccagcaggatattccggaaccacagccaaaagaatatgctgctcaatcagttgaaaataagacgcgcgcaacccgtgctgaagaagccagtccagtcaaccggttgcggcgttatttaccgcaaattgcagtggcagggattgtagttgtagcggttattgtcatttatgctgtgatgttgatgtcacaatcaggaccgaagcagacgataccggcagattctgaaagcgttgcggtttcgtctaaacgcagtagcgcaaagtcatcaaaatcatcgaagtcgtcaaaagcgtcctcaaagtccagcaaggcatccgcttcaagcagctccaagccatctgaaaaagcgtccaagcagaagaaagaaaagagcggtaaactcgatatttctgtcgcagctgctaatggcgcaacacaggcggttacgctcaaaaatctgccgactaccggcaacaagcttactttaggtgctaagggagcaacggcatgggtttcagtgattgtcaatggtacgaccacttggcaaggatccttaacatccggcaatacgcaagaagtctcactaccggataacgcatcaaccttccaagtccgttctggtaatgcaacggcaacaaccatcaaactgaatggcaaagacgttgatatttcaaacggaaccagcatcgtgcggacaatcaccttcacaaacagtaccagtgaaagcgaggggtcccaagaatgaatcttccaaacaagttgacgttgatccggattttcctaattccggtttttacgttgttgcttgcgtttaattggccagcgggttatctgaccattgcaggaaccaaagtggcggtcagctggttcattgcactgattattttcatcattgcgtcactcaccgactttgcggacggccatattgcccgcagtcaacacttgataaccaactttggcaagtttgccgatccattggcggacaagttgttagtcatgacggcctttatctttttaaccgctgccggccagattccggcatggggaacggcgattattctttggcgggaattggccgtgaccggcttgcggcttctgctttccaataaaggcgaagttctcgcggcagcgtggcccggcaagattaaaaccaacacccagatgtttgcgatcatttttctgatgttaaacaacgcgtggtttaacaacatcaatgtgccattcgcgttgattctcttctacgtcgccgtattcttcaccatctattcaggcgtggaatacttctacaaaaatcgcgctgtcttcgccgattcgtttggatcgagtcatgaataagtttggtaaaaacccaggtcaggtgatctgggttttttagtacgcagatttttgcgccagtgtgggctatgtaagccggtagtaggggaccacacagtcttgttggcaaaggctgttttgtgcaatcgcaggtagtaaaatggattgtaagcaaatagcagcgtttttaatgtgagatgcgtcacgttgcaatggcctttatccagaaaattttgatttgaaaaagggaaaaaagaattaaagtcgaactctattgttaggtgggaaagatatgcaggcagaaattattgctgtcggaactgaaattctgatgggacagattactaatactaatggcgcctatatggctaaacagttggccgctttaggcattgccagctatcatcaacaggttgtcggtgacaatgcgcaacgcctggctgatgcgatcagcttagccgaaaaacgcagtgacattgtgattttgatcggtggtttaggacccacaccagatgacctgacgaaacaaacgttggcggctcatctgaatttgccgttggttgaagatgcggacgccatggcaaaactggcggcgcgggttaaacaacagcaacggccgatgacgccaaataataagttacaggcgatgtatccgcaaggtgctgatatattggttaatcgcatcgggctggcagtcggtgcctgggtcgaacaacaccaacatgcctatgtactactgcctgggccgcctaaggaatttatcccaatggttgatcatgagctattgcctcatttggccaagtatagcggccatcatgaagcttttgtcagccgcgtcatgcgcttctttggtgttggtgaatcacaattggtgacggatttgggtgatttaattgccaagcagacgaatccgacactggcaacgtatatcaaggatcatgaagtgaccattcgagtgacggctagtggtgagacccagacagacgctgaagcaaaattggaaccggtgattcgcgccattatggatcgcgagggacgttacttttatggttatggtgatgataatagcctcgctaaagagttggtcaaggcattagcggcgaccgacaagcaaataacggcagcggagagcttgacagccggtgcgtttcaggcagctttgggggatgttcccggcgtctcgaattatttcaaaggcggttttgtgacgtacgccttagccactaaagcagcatttttgaatattgatgcgcgtgagttagcggctcatggggtagtgagtgaatttactgccaaagcaatggccgagcatgcccgtcagcgggctgcggccgatattgcagtcagttttaccggcgtggcagggcccgacacactggaaggccagccagcggggacagtttggatcggcttggcgcggatgggccaggcgccggttgcacaggtttatcattttcccggtggccgcaatgatgtgcgcaaacgcgcggttatgactggcatgatgatcgcattgaagagcttgcgggattaattttcggaacgattgaaaagttggagaggtagcaatgacagggggcggcaggaagtggcagacacagaacgacaagaagcgttagcaacagcactaaaaaagattgaaaagaattttggcaaaggtgccatcatgaaaatgggggacaaggctgatacgcgggtttcggccatttccagtggctcacttgcgattgacgaagtgcttggcgttggtgggttgccacgcgggcggattgttgagatgtacggtcctgaaagctcggggaaaaccaccgttgccttgcatgcggtggcaatggtgcagcagcatggcggaaccgccgcgtatattgatgcggaaaatgctatggatcctaagtatgcgaccgcgctgggcgtcaatattgatgaactgttgctctctcaaccggatactggagaacaagggctggaaattgctgacgaattggttgcttccggagcaattgatattctggtgattgattcggtggccgcgctggttccgcaagccgagattgacggcgatatgggcgatgcacacgttggcctacaggcgcgactgatgtcacaagcgctgcggaagctgtctggcaacatcagtaagacgaaaactattgccgtctttattaaccaaattcgtgagaaagtcggcatcgtttttggcaacccagaaataaccccgggtggtcgggcattaaagttttatgcaacagtgcggctggaaatccgccgttccgaacagattaaaaacggtgctgagattattggcaatcgcactaaaatcaaggtcgttaaaaataaggtggcgccgccttttaaagtagcgattgtggatattatgtatggccgcggtatttcgcaaagcggtgaactcgtcgatatggcggttgaaaaagacatcgttgaaaagtccgggtcgtggtatgcctaccaaggtgagcgaatcggccaaggacgcgagcatgccaaggcttatcttgaaactcatgaggaaatgcgtaaaaagattgaggggcaggtgcgtgaggcatacggaatgccgttaaaccaggtgattgaagtggaagatccggatgtatcggcgcgagcttcctaaatagcggtgacttggtaagtgattcggaagttgaatagtgagatctaaattgtacagacactagctggcggggttcaggttagtgtctttttgttttgtgcttggaggtgagggcataaggagtgtggggcaatccggttccaaaacgcgctcgcagtcgcagaaatctacgtgtaaggacatcaagcctaaatggctaaagaccgattcatgatttgttatagaggacgatgattggccgatactgctcggaaacgcgttcacaggcccagaaacctgcgtgtaaggacttcagccctaaatggctaaagaccgatccgtgacttgttatagaagataactactggccgatgctgcatggaaacgcgttcgctggcgcaggagcctgcgtgtaaggaccttggtcgcaatggccaaagaccggccatcacgcccaaggccgcttacactccagctcctaaacgcgccagctcacgctcttgccctgttgacaccttcattgccagcacgtaaactgatagaggtgtaataatttaaaaaagcatcaaagattttgatcaacaagatgattgaatcgcttagatgatgcggaggtgaaatgatgagttcagtaacactggtctcaataaccctcgcagcagtcatcgctttagcggtcggtttattgatcggatttgcacttcaaaagaagctccaccagaacagtttggatcgagcgacgcagacagcagaaggtatcattgaggccgctaaaaaagaagcagcgactttaaaaaaagagaaactgctagaagcaaaagatgagaatcatcgctatcgaacccaacttgaagatgaattgaaagatcggcgggcggaagtccagaagtcggaacatcgactgaatcagcgggaagatactctggatcggcgtgatgatacgctcgatcgtaaagagcagagtcttgctgaccgagaagcaaatttgaacaagcggcagcaacagttagatgaacgtgaacaagatatctcttcagaaatcagcaaacaacagacggagcttgaacgaattgccgagttaacgcatgaacaggctcggactcagatccttgatgaaacgcaatcggaattgacgcatgaacgcgctgttatgatcaaagaaagtgaagatgaagctaaggaagctgcggataagaaagccaaggtactgatcgcggatgctatccagcgcagtgcttcggatatcgttgcagaaacaacggttaccgtagtgaacttgcctaatgacgacatgaaaggccgaattattggtcgtgaaggtcgcaatattcggacgcttgagactttgacgggtatcgacttgattattgacgataccccacaagccgtcgttttgagcggttttgatccgatccggcgagagatcgcccggatcgctttggagaagctcattcaagatggtcggattcatccggcacgcattgaagaaatggttgataaagcacgcaaagaaatggatgaccgtatccgagaaattggtgaacaagccatttttgacgtgggcattcataacatgcatcctgatctgattaagattttgggtcggttgcattttcggacaagttatggccagaatgtcctggatcattcgattcaggttgcaaagctggccggtgtcatggctgctgaattaggagaagatgttaccttagcaaaacgtgcggggttattacatgatattggtaaggcactcgatcacgaggtagacggatctcacgttgaaatcggggttgagctggcaacaaagtacaaggaaccaaagacggtcattaacgccattgcatcccatcatggtgacgttgagccgaccagtgtcatttcggtgctggtcgccgccgctgatgctatttccgccgctcgcccaggcgcacggtcggaatcgcttgaaaattacctgcatcgcttagaaaaactggaagccattgccaacagtcatgctggcgttgatcacagttttgcgattcaggctggtcgcgaagtacgcgtgattgttcaaccggaaaagctctctgatgaccagagtgtgattttggcacgggacattcgcaatgaaatcgaaaaagaattagagtatccgggtcacatcaaagttaccgtgattcgtgaaacccgaaccgttgaatatgctaaataaacacgcggtgagccaacgctagtgattggatgctgggtgtcgcgtcaaaaagatccgcaagatgagcttgtcttgcggatctttttgtccccgattaacggctggtttgctgacgattttttgagtcacgatctgtccgcgaccgtcattccctattttgggcaaatggatatggtgcttcgcgatactcactctgaccgattgtcggtgaaaactgaccattcaaaaaatcattaatcaacgctaatgaagcctctagttggtcttcatccaagtacagcgtcatggtgaccttcacgccgtaatcaattttggcaatggtgaggtgatgggtggtcaaaaagtgttgtagcggttcaagatcggcgtaagggatctggaatgtaaccgttttttgcttgatgcgcgccacaatgccaatggtttcaatggcgttgttgacgttgccggcataggcgcgaatcagtccgccggcaccaagtttgatgccgccaaaatagcgggtcgtgacggctaccacgtcgcggatgtcgtggttcagcaaaccctccagcgtaggacttccggcggttccggaaggctcgccgttgtcacttgcccgctgaatctgactttcattgccgagtacatacgcatagacattgtgattggctttggcattttcgtggctgatttggtcaatgatggttttggcttcatcctcgctttggatgcgggctaagtgggtgatgaagcgcgattttttgatgatccgggtgtaatttcccgtttctttaatagtgagatatggcttggtcatgcgtaatctccttttgaggtgataaaaatggatcttgctggggcacaactcacccaagctgaactggcgcggttggctgtctctaatatagcacaggccaccgtggtaccggcattggttaaagataagggtcattggtgctgtcagcggtgtcgcagccagttgcccgtggcattgccggatggccgcttctattgtccggaatgcgtgacgctgggacgattgactgaccgggatagcctttatcgatttgaccaaccacatcagccagttggagacggtcgactgacttggcatggtacactcacgcctgaccagcaagcggcttcggatgcgttaatggcgagtgtgacggctggccgcgatcatctcatctgggcagtcaccggtgcagggaaaaccgagatgctatttccaactgtggcccgtctgatccagcaacaacaacgcgttgcgatcgtttcgccgcgaattgatgttatccgagaactggcgccacgatttcgggcagcatttgcaacgacaccgatcaccgtacgctatggcgggcattttgatcagaccgatagtgacttgctattggcgacggtgcaccagttgttgcgattttatcaggcgtttgacctgattgttgttgatgaggtcgatgcgttccccatgaacggcacgccaatgttgcatcaggccgttcagcaggcacgccgcggatcagtggcatatttaaccgcaacgccggatcgggtgttgaaaaaagcgttgcacaacggtctgggtgttagcaggctgtttcgccgatttcatgggcatcccttacctgttccgactattcgattgatgaatctgcaaaaagtgccacgccaacttccgactgccatgatcacatggattcgccaagtgcttgcaacggaccggatttgtctgttattcgtaccaaaaatcagctgggcagaacaagtcgccgacgtgcttcgccaactgggtttaaaaactgctggggtagccagtaccgatccacagcgggcggaaaaagtcatggcatttcggcaacggcaactcgatgttttggtcacgaccaccattttagaacgaggggtgacggtcacccagtgtgcagtgggggtgattgcagccgcagatcgggaattttcggccgcggcgttgattcagattgcgggccgtgccggacgggcggcggacagcccagatgatccggtcgtattctttacggatcgctatacgctggcgttattggccgctaaacgccagattgtgatgatgaacggaaggtgattgtatgcgttgcatcggatgtgatcgacccaccgaccgcggtttgcaactgacgactttatttgcgcatggaccactgctggcaccgagattatgccacagttgtttaagtcgcttttgcccgattaccggggagacctgtgccggatgcgggcgaatgcagcctaccgagcaactctgttcggattgccgcaagtgggaacgccaaggaacgctcttacataatcgggcgttatttgcatatgatgctagcatgaaagcgtggatttaccagtataaagggcttggcgattaccgactgcacgtggcgtttcaggatctgatcgcggcgcgtttgcggcatgctactgcgctcgtgccgattccaagtgagccgaagcactttgagctgcgtggctttgatccgattctcggtttatttggctgcttacgattgcggccgtggttgcgtaaaacggccaccgagcgaccacaagcccaaaagacccgacaggaacgcctgaagacaccgcaaagttttcatgttctggtgccggaacagacgttgaaccgggttcggcaaatcacactgctcgatgatttgtatacgactggacggactttataccatgcacgcgatgcattggtggcagccggttttaaaggaacaattgacgcgttgacattaattcgctgaattgcggcttttgttgtgtctgactgcaacattcgggtataatgaaattgaagattggaagggttttatcccagccaatcagcgtgtaagcatttggttacacgcaggaaaggggagaagttttatgctcacatacaatgttcgtggcgaaaacatcgaagtcaccgaagccatcagaaattacgtggagaagcgaattagcaaactgaacaagttcttcggaggttcagtcactgcgacggcgcacgtcaatttgaaggtttatccggataagacagctaaagtcgaagtgacgatcccactctcgtttttgaccctgcgtgcggaagaaaccagtcctgatttatacgccagcattgatcttgtaactgataagctggagcggcaggttcgcaagttcaagacgaagatcaatcgtaaatcccgtgaaaaaggctttgggcaaattgatgttgataccagtgcaccagctgagccaaagccagccgaagatgatgataatctgacggtggtacggacaaagcgagtttcattaaagccaatggattcgcaggaagccattttgcaaatggatatgctgggccacaacttcttcgttttcgaagatgccgatacaaatggtacgagcattgtttacaagcgtcgtgatggacgttacggcctgatcgaaaccaacgaataaataaataccctttaaacaaaaacaaggctgctgatttgccggcagtcttgtttttgtttggtaagcgcggcaaccatttgctttcattggctggcattaagtttggtggcattcatgttctgggcatcacgactgagttaaataaccgaaaatgtcatcatggtattttcaatctccccgtgaaaatgttaagatgttacaatgtatcaatgttagaatgattaaagtgtgttagattcacgaggtttcgacagagaggaatccatttatggccaatattcttagaaaatgggtcgaaagcgataagcgagagatcggtcgcctcggcaaaatcgctgatcaggttcagcgctatgaagatgaatatgcagcattatctgatgaacaattaaaagcaaatacccagaaatttaaagatcggcttgcagcaggcgaaactctggacgatattttaccagaagcttttgcaactgctcgtgaaggtgccaagcgggttttgggactgttcccgtttcgggttcagattatcggtggcatcgtgttacacgaaggtaatattgcggagatgaaaaccggtgaaggtaaaactttgaccgctaccatgcccgtttatttgaatgccttaactggtaaaggcgtgcacgttgttacggttaacgagtacctatccacccgtgatgccacggaaatgggcgagttgtacaactggcttggcttgagtgttgggctgaatctcaactccaagaacagcgatgaaaagcgcgaagcttacaattgcgacattacctattcaaccaacagtgaacttgggtttgattacctgcgggataacatggttgtttacaaggaacaaatggttcagcgtccgttgaattttgccattgtcgatgaggtggattccatcttgatcgatgaagcgcggacaccgttgattatttccggtggtgctgaaaagacaaccgggctctatattcgggctgatcggtttgtgaagacgctgaaagccgataccgattacaagatcgactggccgaccaagaccatttccctgacagaaagcggcatccgcaaagccgaaaagaactttggcttggacaacttgtatgacacggaaaatactgcgttgacccatcatatcgatcaagccttgcgcgctaattatattatgctcaaggatatcgattatatggtttccaacggcgaagttctgattgtcgaccagtttaccggtcgtgcgatggaaggccggcgttattcggatggcctacatcaggcgattgaagctaaagaaggcgttcagattcaagatgaaaataagacgatggccaacatcacttatcagaatttcttccggatgtataacaaactggccgggatgacagggacggcgaagaccgaacaagaagaattccgtgaaatttacaacatggaagttatttcggtgccgaccaataagccggtcattcgggttgattcgcctgatgttctttacccgacattggatgccaagttcaatgccgttgttgaagacattaaagaacgccacaagaagggccagccaattctggtcgggaccgttgcgattgaatcgagcgaacggttgagcaagcagcttgatgaagccaaaattccgcacactgttttgaatgcgaaaaaccattttaaagaagcagagattatcatgaatgccggccagcggggcgcggttacgatcgcgaccaacatggctggacgtggtaccgatattaaattaggacccggcgtgaccaaattaggcgggcttgctgtcatcgggactgagcgccacgaaagccgccggattgacaaccagttgcgtggccgttccggtcgacaaggtgatccgggttcaacgcagttttatttgagtcttgaagatgatttgatgaagcgttttggttctgaacgcatcaaagccatgctggatcgattcaaagtggctgatgatgatcaggtcatccaaagccgcatgatttcccggcaagtcgaatctgcccagaagcgggttgaagggaacaactacgatacccgcaagaataccttgcaatacgatgacgtgatgcgtgaacagcgcgaagtcatctacaagcagcggcagcagatcattgatgaaaacgagacgctgaagccagtcttgatggcgatgatcaatcgtacgattaccaggattgttcagacccacacgcaaggcgagcagaaagactggaatctggatgcgctgtatgcgtggatcaccgcgaacatggttgatccggagaaattcaagcgcagcgaactggatggcaagtcacaggatgagctgattggtttgctggcagatcttgcggaaacaaacttcaaacaaaagaataagcaactcggcgatgacgcccagatgcttgaatttgaaaaggttgttatcttgcgggttgttgactcggcttggaccgatcacattgatgccatggatcagctacgtcagtccattggcttgcgtggttacggtcaaatgaatccgttagttgaatatcaagaagaaggctatcggatgtttgaagaaatgattgcctcaattgacgatgacgttacccggctgttcatgaaagccgaaatccggcaaaatattcgccgttaacaatgaacagacgccccggcactgcaattttgacttgcggtactggggtgttttggggatagcggtagaaaaacgatagtcaagcagttggtttttaaccgtgctggctcaccataacgcgttcggtggcgcagaagcctgcgtgtaaggaccttgagcgtaatggccaaagaccgggccattacgctcaaggccacttacactccggcttctaaccgcgccacctcacgctcacttatttgggaaaggatttagacgatggaacttaatgttatgcgcaacaccttggccgccatgcggaccaaaataaatcaatttagggggtcactttgacctcgatgccttgaacgaacggatcactgaaaacgaaggcaaaatggctgagccgggcttttgggatgactctgaggccgcgcaaaaagtgattgatgccaacaatgcgttgaaggaaaagcatgatcgtttttatgcacttgaaaacgagttagaggatcttgaagctggtctcgagctgttgcaggacgaacctgatccggatctgcagcatgaagaagagaccaagattaaggatcttcaagacaagctcgatcagtacgaaatgcagctccttttgaacggcccgtacgatcacaataatgctattttggaaattcatcctggcgctggtggcacggaatcacaagactggggttccatgttaatgcgcatgtatcaacgctgggccgaccagaatggtttcaaagtggaagtggccgattatcaaccgggtgacgaggccggaatcaaaagcgtgacgctgcttattaacggtgaaaatgcctatggattgcttaaaagcgaaaaaggtgtgcatcggctagtccggatatcaccgtttgattccgctggccgtcgtcataccagttttgcctccgtggatgtgatgccagagctcgataattcaattcaggtcgacattcgcccggaagacgtcaaaatggaagtgttccggtctagcggtgccggtggtcagcatattaacaaaacctccagtgcggttcgactgattcatattccaactggtattgtcacctcaagtcaggcacagcggtcacaattccaaaacaaagcgaccgcgatggcgatgttaaaagccaagttgtatcagcgtgaagaagaggccaaacgcgccaaagccaaggcaattcaaggcgaacaaaaagatgtcgcgtttggctcccagattcggtcttacgttttccatccctatacgatggtcaaggatcatcgaaccaattacgaaaccggcaacggtaacgccgtcatggatggcgacctcaatccttttatcaacgcttatttacagtgggaactttcacagaaaaatccggattaaaactgtaatctgcctgaaaccttgctgacttaatcgcctgttatactgtctctagcttagaaaaaggagcaaaatgcatgattcaaatggaaaacgtgacgaagcaatacgcaaacggcgtcaccgccatcaaggatgtgaaccttaagatccaagatggtgagtttgtttacgtcatcgggcctagtggtgccggaaaatcgacgcttgttaaaatgctgtaccatgaattgatgccgaccagcggcaccattaaaattgataactttgacttttcgaccatgaagccttcagaggtaccattcttgcgtcgccacatcggcattgtctttcaggacttcaaactcttgccgcgattgaccgtgtacgaaaatgtcgcctatgcgatgcaggttatcgaagcgccggatgatgaaatcaaagatcgggtgctcgaagtactggggctcgttggcttggagcagaagttgcgccgttttcctgatgaattatctggtggtgaacaacagcgggtgtcagttgcccgtgcaattgtgaacaagccaaaggtactgattgccgatgagccaaccggtaacctagacccacaaacctccgatgaaattgtcgatatccttgaacgcatcaacgccaacgggacgaccgttattatggcgacgcataacaaggatattgtcaatgaacggcaacaccggctgcttgaaattgccggtggtcgtttagttcgtgacgaagaaggaggcacatacggcaatgaagagtaaagtctttttccgccatgtcaaagattctctgcgcagcttacggcgtaacggctggatgtcagttgccgccgtcagtgccgtgacggtaaccttgttacttgtcggtatttttatggcattaatcttcaacttgcaccatatttcgcaacaggttgaaaatgatgttcaggtgcgggtttatattgataaaaaaacaacagtcaagcagcgggatgagttaaaaaacaagctgaagaaacttgatcacgtcaataaagtgacttaccgttcccgtcagcaggaattggatacgattattggcggttacggatctcagtggcggatgttctccggcgatcagaatccgttaagcgacgtctatatggttaagacgaccagccccaaggcaacgataattgtgtctaaagaggcgcagaagctggatcatgttgttgatgccagttacggcggccggacagcgaagaaactctttaattctgtcgatcttgcccaaaagtggggactcggctttacaatcctgctgctatttgttgccgtattcctgatcaacaacaccatccgaattacgattctatcgcgttccgacgaaatcagaattatgcggttagtcggtgcaaccaattcctatattcggtggccgttcttacttgaaggggcatggaccggcttgttcggggcaatcctgccgatcgtcgttgtcgatgtcggctatgccgttgtctaccacagtttcagcatggctaacggcgccagtggctattcactttatgccaatatgccattcctattctggctggacttgatgttagccggcatcgggatcgtcattggcgcgctcggatcggtcatctcaatgcggcggttccttaagttctagagcattaattagtctatgaaagttaatctaatcaaatttacaaaatagactggtcatcattcacgaccacagtatataaacggacgtattctgcggtcggccctgtcaagttgacagatgaaataatataaaattttggtagcttttagatggccttattccagtattcttctggggtaa

SEQ ID NO: 306 - DNA, 43048 bp, Lactobacillus casei
tgtgtacttagatctgggcatagaaaatccctccatgatcatcagatgaattatgatatttcatctgacaaccataaagggattatcgcattcttcagtaaaggggatatgttcgtttttttgtttcccaagtataattcgttaaaggcattagggtaacagtgccaaagcggagcaatcgtaggccagatggggctcagcagtgaagtcattgttggcggtttaccgcctacaatgaggccgagcttcgagaccgcgtactttgcgggctcgaagtcgtgcccactgctctagcttcgcgtcgccaccctagctggccggagattgcggagtttggcacggcttggaacttattacctaaacttttttgtagacttcaataccgcctccgcatcactgagccatccccgattgcccaaaccttataggagcggcagttgatttctgctatactgtttacagtgaatagtggagggttacgaatggcagtgatcattgccttacttatcagcccggttggtttggcgttttggctagccttagggttgacgattttgtttgcggttcggcgcacgagccgtgaacgccaccagtacttgcgggcgattcaccccaaacatattgagattgcccggtttttttgggtaggtatcctgatcggtattgtggtatccgccatctcggttttggcacgacttcaggtcagtttagctgcgttattggcattaagcggcttgaccgtgattggtttgatattgtctgcatggtcgtttagtccatggtggctaggtcttgcaagtttggccacatttattcaaccagattattctgatacagatgggcagctagcagctaatttggcgcttttgatcggcctgctttggcttacccaggctgtgttggcgcggctgaatcgtggcgaccaacttgaatcgccggttattttggtagatcggcggcagcgaaaaagtgcgacgtttcgtttgcggcaattttactgggtaccgttgctggtaccggtggatcccgctcaggttgccggttcaccggtgttgactgtgatcattcaagcatttgcaatcgtcggcctgcctttgatcttaggtgcctcatttacggcacagcatgatcgggcgaagatgcattggcaacgcagctggccgtggtttgccggagctggaggcgcattagttgtatacggcgtcgctgcacgattactgttccttccagcacttgtgagcgccatcgtgcctgcatgtatcagtgttattcttggaatcgggttactctggcaaggccataaggtgtacctgacagtgacgcgcactgatcgtggggttgttttaatcggggttgtccctgataccccagcagcacaaatgaatttacaaccaggagatcgggtgctttcctgtaaccacatcgcggtgaatagcgccagcgaattgtacgatgccattcaaaaggaacccacttattgtcgcttgcggcttcaacaggcagatggcgagttacgtcttgccgaaaccgctattttttcaggtgcgccgcatgaacttggtatgattttattcccggaggagacagcatgaagaagatcttgattgttgatgacgagccagccatcttgacgttgctgcaatataatttagaaaccgaacactatcaggtggagacagcaaccgatgggcaagaagccttagacaaggtacgtagcgaaccgtttgattttattattctcgacctcatgttaccaagcctgagcggactggatgtcacccgcaagattcgtgaagataagattcagacacccatcatgatcctgacagcgaaggataatgaaaccgacaaaattgtcggacttgaactgggtgccgacgattatgtcacaaaaccgttttcgccgcgcgagattattgcacggatcaaggccatcgagcggcgtagtcagagtcaaccgcaaaccacggcgcgctccggtaacgacaatcagattaccgttggccaaatcaccatcgatccggaaaactataaggctagcaaagccggtcaccggctgcaactgacccctaaggaatttgagttgctggtttattttgcccagcgagtaggtaagaccctgtctcgtgacgctttgttaaatggcgtctgggggtttgattatccagccgaaacccgcatggtcgatattcaggtcagtcatttacgggataagattgaaacagatcccaaacatccggattatttaaagacagttcggggatttggttatcaaatggaggcaccacatgaataaacgggtttttcgccgtgcacttgttattagtctgctatcattggcaggcttttttgtgcttgtgacaacagtgaatcaacaaatcgttcaccaacaggcgcgtgatcttcgccgagtggccagaacttacgtgacgtctgatcatgatggcgttgatcgccaggcgctagctgaatcagaagctgcttttatcacgatcattccggataatcctcagaccaccagacagaaggtaatggctgatgcgttgcgtggccgccgcgccaaggcttttgtcacatcagtcaacgtttatggacggacggagcaggcttatctgtttcgggatcacgggcaatgggttgctgttagccgctataagtcaagtgtatggaccacggcgccagagcaattttggattctgacactgatcttcgcggccttaattgcgttgatcttactctggcttttccgatctgaacatcagtatcaggaagccatccggggcatgagccacaatctggatcgcatccgcgaaaaaaaggaacccgatccggtgattttgccgccgaagtcaccatttgtacctgtggcacagcgaatcaatgcgctcgccgctgaacaggcgcatctccgcgaaaaagtagctgtgcgccagtcgagctttgatcgcttaatcgacaacctacctttaggcgtcatgttgattgacacaaacaaagacgtcattctgcataaccatgccatgtcgcagcttttagggcatcagattccccaaccgcgtcacagttatctcgacgatgtcaaaacttacgcgcttgctcggatgatcgagcatacattccgccatgaaaagacccatcatcaggaactgaccgtcttggcgacccaaaagtcggtggacgcctccgttattccgttgaatcaaggcattagccggctgcaagtattggtgattttatatgatgtgacgtatcttcgccaggtggaaaaaatgcagctggattttgtcggcaatgtcagccacgaattaaagacgccggtcaccgcgattgccgggtttgcggaaactttgttgaacggggctaaaaatgatccggcgactctggataaatttttaggcatcattttcgatgaaagtaagcgactcacccagctaatcaatgatattctgacactgagccgaccggaaaccaatcaggcggtgcaggcgacagtcgccctcaagaaactggtcgatgacgccttgcacaatttggataaagtgattaaagataaacagattcgggttgaagtcgcgattgcacccgacttgcagattgttaccgacgaacgtaagctgacccagatcgtgcggaatcttttgaataatgctgtcttttacaatcgtctggccggtcacgtgacgattaccgcgcaagtcgtgggcgaccacttatcattagcggtggcggatacgggaatcgggattccggaagaagaacaggcccgtattttcgaacgcttctaccgggtcgataaggcgcgcagccggcacaacggtggcacgggcttgggcttggccattgtagccgagctggtgaaaagtatggatggccgggtcgcggtcaatagtcaggttggggttggttcaacctttaccgtaacattgccggtcggccaaaataatcgtccgacttaacgtcgatgtttacacaacctttacattcaacagcatgaacatttacacacagctgataagatggttggagcttgaaatggaggatttcgtgtgaaaaaaattgtgaccctgtttacgatcatgcttctggcgtttacagcaagtgcatgcggcagcagcagtaatagcaaacagtcaggtgaatccatcaccgcagttggatcaagtgcgttgcagccattggttgaagcagcaggtgaacaatatcagacggaacatctcggcgtctttatcaacgtccaaggcggcgggagcggcaccggattgagccagatccagcaaggggctgttgatattggcaattcggatcttttcgctgaagaaaaaccgggtattaacgctaaaaagcttgtggaccataaagttgccgttgttggcattgcgccgattgttaacccggacgtcggggtcaagaatgtcacgatggcccaattgcaacagatctttctaggccagatcaccaattggaagcagttgggcggcaagaatgtgccaatcgtcttggttaaccgggcgcaaggatccggaacccgggcaacgtttgaaaagtgggtgcttcaaggcaagcagccggttgccgcgcaagaacaggattcgaccgggatggttcggcagattgtcggcagtacgcctggggctatttcgtacgttgccttttcctatatcgataaaacggttcagagtctgtcggtagatggcgttgcgccgactgataccaatgtgacaaccaaccggtggcggatctggtcgtatgaacacatgtacacgaagggccaaccgcgcgggctaaccaagcaattcttggcttatattatgtcatcaccgattcaaaaaaagctggtgcagaaaatgggctatatcccgatgacccagatgaaggtcgtccgtgatgccagtggccatgttagcaagcaataactgcacaatggcagctttttgacgggcactttgcagccgagtgcgatgtgaatgtgacgtttggcaaccgaagtacacggatcgttgtcaaaaggggccatttattgacatgcacggtcacggtgatgagattttaggaggattatgatggatccaattcgagaagcgatgttaaaaaaatcgcgttcagccaagttagagcggcgcggcaaaatgattagcctattttgtatcaccttgattgtgattgtggtggtggccatctttttctttgttgcatctaaaggactggcaacctttttccaaaacaaaatcaatccttggtcgttcttgactaagagtgtttggaacccttcgattaaggatgctcatgggaatcccgaagtcggggctttgccgatgattgtcggctcgtttggcgtcacgttcctttcggcaattatcgcgacgccttttgcggttggtgccggcatttttatgactgaaatttcccgtaaatgggggcaaaagattctgcaaccggtcattgagcttctggttgggattccgtcagtggtttatggctttatcggattgtccgtcatcgtgccgttcattcgtcacatttttggcggcaccggctttgggattctggctgggacgtttgttttgttcgtcatgatcttaccaaccgtgacgtccatgacggttgatgccttaaaagcggtgccgcgccattatcgtgaggcatcgttggcgttgggtgcgactcgctggcagacgacttatcgggttgttctgcgagcagccattcccggcattttgaccgggatcgttttcggcatggcgcgggcgtttggtgaagccttggcggtgcagatggtcatcgggaatgcggccttgttgccaaagaatctggtgtctccggcctcgacactgacatcggttttaaccagcggcatcggtaataccgtcatgggatcgcttgacaataacgcgttgtggtccttggcgttgctattgctgctgatgtcattggcctttaacctgttgattcggtggatcgggaagaaaggggagctgaacaaatgaatccgaaaattgcggataaagtagctaccacagtgctttacattatctcaggcatcatcattattattttggcaagcctgcttggttatattctgtttcaaggggttccccatatttcctggcactttctgacaagtccggcgcaaagctttgaggctggcggtgggattggcattcaactgttcaactcgttttatttgttactgctggccatgttgatttcaacgccgatttccttgggggccggcatttacttgagtgaatacgcaaagaaaaactggttgacggatgtgatccggacttccattgaaatcctgagttcgttgccatcagttgttgtcggtttgtttggtttcctgatttttgttttgcagtttaagtttggattttcgattttgtcgggtgcgctggcattgacggttttcaacttgccactgttaacgcgaaatgttgaagattcattgcgcggcgttggcaatgagcagcgcgaagcaggcttggcccttggactttcacgctgggaaacggtgttacatgtcgtgatgcctgaagcgttgccggggatcattaccgggatgattcttggcgccggccgtgtgttcggtgaagctgcggcattgatttatacggctggacaaagtgcgccggcgcttgattttaccaattggaatccagcgaacattgctagcccgttgaacccgttccgcccagccgagacgctggcggtgcatatctggaaaatcaactctgaagggattcagccggatgcggttgcggtttccgccggtgccagtgcggtgctggttatcgccgttctaatcttcaatgtgggtgcgcggtattttggtaatcgtttattcaaaaagatgaccgccgcttaatgcgtggttcacgatgatgatttgcgcggatgacgtgatgaagatagtcatggcgcctatcatgaaaaggcatggagggtcaagatgcaagaacttgaaaagtattctttagatgatacgtatatccgcccgtttgatcgggacaagcaggagattgccattgaaacgaaggacctgcatgttttttatggcgacagtgaggccattcacggcgtatcgctgccttttgaacggtataaaatcaccgcattgatcggctcgagtggctccgggaagtcgacctacttgcgttcgctgaatcgaatgaacgataatattgaaagtgcccgtgtcactggcaagatcatgtatcgcaacatcgatattaacagcgatgccgttgatgtctatgaaatgcgcaaacacatcggaatggttttccaacggcctaatccgtttgcgaagtctatttatgacaatattgcctttgcattgcgccgctttggtcttaaggacaaaaagaagctggatgagattgttgaaaccagtttgaagcaagccgccttatgggatcaggttaaagatgatctgaatcaaagcggcatgtcgctgtcaggtggtcaggcacaacggttgtgtatcgcccgggccattgcaatgaagccggatattctgttgcttgatgagccggccagtgcgttggatccgatttcgacttcagcggtcgaagataccttgctagcgttgaaggataagtatacgattatcatcgttacacataacatgcagcaggcagctcggattagcgactataccgcgttcttttatagcggcgccgcacttgaatatgatgaaacccgtaagatcttcacgcgtcccaagattaaagcaaccaacgattatgtttccggacatttcggctaggaggtccccatggctgaagcacaaaaaatcattaccagttcagatgttcatcttttttacggcaagtttgaagcactaaaagggatcagtctggatttcaaccagcacgaaatcacggctttaatcgggccttcaggttgtggtaagtcgacctatttacgcacgcttaatcggatgaacgatctgatcccaggcgtcacgattaccggcacgatcagcttgcgtggccaaaacatctatgcgccaagcgaagatgtggttcagttacgcaagcaagttggcatggtgtttcaacaaccgaatccttttcctttttcgatttatgaaaatgtgatttatggattacgtttggccggtgttaaagataaaagtaagctggatgaagccgttgaaacaagcttaaagcaagcggccatttgggatgaagtcaaagaccatttgcatgacagtgcgttatcgttgtcaggtggccaacagcagcgggtgtgcatcgcgcgggtgctggcggttaagccggatgttattttgttggatgaaccgaccagtgccttggatccgatatccagcactcagatcgaaaatatgttgctgggcttacgcgatcagtacacgattattttggtaacgcacagtatgcatcaagcatcccgaatctcggacaaaacggcctttttcttaaccggtaatttgatcgaattcgctgacacgaaacaaatgtttttaaatccaaaagaaaaggaaaccgaagactacatcactggacgcttcgggtaggaggggtagtatgcgacgactttttgttgacgaattgaacgatcttcatgtacgtttttcggaaatggggatgatggtcaatgaggccatctataagtccgtgaaagccttcattaatcatgacaagagtttggcccgcgaagtgatccaggaagacaaacatatcaatgaacgcgaagtcgatttggaaaaacgcagctttgaactgattgctctgcagcaaccggttacgacggatctgcgggtgattgtgacggtgatgaaggccagttctgatctcgaacgaatgggcgatcatgcggtttccattgccaaatcaacgattcgcgtcaagggcaaaacccgggtgccgcaaatcgaaaccgaaattgccggcatggccgaagcggtcaaggaaatggttgagcaggttttggacgcgtatgttaaggaagactccgcgcgagcccgaaaaattgcgcttgaagaccacgggattaacgacttctcatcccgaatttataaagaatgtatccgccagatgcaggacaacccggaaaccgtggttggctcgatggactacatgctcgtctcctcttatctggaacggatcggcgattatgtcaccaacatctgcgagtggattgtttacttaaagaccgggaaaatcactgaacttaactccaatgcgattgaagacaagttctgatgaagggacacttcaacaacggggattgttaaaagtgctcagttagtatttatgctcaatcaacaggcaggaccataaattcacagctacagcaaaaagcaaacatgctctgcgataacgagggagtatgtttgcctttttgtttccctgaagtaatctggtgggtttatttaagatatgagtgccaaagcggagcaatcgtaggccagatggggctcaggagtgaaattggcattaaacgggcggttttcccgttttaggccaaggccgagctttgagactcagccgggcttgctgaggctcaaagtcgtgcccacccctctagcttcgcggtcgccagccccatctggccggagattgcggagtttggcacggcttggaacttattgcctaagctttttcgaccgttcagaatcaaactatgagcgcacctactaaattatgatttaacctcgttataaatgaaccgtccgccttccgtcccgtttaaaaatcaacctttggacctatgcgccgtggtcaaattccgtgcatactaatcatgtaatcaaatcctggagggataacccatgaatgaacgcgaaagaattttagacctcgtcaaaaaaggcgttatttcaagcgaagaggcactggtacttttggagaacctcgccaaacagcaaggctcccaagccgacagcccggccgatcatactgctcccgaagatgactcggagtcagatacgcatgatcaagccaagcacgatgatcacgaagaaaccgatactgacaccgatgctgcgttgaccgaactcaacaccgagattgccgaagcagccggtgcattggacgcggcaacaacgcaagtaaccagcatcaacaagcaaattgaagccaataacgaacagattatcgtcttagacacgatggaagatcttgaagctttgtccccagagaaataccaaaagcgcggggaattaaagcaggagaatcagaaactcaccgatcaactagccgagttaaatggccaggttgagtcacttaaagccaaccttgccacccttcgtcatcagaaacatgatctggaacgtcaaaagatcggcgacaagattttcaatgacgagtggcaaaaagatgcccgtgacgtcttttccgaacttggtaaaaatatcggggatgcgacctcgcaaatcggcggttttgtcaaagatactgtcaacaatgtcttggataatgtcgattggaagaatgtcaccgttaccgttcctggcttagccacagagaagttcgagcatgtatttaaatttcctgacagtaaggcaaccattttggatgtgaaggttgctaatggtgacgtgcattttaagccttgggatcaaccgggtattcaagtcgaagcagccatcaagctgtacggcaaaatggatgcaccgacaccgctggacgcgtttaacgaccgcagccggattgatgtcaccgatgatcatttcagtttccaggtgcctaataagcgcgttcaggccgacctagtcatttcactgccaaaacgcagctatgatcatgtggctgtgcgcttactcaacggtagtgcggatctgaccggcatgaccggaaaagatttctatgttaagagcaccaacggtcaaatgaccttcaccaatattgatggtgtcatgatcgagagtgaaggcgtcaatggttctatcaaggttcagggcgggcacacacatgatttattgctgaccactgtcaacggcgacgtttcggttgatgccgacccagcaacggccgcactgaaaaccgttaatggaacggttcgtgccacctatcagaccgactttaccaaactcgaagggacttcgatgaatggcaatgtgaaagttgccgtaccggcttcgattgccttgaatggcgaagcccggacccattttggcagtattaagagtcggctgagcaatgtcaccgaaccggcaaaaggtatcaaacgcttcgaattggagcggccgggcactggcagtagcgagctgaaactcaataccaccagtggtaatattcaactgaaagattcaaatgactaagggggatcgcttatgccttttctattaattccattaatgtttttcatcgttggcttggttttggtggcggtatttgcgatcgggatcatcttgttgaaaatgttaatcgtaccggcacttctggtggttttggctgtatggctattctcgcgccatgaccgtgatggccgccgtggtccacggcatccatatcgcgatcaaggtacgtcgcgaccgcgtaaaaacgccacccacgttaccgagtcacatgatgatgattggagcgatttctagtcatgaatttcatcaaacgtaccatcatcacaaccgccgttttcttaatctatgcgcaactgtttcctagtcaactctatgttgcgggctttggtgtggccgttgtcggtgcgcttgttttaggagttcttaatggcttgctacgaccaatcctggtgattctgtcgattccaattacaattctcacgttagggttgtttttaatcgtcctcaacggcttgatgctcagcatgatgacatggttcgtgtccggcattgttttcagcagttttggctcaaccatgatgctggcgatcatcatctcggtgatgaatatgatttttgtaggtaaaaaatagcgcagcttgatcagcagttgcgccagaagttggtcctcgagacataaattgtccgggggtctttttttgggctaatgcaacctttcttgaccatattctgacggaaccaaacaactttggcgtcggtttttacctgtcgctcccgtgtggttcactgagttatggtaaaatgaagcaaacatggcgaaagaaaggtggacttcatggcagacagcgtgacggtacggcaactcgtcaaggcgactaagcttgaggtatatagtggtgaggagtatcttgattctcggcaggtcgttttgagcgatatttcgcgtcccggactcgagttgacaggttactttaattattatccgcatgaacgtattcaactttttggtcggacggaaatttcatttgcgcggaatatgtcctcggaagaacgtttactgattttgaaacggatggccaccgaggacactccagcttttctggtgtcgcgcgggttgcaaccaccggcagaaatgattacggcggccaccgcggcgcatattccagtattgggttcacggttaccgacaacgcggctgtcaagcttgatcaccgaatacttagacggacagctggcggagcggcgcagtatgcatggtgttttggtagacatttatggcctcggcgtgctgattaccggtgattccggcgtcggcaagtcagaaacggctttggaattggttcaacgtgggcaccggctgatcgcagatgaccgggtggatgtttatcaacaggatgaacaaaccatcgtgggtgctgcgccgccgattctctcacatttgctggaaattcgcggcttgggtattattgatgtcatgaatctttttggtgctggcgctgttcgtgaagacacgaccatttcactcattgttcatcttgaaaattggacaccggataagacgtttgaccggttgggttccggtgagcagacccagcttatttttgacgtaccggtaccgaagataactgtgccagtcaaagtcggccgtaacttggctattatcatcgaagtggcggccatgaatttccgcgccaagtcaatgggttatgatgcgaccaagacattcgaaaaaaatcttaatcatctgatcgaacataacgaagcaagcgaccagagcagttcggaggaaaaataacttgttattagtactcaatccaatcgcgtttcagttgggtggtctggaagttcattggtacgggattattattgccagtgctgttttactggcagtctatctggcgatgaaggaagcaccaaaacgcggtattaaagaagatcacattctgaatttgattttatgggcgttgccatttgcactcatcggggcacgcctttattatgtggcatttgaatggccatattatgctgcccatcccggcgagattattgccatttggcatggcggcattgcgatttatggggctttgattgccagcgtgattgtttttgccatttattgccgaattgagtggctacctgcctggctcgtgttggacattgcggcgcctacagtgatgctggcgcaagcgattggccgctggggcaatttcatgaatcaggaagcccatggtgcgatcacaagtctggcttacttacgtggcttgcatctgccagagtttatcattcagcaaatgaatattggcggcgcatatcgccagccgacatttttgtatgaaagtatgtggaatctggttggctttgccttaattatgacggtgcggcatcatcagcattggttcaagcaaggcgagattgtcttgagttacgtgatgtggtacagcttcggccgtttctttgttgaaggcatgcggaccgattcactgtatgtggtgccaggtctgcgggtttcccagattctgtcgattattttgttcatcgtggctggtgcgttaatctggtatcggcggcgccggggagacgttgcgtggtatttagacggcaatccgctgaaagcagttgaataggagtgattttgtgccgacaaaaatagcagtgttaggtgctggttcatggggaacggtgttagcaaacttgctaacggaaaatggtcatgacgtttatttatggagtcatagtccggaacaagttgcgaccatgaagcagactcacaaaaatgagcactacctgggtgctgaatttacattacacgatgcgcttcacgtgaccgcagatttaggccaggcgttggaccaggcgaccgtgattttatttgtggtgccgaccaatgccattcgcagtgtggccgaacaagtcaagccgattttgcaggcgcaccgtggccgcggcgaacggccgattattgtccatgcggcaaaaggcttggaacgcggcagtgagttgcgaatttcgcaggttttggctgaggtcttgccaccggatctcattcagggtattgttgtgatttccgggccgagtcatgccgaagatgttgctacgcatgacattaccaccttaaccgccgcatctgaagatttaccgctggcgaaaaaagtgcaacaattattcatgaacgactattttcggctttacacgaataccgatgtgatcggcgtcgaaatcggcgcagcgttaaaaaatgtgattgccatcggcgccggtgcgttgcatggcctcggctatggcgataacaccaaagctgccttgatgacccgcgggctggcagaaatcagccgagtgggcgtaaaactaggtgccgagccgctcacgtttatcggcctatccggtgtcggcgacttaattgtgacttgcacttccgttcatagccgcaattggcgcgctggtaatgcgttgggtcaaggcgagaagctttcagacgtgttgaagaatatggggatggtggtcgaaggcgtttcaacgaccaaggtcgcccatcacatggcgcgtgagctgggtgtcgatatgccgattaccgatgcgatctaccaggtcctgtatgaaaatgccccgattcgcgcggtgattaccgatctcatgcagcgatccggcaagccggaatttgattttgataatgccagtttacaaaagcactaaaaccctgtatattagactacgtagcttactatttgtaagcaatacggcaaaaggagagactgcccatggcaaaaaaatatgatgtaatcgtgatcggtgccggtcccggcggcatgacggcggcgctttatgcttcgcgtgccaatttgtcagtgttaatgcttgatcgcggtgtctacggcggccaaatgaataacaccgctgaagtggaaaactatccgggttacaagtcaatccttgggcctgatcttggccaaaaaatgtacgatggtgccactcaatttggtgcagaatacgcctatggtaatgtgatcagtgttcagaatcatggcgcaaccaagttggtcaagactgatgaagacgaatttgaagccaaggcgattgtgattgcgacaggcgcagaacacaaaaagctgggtgtgcccggcgaagaagcttacagtggccgtggtgtttcgtactgcgcagtctgcgacggtgccttctttaaggatcgtgaacttgccgttattggcggtggcgattccgcgatcgaggaaggcctttacctgacgcaaatggccaaaaaggtaacggttattcaccggcgcgatcaattacgtgcgcaacagattatccagaaacgcgcatttgccaatgacaagatgcattttgtctggaatgcccaggttcaggaaatccaaggcgatgacatgaaagtcaccggcgtcaagtatcgcgacaaggaaaccggagaagagcatgttctgccagttgccggtgtcttcatttatgtcggcatcatgccgatgaccgaaccattccaggatcttggcattctggacgatcatggctggattccaactgatgaccatatgcggacaaaggttccgggcatctttgccattggtgatgtccgcgccaaagacttgcggcagatcaccacagcggtaggcgaaggcggtaccgctggccaaggcgttttcaactatatccaaagtttgaacgacaccaacattgaagttaaagcttagttatctttggtgtgccagaagtgatttgaagctaagagataggaaatggcggggacacagtttacggtcgaactgcaaaagcaaacttactttccgttgataagacggtggtaagtttgtttttgtttactcatgaataatttgtcaggtctcttgagatctaagtgccaaagcggagcaatcgtaggccagatggggctcagctgtgacattgtactagccgggtgaacttcccggcgtagtacaaggccgagcttagagactctgccgcttttgcagaggctctaagtcgtgcccacagcgttccagccccagctggccggagattgcggagtttggcacgacacagaacttattgccccaatatttcaatggatcgcaaaagaattttcttatttgagcgcgttttcaaccaagcgttggttacttatagtatgattggaaagggaagggctgtacccgaaattattaatttagacagataggagctgatcacgtgagttaccgtgatacgtaccaacaatgggttgatgaaccaacacttgatccggagctaaaagctgatcttaagaaaatggctgacgacgaaacaactaaggaagaggcgtttgctgcccccatggcatttgggactgctggcatgcgcggcgttcttggtgccggcattggccggatgaacatttatacggtacgacaggcaactgagggcctggcgcggtttatggacaccttaacggatgaaacgaaggcacgcggtgtggccattagctatgattctcgctacatgagtcaggaatttgcttatcaaagtgccggtgtgcttggcgctcacggcatcaagagttatgtgtttgaccagctgcggccaacaccggagttgagttttgcggtacgtcatttgaagacttacgccgggattatgattacggctagccataacccgaagcaatacaatggctacaagatttatggtccagatggcggtcaaatgccgccggaagaatccgacaaaattaccaagtacgctcggtcggcatctgatctttttgcgattaaagcattgaatgttcacgaattgcgggccaagaatttaatgcagccgattggtgaagacgttgatgaagcctattatgctgaagtggccacagtgacaatcaatcctgacttggtccacaccgtcgggaagaatatgtcattggtttatagcccgttacatggtactggccgcattccggcacaaatggttttacgcaatgccgggtttgaaaacttccgcttggttccggaacaaagcattgccgatccggaatttgcgacaaccccgttcccgaaccctgaatttgcccaagtctttgacttaccaattgcattgggcaagaaaatcggtgcggatgtgttgattgccactgatccggatgccgatcgtttgggcactgcggttaaagtcggcgaccactatcagttattgactggtaaccagattgcttccgtattgctgcactatattctcgaagcccgcaaacaagctggcacgttgccgaaaaatggggcggttgtgaagtccatcgtttcaaccgaattggcgacggcgattgcaaaagattacggcgtggacatgatcaatgttttgaccggcttcaagtttatcggggatcagatcaagcacttccaggccacaggcgagcacgagttcctctttggctttgaagaaagctatggctacctgatcaaaccattcgttcgggataaagacgcgatccagtccacggtcttgctggctgaagtagccgcttactaccagtcacaaggcaagacactttgggatggcgttcaggaactgtacaagaaatacggttattatgctgaaaagacggttggcgttgattttgaaggcgttgacggtccaaagcagatggccaatctcatgacgaagttccgcgaagagcagccggatgattttgccggtgtcaagattgctaaagtggaagacttcctgagtcaagaagcgaagttggcagacggcacggttgaaaaattgacgatgccttctagcaacgtactgaaatacattttggaagacggcacttggattgcaattcgcccatccggcacggagccaaaagtcaaattctatgttggcaccaaggctgagaccgacgcaaaagcacaggagaaacttgaggccttcgaaaaagccttgaatgattttcgtgaagaagcctaaaccaatcagcgtggtaaaggtgttttctgcgtaagcttaaatagatcctgacgaaacattcagggtctatttgtttgcattcacttcaggacaaccaagtcccaaaatgtgaaacaccttgcaatggtctggctatggtggtagtcttttagcaatttaagtaattttttgatcgtcacaccaaataacaggaggtcattttgacatgggcatgcaccaatttatccaaggactgagtaatctggagacactgcggcgggcaccgggctttttcaagtatcaggagcactcggtggcggcccacagcttcaaggttgcggaaatcgcgcagatgctgggcgatgtcgaggaattggcggggaacaaggttaattggcagatgctctacgaaaagtcgctgaaccatgattacacggaacgtttcatcggcgatatcaaaacgccggtcaaatatgccacgccgacattgcgacagatgcttgctgacgttgaggccacgatgacggagaacttcatcaaaaatgaaattccgcgcgattttcaggatcgttatcgccgtcgtttgtctgaaggcaaagacgacacgcttgagggccaaatcttgagtgtggccgacaaaatcgacttgctttacgaaggatttggcgaaattgaaaaaggcaatcctgaacaggtctttcttgacatctacacggaaagcctgagtactattctggaatttaagaatcgaccaagcgtccggtacttcctcgatcaggttttgccggatatgctggaagaaaagtttgccagtcgtgatcaattggccaaattgaccaaagcaaccatggccgaacacgagccaagtaagtagcgaaagtatgttcgctatgttataatatgcgagatgaaagttggaatgcgtttcaaatcggttccaacttttttgatgaaaaattttggtacaacggcgggacaccgcatacaaatggatgttaatgcgcgtgggaatagccacgcgtcacatgttgattggaggcatgtcgatgatcgaacgaatcgctgatcgtaaatttgatctggtttcaccttatcagccggctggggatcagcctcaagcgattgccaagctgacaaagggatttgaagaaggcaagaaagaacaaatcctgttaggtgcgaccggaacggggaagacgtttacgatgagcaacatcatcgccaacctgaataagccgactttgattttatcgcacaataaaaccttggcgggacagctctatggcgagtttaaggaattcttcccgcataatgcggttgaatattttgtctcttactatgattattatcaacctgaagcctatgtgcccagcacggacacgtatattgaaaaagacagtgctattaatgacgaaatcgacaagttgcggcatagtgcaaccagtgcgttacttgaacgaaacgacgtgattgtggtggcgtcggtatcatctatctttggcttaggtgatccgcatgaatataaaaatcacgtgttatcgcttcggaccgggatgacgattgaccggaatacattgttgcggcaactggttgatatccagtttgatcggaatgacattgattttcagcgtggccgttttcgggttcgcggggatgttgttgaaattttcccggctagccgtgacgatcatgccattcgggtcgaatttttcggtgacgagattgatcgaattactgaagtggacgcattgactggcgaagtcatcggcacgcgggatcatgttgccattttcccggccacccactttatgaccagtgacgaacagatgcaacgcgcgatcaagagtatttcggcggaattggaagaccgactgaaggtgttgcgcggcgaaaacaagttgcttgaagcgcaacgcttggaacagcggaccaactatgacattgaaatgatgcgcgaaatgggcttcaccagtggcatcgaaaattattctcgccacatggatggccgcaaaccgggtgagccgccgtacacattgttagactttttcccgaaagactttacgatcatggttgatgaaagccatgtcacaatgccgcaggttaaagggatgtacaacggtgatcgggcgcggaaacagatgctgattgattatggctttcgtttgccaagcgcgttggacaatcggccgctgaagatcgacgagtttgaaaagcacgtcaagcgcattttgtatgtcagtgccaccccagggccttacgaattgagtcgcgtacccaaagaagatattgctgagcagattattcggccaaccggtttgctggatccgaagattgaagtgcgtccggtgatgggacaaatcgatgatctggttggtgaaatcaacaaacgcattgatgctcatgaacgggtcttcattaccactttgactaaaaaaatggcggaagatctgaccgattatttgaaagatatgggaattaaagtccgctacctgcacagtgatatcaagacgctggagcggacaaagattattcgcgatctgcgacttggtaaatttgatgtgctcattggcattaaccttttacgtgaaggcattgatgtgccggaagtttcgctgattgcgattcttgatgctgacaaggaaggattcttgcgggcagaacgatccttaattcagacgatcggacgggcgtctcgtaatgagcacggtaaagtgattatgtatgcggacaaggtcactgattcaatgaaggccgcaattgatgaaaccaagcggcggcgtgcgattcaggagaagtttaacgaagagcatcatattcagcctaagaccattatcaaaccgattcgggcagcgatttcgacttacgagcaatctgacgatgagaaagccgaggccaagaagacctttgccgaggttgattatgaagacatgaccaaagccgataagaaagaattggtggccaacctgcgttcacagatgcaggcggcggccaagaaactggatttcgaacaggcggcatcgttacgcgataccattctggaattgcaagcggatatgtcttgagatttttgtaacgaacttgcatgatgaaacaaagtcagccatgattaccttgattagatccggcgatcgtggctgttttgttgtcgtgatcctggcgttggatgagacgcaggaactgatccgctttgtcgtgccagatggggtgacgttctggccacgggcggcttgttttaaatgaggagattttttgtgaatggcaaatgataaaattgtgatccatggggcgcgtgcccataacttaaaaaatattgacgtgaccattccccgtaacaaactcgtggtcatgacggggctgtcaggttctggcaagtccagcctggcgtttgatacattatatgcagaaggccagcgccggtatgttgaaagtctgtctgcctatgcccgccaattcttaggccagatggagaaaccagatgtcgactcgattgatgggctcagtccggcgatttcgattgatcaaaagacgacttccaagaatccccgttcaacggtcggcaccgtcacggaaatcaacgattatctgcggttgttgtgggcgcgggtcggtcatccgatttgtccgaacgatgggacaccgattacgagccagagtgtcgaacaaatggtggatcgcgtcttagcactaccggagaagagtcggattcaaattttgtcgccgattgtgcggcgcaaaaaaggcagtcataagaaagtcttcgccaagattatgcgtgaaggttatgtgcgcatgcgtgttgacggtgaagtcatggacgcgacggccgactatgagctggataaaaacaaggcccatgatattgatatcgtgattgaccggattgtggtgaagcctgaagcgcgcagccggttgtttgattcattcgaagcggcgttacgtctgtcggaaggttacgccaatgtcgatgtgattggcggcgagacgttacgtttttccgaacattttgcctgcccgatttgtggctttaccattagtgaaatggagccgcgcctcttttcgttcaatgcgccatttggtgcctgcccggaatgtgatggcttaggggttaagctcacggtcgatatggatctggtcgtcccggatccaagcatgaccttggcacaaggcgcgattgctccgtggaatcccatcagttcccagtactatccggaattgttggaacaagccgcaacggccttcaaagtgcgcatggatgtgccatttgagaagttgaccaaacgggagcgaaccgttgtccttgatggcagtaacggtaagccgttccattttcattatgaaaatgattttggcggcgttcgggatgtcgatgtcccgtttgaaggggtactgaccaacatttcccggcgctatgccgagaccaacagcgattttacgcgccaacagatgaggagttacatgactgcattgccttgcccggtttgccatggcaagcggctgaatcggcaagcacttgccgtgaaaatttccgggcgtgatatcgccgaagtttccgatctggccatcaaagacgccttaccattcttcaagcagattcatctgagcgaagctgaaagtgtcatcgctcagccaatcgtgaaagaggttgtcgatcgcttaacttttcttgtcaatgtcggccttggctatctgaccttgagtcgtagtgccggaacgctgtctggtggcgaggcacaacggattcggttggcaacccagatcggctccaacttgagcggagtcatgtatgttctggatgagccgtcaattggcctgcatcaacgtgacaacgatcgcttaatcgcgtctttgaaaaagatgcgtgatttaggcaatacgctcattgtggttgaacatgatgaggacaccatgcgggcagccgattacctgatcgatgtcggtccgggtgccggtgaccatggcggccggatcatggcggccggaacgcctaagcaagtggcgcgggtacgcaagtcgatcacggggcaatacctatctggccgtaagtttattccggtaccgttgaagcgtcggacaggcaatggcaaagtgatccgtttggaaggggctgccgaccataatctcaagcacatcaatgttgattttccattaggcaagttcattgtggttaccggggtttccggatcgggcaagtcaacgctcgttaattcgattttgcggcgagccttggcccaaaagctgaatcacaactctgaaaaacccggaccatatgataagattctgggttataaaaacatcgagaagctaatcaatatcgatcagagccccatcggccggacgccacggagcaatccagctacctacaccagcgtttttgatgatattcgcggattatttgcagaaaccaatgaagctaaactgcgtggctacaaaaaagggcggttcagctttaacatcaaaggtggtcgctgtgaaaactgtaaaggcgacgggatcatcaagatcgaaatgaactttttaccggacgtttatgtaccttgcgaagtttgtcatggcaaacggtataattccgaaacgcttgaagtgacgtacaaaggcaagaatattgcggaagtcctcgacatgaccgttgaagaagccaccaactttttcaaaaatattccaaagattcgccgcaagctgcagacgattgtggatgtcggtttgggttatgtgaagctgggtcaaagtgccacaactctctccggtggtgaagcacagcggatgaagctggccagcgagttacaaaaactttcgaccggtaagaacttttatattctggatgaaccgacaaccggtttgcataccgatgatattaagcgattgctggaagtgctggaacgcttagtcgatgaaggcaacacggttttggtcattgaacacaatctggatgtggttaaatctgccgactgggtcattgatctgggtcctgaaggcggggatggcggtggccgtgtcattgccacaggcacgccggaacaggtcgccgaggtggccgacagttacaccggccagtacctcaaaccggttctgatccgtgacaccaaacggaccaaagaagcggctgccggcaagaatggccaggccaaaagcagcaccaagaaataatgcgtttgatagtcgcgtttaaaaccgcgactatttatgtacataaatgagcagcggggaaccgatttttgataactttttaaaggttgcggatcatgcgtggctagtggcatttgccagcatcttcaaaaattccggcaattcaatttattgaattgctttttgaaatggtatgatataagtgatcaagaaagtagggaataatatgttgaatcgaaagagttttggctttgactgggggcagttcatcaccggtattctgtttctggttgctgcttttgtggtcttacggtacccgttagcaacattaaggacggttacctttatctttgccgtcgttgccattattcgagggattgcggttcttgcgggcttttccacattgcgccagtttaccggtagattggcatggatttccttgattatggggatttttgaccttgtcattggcctgattttcttattgaattctggcttaggcgtggcgacgatcaccatgatgtttgctatctggttcctggtcgattctgtcggctcattgttcaatgtcggccatctgcgcgttgccggcacgggctggtttgttgtttatctgattctggatattctggcggtcattgtttcgctgatgctgttcatgcagcctgtgattgcagcagtgacgctggtgaccttgttggcgatgttcttcgtcctgttcggcatcgagtgtattgtcatcgcttttgctcgacgcaacatttaaattgtccaccaaaagtccgaagaaccggtgtttctaagccggttcttcggctttttttatttcgggagtctgtgatggtaggaatgacacgcccggaatgttatacttgattgaatatgagcacaaaggagccttttatgactgaaagtttggatcttgttattatcactgggatgtcgggtgccggcaaaaccgttgcaatgcaggcgtttgaagatttggggtatttttgcgttgataacatgccgccagcgctgcttcctaagttttgggaactcgttaaggaatctgggaagatctcaaaggttgcgctagtcgtggatctgcgtagtcgggccttttatgaccagattatcgacatgttggctaatctggacaacaacgcttacgttcattcgcgcattttgttcttagacgcgacggatgaagaactggtttcgcgttacaaggaaacccgccgctcacatcccttggcaatggaaggccggttgatggacggcattaaaaaagaacgtgtgctactaaccgagttacggaatcgggcgcaagtcgtgatcgataccaccacgttgagcccgcgacagttacgcgaaaagatcttcttaaacttcaaagaaaatagcggtcagccagcctttcatattgaagtcatgtcatttgggtttaaatatgggctgccgattgatgcggacattgtcatggacgtccggttcctgcctaatccgttttacgtcaaggcttaccggccaaaaaccggtttggatcaggaagtttatgactatgtaatggacaatgaagatgccgaaagcttctacaacaaattttacgatttgctggctgagatcatgcccaagtataaagccgaagggaagaccagtgtgacgatcgcgatcggttgcacaggcggtcaacaccgaagcgttgcgtttgcggagcgcatcggtaaggcattttcggatgcgtatgcggttgatattacccatcgggacattaagaaacataaggagacggtgaatcgttcatgagtcgggaaactaaatttatccgcgtcattcgcgggcggcgtcctaaagtcgtcgtgattggcggcggaaccggattgccggttatcttgcatagtctgcatgaacaggatgctgacgtaacggcgattgtgacggttgccgatgatggcgggtcgtcaggtaccatccgcaattatattaacgtagtgccgcctggtgatattcgcaatgtgcttgttgccttgtcggagttgccaagtctgtatctggatattttccagtacagatttaacacgaccgatgcgtttttcgccggccatgcgattggcaacttaatcattgcggctttgtcagagatgaaaggcggcattttcccggcggttcagcaactgagcgaaatgatgcaggtggatggtcacgtttatcctgccagcaacacgccgctcacacttaatgccgagttcacagatgggacgagcctatccggtgaatccgaaattaccgctgccggtaagaatatcaagcatatttccatctccgaaaccgatccggctaatggtgaacctaaagctgtccatgaagtcattgatgccattatggatgccgatgtggtcgtgctggggcccggcagtctgtttaccagcatcctgccgaacctgatgattggcaatctgggtgacgctgtgaagaaaacgcaggccgaagtcatctatatcgtcaacatcatgacgcagaaaggcgaaacacaaaacttcaccgatgccgaccatgttcgggtgttgaatgaacagatgggggaggattttgtcgataccgtgctcgtcaatatcgaaccggtccccgagaattatctcgatcaccaaaagtacaacgaaattctgacgccggttaagcataattatcaaggtttgcgggatatgggttgtcgcgtgatttcggaagactttttgaagttgcgtgatcgcggcgttttccatgatggcgacaaggtggccaaggaaattttgaatttggcttttcaagtgagcgcaaaaatccggaggtgagggcatggcaagctttgccagtatggtgaaaaaagaactgacccaactcgaggttcatcctgaacatgcgaaggcagagctgtcggcattgatccggatgaacggcagcctgacgttaatggcccatcggtttgtgttaaacattcagactgaaaacccggccattgcccggcgaatttatagtttgattcgccaggtttaccggcatgaagccaacttggtcgttcatcgcaaaatgaaactcaagaaaaattatcagtacattgtccgcctgacggaaggtgtcaatgatattctgtcggatttgtcaattttggatccgacaacgatggcgatttcgacgacggtcccagcaacggttttggaagaaccacaacggatgcgttcgtacttgcgcggcgcttttttagccggcggatcggtgaataatccggaaacatcgcgctatcacctggaaatttattcattatatgccgatcacaatgccggcattttgaaaatgatgaatcatttcaacctgaatgcgcgtaccgtcgaacgccgaagcggctatattgtttatttaaaagaagccgaaaaaatcgcggatttcctgcaggtgatcggggcaacgaatgcgatgcttaagttcgaagatgtccggattgtgcgcgatatgcgtaactcggtgaaccgcctcgttaattgcgaaacggcgaatatgaacaaaaccattgatgcggcccagaaacaaattgagaatatcaactatcttaaagatcatgtggggttggataatctgccaaccaaactgcgcgaaattgccgttttgcgcttagcccatccggatgtctcgttgcaggagttgggtgccatggttccgggtgggacaatttcgaagtcaggcgtcaatcatcggttgcgcaaactcaatcagattgctgagggttaccagcaaccggaagatgcctagcagctatgataattgcaagataagcaaaaagtcatatttataagataatgcctttgtttcctcaagataatcgtgtacaatgtaaccgacatcaagttatttgatgtaggcgtttgaacgacccggctgccacttttaggacgctaaaaactgtccggcagtgcgctggttgacgagtgccacgacaagaaacatgagtcagtttacattcggatttgcagtgatgttattaccagatgaagtggtaattgtcacgttcagcgggatacaattgttgcttaggttttaggaggaagcactatggtcaaaccgatcacattaaatgaacaactttgttttgcaatttacaaggcacagaaacaatataatcatttctatgctcaggcattggcgccatttaagttgacttatccgcagtacattacgttgctgtcgctgtatgaacacggcacgatgtcggttaagcaggtgggccaaacacttgagttggacagcggtactttgacaccattaatgaagcgtctggaaaaagatggctggatcagccgcaaacgatcaaccgaagatgaacgtcgcgttgatgttagcttgacgcaaaaggctttggacgctcgcgacgagatttttgaacatgttggctcctgcatggaattgatgaatttgccgcaaactgaatatgatcgtatcaagactgaggtaacgcgtgtcgatgagcatctgagtgctatcgctgacgacgcctacccacaagtctgaacgatttttataaggtcaaagattgtgattaaaatctttgaccttatttgactttagcagtatacttagcactgtactttaaagagtgctaaaaaacgattttcaggaggttaggacatgctagtacctaccgtcgttgaacaaaccagtcgtggcgaacgtgcttacgacatttactcacgtctattaaaagaccggatcatcatgttgtccggtgaagtaaacgatcaaatggcaaactcggtcatcgcccagttactttttcttgatgcacaggattctgaaaaggacatttacctttacatcaacagtcccggtggtgtgatcaccagcggcttggcgatgcttgataccatgaacttcatcaagtccgatgttcagaccattgctattgggatggctgcatccatggcatctgtcctgttagccggtggcacgaaaggcaaacgctttgctttgccgaattcgaccattttaatccatcagccttcaggtggtgcccaaggtcagcaaaccgaaatcgaaattgcggccgaagaaattttgaagacacgtaaaaagatgaaccagatcctggccgatgcaacaggtcagacagttgagcaaatcaagaaggatactgaacgtgatcactatatgagcgctcaggaagccaaggattacggcttgattgatgatattctggttaataagaataatcaaaaataaaggtttaaacgaattggcacaccgctttggttagcggtgtgtttttttcgtgggagtggaaggacgggtagaaggaatttgaggataaccgccgagaatgaatcagtataggcagtgaaaaaataaggtttgggggcaatccggttccgaaacgcgctcactgggccagaaacctgcgtgtaaggaccttggtcgcaatggtgcagaccgtgactgaagttctccgacgcaaaaacgcgctcacagtcgcagaaatctacgtgtaaggacctcaagcctaaatggccaaagaccagccatttaggcttgaggccacttacactccgatttctaagcgctcctgctcacgctctacataaaaagacttgcaaattgccccctgattgagtaatataattaggtacttgcgcggttagtgtaatggatcgcacgtgagattccggttctcgaaatccgggttcgactcccgggctgcgcagaattccagtcatatggaaaataccgaaaatagaaaagtccgctatggcgggctttttgtttgccataatgtgtttgtaggacgcaaatgtcgctgatcagcatagccctttttaagctaagaaaacgccaaatgaaatcgctccctcaccaaatagcagtttcgcttgaaaaatgctcaaaacagaacaagcagtgatgaaagaacccatgactggctgtgtgtaggctgttgaaatagaccgaaatacagtgcatgaaaatttcattagaagcaagccgaaacccctgatatcaaaaagccgcagcgaggttgccgaaactggtaaatgccgaacgtttgaatcattcttgaagtagatgttcaaacttagccggttttgtgattactttgagacgatttaggcaacagacttgcgataaagcggaacccctgctacaattggttttgttggtaagggaaaacagcaaacgttgggttcctaatttttttcagcttgctgggtcggcaaacgactcggagggacgtgaaatgacccattaaagaaggacgtgccttatgcatactgaacttgcgtggctcaaagcgatcgcgcctgatctgatgggcgtcgtcactaaacgctatcaggtccttcaatttattaactggatggcaccggttggtcggcgaacgttagccgaacagatgaagatttcagaacgcgcgttacgtacagaaacagattttttgcgcggacagggacttttagaaagttcgaaatctggcatggtgttgacagcaaaagggctagaaacttttcacggtcttgatcatttgatgaatcagttgctgggaatcaaagatgacgaaaagcggctggcaacgcatcttggcattgaccattgtctggttgtttccggggatgcggatcagagtagccgggttcttgatgaacttggcaaaacgttaaattcaaccttacagttactgttaccacccgggcatttaacggttgccgttatgggtggcacaacgatggcacatttagccacgcagttaacttttcagctatctgcgggccgtgaactgtcgtttgtccctgcacggggtggtctcggtgaagccgtgaccattcaggccaactcgattgcggctgcaatggcagaagcaaccgatagcaagtaccgggctttatatgttcctgagaatctaagctcggagtcctatgaatccttaatcaaagagccatcggtaagagatgtgttaaaccttatcgataaagctcaggtcgtaattcatagtgtgggcgatgcgctggtcatggctaagcgccgtggcatgtcgcctgatacgatcagcatgttgaaagccaagcatgccgttgccgaggcattcggtgttttctacgatgccaagggcaaggtcgtttacaagataccgcaaatcggattacagcttgcggatcttgatcatataccgtatgtcttcgcagttgcggcgggtaaaagtaaagccaaagcaattgcggcgtacatgcaacacgcaccgagtcgaacgtggctgttaactgacatcggtgcaacaaactcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcgatcaacgatctgaccagcccaaccatgctggctcacttgcttaagtatgattcaactcacggtactttccctggtgaagttagtgcaaccgataacggtattgtcgttgacggtaaagaataccgcgtctacgcagaaccgcaagcccagaacattccttgggttaagaacgatggcgttgactatgttcttgaatgcacaggcttctatacctctgctgaaaagtcacaagctcatttggatgcaggtgcaaagcgtgttctgatttctgccccagctggcaagatgaagaccatcgtttacaacgttaatgatgacactttgaatgcagacgacaagattgtttctgctggttcttgcacgaccaactgcttggcaccaatggcttacttcctgaacaaggaattcggcattgaagttggtaccatgaccaccgttcatgcttacacctcaactcagatgttgcttgacggcccggttcgtggtggcaacctgcgtgctgcacgttctgctgctgctaacacgattcctcacagcactggtgctgctaaggctatcggtttggttatcccagaattgaacggcaagttgcagggtcacgcacagcgtgtttctgttgttgacggttccttgaccgaattggtttccatcttgaagaccaagaacgttacagctgaccaagtcaacgaagctatcaagaagcacaccgaaaacaaccctagcttcggctggaacgaagacgaaatcgtatcttccgatgtaatcggtacgacttatggttcaatcttcgatcctactcagactgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaaggcgacagaaatcatcggttttatgctgatttttgccctttgcgaacaccatggtggaggacgcgtgttcatccaccatctttgggaaaatgaaggaggtcaaatcttttggctaaattaatcgtttcagatttagatgttaaagataaaaaagttctgatccgcgttgacttcaacgtgccgatcaaagatggcgttatcggtgatgataaccggatcgtggcagcattgccaaccatccaatatgtcattgatcacggcggcaaggcaatcttgctgtcacaccttggtcgggttaagaccgaagaagataaggctaagctgacattgaagccagttgcccaacgcttgagtgaattgctgaagaagccagtgacctttgtaccggctacccgcggcaaggaactggaagatgccattgccaaaatgaacgatggcgatgtgcttttgatggaaaacacccggtttgaagatcttgacggtaagaaagaatccggcaatgatcctgaattaggcaagtactgggcaagccttggcgacctgttcgtcaacgatgcctttggtacggcacatcgtaagcatgcgtccaacgtcggcattgcttccaacatgaagcaaacagctgctggattcttgatggaaaaggaaatcaagttcttaggcgacgctgttgataatccgaagcacccattcattgctatcttgggtggtgccaaggtttccgataaaatcggtgtcatcgaaaacttagtgcctaaagctgataagattcttatcggcggtggcatgacttataccttctatgcagccaaaggtatgagcatcggtaactcattggttgaaaaagacaagatcgacttagccaagaagattatggaccaagccggcgataagttgcttttgcccgttgattctgttgttgccccagaattttcaaacgatgctcctcataaagttgttgaaggcgatattccggatggctacatggcattggatattggcccgaagacgattcaagaattcaaagatgctttgcaaggtgccaagacggttgtttggaacggcccgatgggtgtgttcgaaatgagcaactatgctgaaggtactttggaagtcggccgtgcactcggtgatttgaaggatgctacgacaatcattggtggtggcgattcaaccgctgctgccaagcaattgggtatcgcacctaagattacccacatttccactggtggcggtgctagccttgaatatcttgaaggcaagacgttaccaggtatcgcagccatttctgacaagtaatttgtcagtgatgctgatctaacagtcaatgccgacacgtgctgagcgtgtcggtacataatgaaaggaagctaagtcatgcggacaccattcattgctggtaactggaaaatgaacaaaaaccccaaggagacgcaagcctttttggatgctgtgaaaggcaaactgcctgacgcaagcaaagttgaaacggttattggcgcacctgccattgatctgacgactttggttgccggagcagaaggcacacctttaaagacagcggcagaaaactgctactttgaagatgaaggtgcttataccggcgaaaccagcccgaaagcattaaaggaaatgggcgttgattatgtcatcatcggccatagcgaacgtcgtggttacttccacgaaaccgacgaagatatcaataagaaagctaaggctatctttaagaacaatcttctgccgattatctgctgtggcgaaagtttgacccagcgtgaagccggtcaaaccgaagactgggttgcttcgcaaatcgaagctgctttggctggcttaacggccgatcaagtcaaagtttctgttttggcctacgaaccaatctgggctatcggaaccggtaaaactgcgaccgccgatcaggcacaagaagttgttgcccacattcgtgcgaccgttgagaagttgtataataaagatacggcagacgctgttcggattctttacggcggctccgttaaaccagcgaacgttaaagaattgatggctaagcctgatatcgatggcggcttagtcggtggcgcttcgatggatcctgaaagtttcatcgccttggctaactaccaagattaatctggtttctaatattaaacagccttctggcaaaaaggagaagaatatatgtctatcattactgatgtattggcacgcgaagttttggattcacgtggcaaccctactgttgaagttgaattgtataccgaagatggcggttttggccgcgcattagttccatcaggtgcttcaaccggtgaacacgaagccgttgagctgcgtgatggtgacaaggatcgttttggcggcaagggtgttttgaaggccgttggtcacgtcaacaatgaaattgccaaggcagtgattggccttgacgttaccgaacaacgcctgatcgaccaaaccatgatcgatcttgatggcacaccaaacaaaggcaagctgggtgccaacgccatcttgggtgtttccttggctgctgcccgtgctgctgctgatgaagtcggcctgccattgtatcaatatcttggcggcccgaacgctcatgttctgccaacaccgatgatgaacgttcttaatggtggcgcacattcaaccaacaccgttgatttccaggaattcatgatcatgcctgttggtgccaagagtgttcgtgaagccgttcgcatgggttcagaaaccttccatgcactgcaggctttgctgaagagcaaaggcgacattaccgctgttggtgatgaaggtggcttcgctcctaacttgaaggacaacgaagaagcctttgaactgcttgttgaagcgatcaagaaggctggctacaagccaggcgacgacattgctttggcctttgatgttgcggcttcagaaatgtatgatgccgacaccaagacctacacaaccaagtggtcaaaccctgacaagaagtacaccaccgaagaatggaccaacatgatcgatggttacatcaacaagtatccgatcgtttctgttgaagatcctatcgacgaaaacgattgggaaggttggcagtcattcaccaagaagatgggcgacaaagtccaaatcgttggtgatgacctgtttgttaccaacaccgactacttgaagaaggggattgacatgggtgttgctaactcaatcctgatcaagctgaaccaaatcggtactttgaccgaaaccttcgaagcaattgagatggctaaagaagccggctacaccgccgttgtttcacatcgttccggtgaaaccgaagacaccacgattgctgacttggttgttgcaaccaacgccggtcaaatcaagactggttccatgagccggaccgatcggattgccaagtacaaccagttgatgcgcatcgaagatcaattaggtgcacaatcacaatacaagggtcgcaagtccttctacaacgttaaagcaatcgactaattaattgtcattgctgtcgttacgagcacgtcacttatgataagtggcgtgtttttttcctaatatttgaaaaaatgggatttttctcgtttcctctaaaggtttatactgaatgaatgttggcatggagggaaatgttgtggcacgaatcattaaggaaaaagaaaaattcgatatcacccgcctgcggtttgtcttgctgggattattagtcggcttgatgaccggtacggtggtcagtgcttttcgctactgtattgaagtcgggttgcgcgccagtcatcaggtatacggatacttacatatggggccgtttgtctggtggcactgggttttattgattgcctttaatctggtgctggcggcgcttgtggccctaatgttaaaacaagaaccttatatttccgggtcaggcatccctcaagtcgaagggcagcttgccggcgaactggaaatgcattggtgggccattctttggcgtaagttcgttggtggcgtgctggcacttgctcccggtttgtttctgggtcgtgaagggccttcgattcagttaggcgcagccgtgggtcaaggcttggctggtggattcaaattgcgcggaaccgatcgacggctcctaattgcttccggatcggcggccggactcgcagctgccttcaatgcaccgattgccgggacgctgttcgtgctggaagaggtttatcataatttctcgccgctggtttggctgactgcactggccggtgccattggatcggatttcatctcgctgtatgtgtttggactggttcccgtgctacatttgagttattcgcgaagtttgccggtcaccagttactggcatttgattctgctaggcattcttctagggctgctaggctatttataccagcgggtgcttttatccatgccgcggtggtatcaacgcttgacccacttaccacgggtcgtgcaaggcgtcgtgccgttcatcttgttgattgcggtcggttactttacccctaatctgcttggcggcggcaatagcttgattgtcggatttggccagtatgtaccgccacttttgacattacttggtattttcgtgattcgctttgttttttccatgatttcttatggctcagggttaccaggggggatttttctaccgattttatcgttaggggcgattatcggggccatttatggggtggtcatgtatcagttaggactgctgccgcatgtctacatcatgaatctgattatcttctcgatggccggatattttgctggaatcggaaaagcgccgtttaccgcgattttattggtgaccgaaatggtgggcaatctgacccatctcatgccgctggccgtgttgtcgttgacggcttatcttgtggttgacctgcttggcggtgcgccgatttatgaagccttgcttgaacaaatgacattccccaagaccgttgagcagctgcaccagcctgatcgactggaaatcccggtttttgtgggcagttcgctcaatggtaagttggtgcgcgatatgccatggccaaaagagtcgttgctgattggtattcgccggggtgagcgggaagtgattccccatggtgatacattgattcgagaaggcgatacattggtattgctgacagatgcggctgagcgtgtgcgggtgaaaaagcgaatcgatgccttatctgctgccctagcaacggagcacaaaacgcgaacgtgatgccatgtctgtgagtcgcatcttttagatggcgcctaatcggtatgcatgtataatgaacttgtcaaagtgatggctatcgtcaacagaagggacttgatcaccatgagaacatttcgcatcgtgtacgctgttgcaagcatcctacttggtttattttattcggttggtggcgaactaggattgctcacatcttccggtgacggttttgccagctttattgtgccattcttactgggatttgtagcgaactggggcatggttgcacttgtcattgttggcgttattatcgataagcagatgcgctggtggtatttaggttatccggtactgatgggtttgaacattggcttgaatcaaatgttgccggttagcgtggcagatcaggtaagctatttgatgcctttcctggtggccgtgatcggtggctacatgctgtatcagactttcagaaaaaagcctcatattgcgtgatcgcttaacggccatgatattgcggagagtcgcctactggtctttgaaattggctaattttagatcaatgatgaaaaagatgactgaaatcagcaaagattcgcctttgccttgcttttatgctaaactactaaagtgagatttttcgcaagggaggcaacaacttgcaaagtttattgaccacattacttgtgatcgattcgatttttatcgtgatcgcaactttaatgcaaccaagcaaacaacaggatgcgttaagcgcattgtccggtggggcaaccgatttattcgggaagaccaaatcccgcggttttgaagctttcatggagaaagtcaccgttgtattgggtgtcattttcttcggcctcgccatcgcgttggtctatctggaagcccattaaccaaagtctcctggaacattcagggggctttttttgcagaagcatgatccaacctacgtagagctggcgtttaaacatacagattcttgtgcggtgcatcggcggtctgcaactatggcttttgtatcaagtttttgctgtgcttaccagtctgacatcagtttcgccagctaaacatgcacagtttccaaaaatcggcattcatgcgtcgcatatcattgacagccacaaaggacgatttcaccatgatttttcgcaaaccgcaaccttttgaatacgaaggcaccgacacaggcgttgttttacttcatgcgtacactggcagccccaatgacatgaattttatggcccgagccttacaacgtgccggttatggggtgtatgtgccgctttttgccgggcatggaacgatcgagcctatggacattttgacgaagggcaatccagacatctggtgggcagaagccagtgctgccgttgcccatatgaccgcaaagtatacccgcgtgtttgtgttcggcctgtcgttaggtggcatttttgcggtaaaagctttagagaagttacctggcatcacggctggcggcgttttttcatcgccgattctgccaggcaagcatcatttgattccgggatttttaaaatatgcccagtatatgaatcgattggccaataaaccggatgaaagtacccagattctggcttacctaccggggcaactggctgcaattgatcagtttgccacgggggttgcggccgatttggatctagtcaagcaaccgactttcattggtcaggccggtgaggacgaattagtggatggccgattggcgtatcagctacgcgatgctttgatcaacgcggcccgcgtggattttcactggtacgacggggccaagcacgtgattaccgttaattcagctcaccatgcactagaacaagacgttattgaatttatgcaacaagaaaacgagggatagcatgaccacagttggccatattcgtaatgaattattagcaacatttcgcaggaatccgaagattgattattcggttcagacacttagtcgcgcgttgaaattaaatgaaggcgcggattttaaagtgctggtacaggcactaaatggtatggaaaatgacaatctgatccacgccaatcatgaaggccgttatgcattgggtggcgcgcctaaagttttgactggcgtcttccatggtaatgaaaaaggttttggtttcgttgccgttgaaggcttggatgatgatgtttatgtgccatcgaccagcacggattttgccttggatggcgatacggttgaggttcgcattgttcgcgaagcgcggccaaacgattcgcgcggagcagaaggcgaaattaccaaggttgttcaacgcagcttaacgaccctggttggcgagttcaaacctttttccgataaagatcgggctaagtccggttttatcggcatggttgtcagccatgaaaagaagctgaagaattatccggtttatgtcaaggataccggaaccattccgcaacttggcgatatgacagtgacggagattactgaatttccgactgaataccatccaaaattaatgtacggcatggtggtggaaacactagggaataagaatgatcccggcgtggacatcatgtcattggtcctgcaaaatcacattaaaaccgaattcccggatgaagtgatggatcagaccaatgccattccggatcacgtgacgccggaagaacgcgttggccgcaaagatatcaccgatcaggcagttgtcacgattgatggtgatgacagtaaagactttgatgatgcggtggtcgtttggaaactgccaaatggcaacttccatcttggcgtccacattgccgatgtttcgcattatgtcacggaagggtccgccttggatcaggaagcatttgaccgcggcaccagtacgtatttggtcgatcgcgtgattccaatgttgccatttcggttgtccaatggtatttgttcgttgaatccgggtgttgatcgtctggcgatgtcttgtgatatggaaatcgaccacgaaggccatgtggtgagtcacgagatctatcaaagtgtcatcaagagccatgcccgcatgacctacaacaatgtgaacaaaattgtgaccgaccacgatccggaagtgatggccgagtatcaagaacttgtgccgatgtttgaagacatggtcgaattacaccagattctgtataaaatgcggcatgcccgcggcgcgattgactttgaagaaaatgaagccaagatcattgtggatgatatgggccacccgacagacattgtgttgcgcgaacgtggggtctccgagcgtatgatcgagtccttcatgcttgcggccaatgaaaccgtggcagaacactacaacaagcagcacctgccattcctttaccgggttcacgaaacgccggacgctgatcgggttaaagaattcatggaattcattgccagcttcggcatcaccgttcctatgaaaaaaggtaaggaaatcacgccaaaacagcttcaggaagttgtgacggatgtgactggaacaccggaagaagccatggtcaatgtgaaactgttgcggagtctcaaacaggcgcggtattcaccggatccgcttggacattttggcttggcagcgaagtattactgtcatttcacgagtccaattcggcggtatcctgacctcgttgtgcatcgcctgattcgcgactatgcaacggaaggcgtcggtgatgacgttcaagcttcgtggaataagaagctgcctgacattgcgacgcaagcgtctatggccgaacggcggagtattgacgctgaacgtgctgttgacgacctgaagaaagccgaatacatggcggacaaggtcggcgaagagttcgacgctgttgtcagtggggtgacaagcttcggtatgtttgtggccttgcctaacacagtcgaaggcttggttcatatcacacggatgagcgacgattattattcctttgtcgaaagtcagatggccttggtcggtgaacgcaccaagcgaacttatcgtgtcggccaatctttgcgggtcaaactggataacgtcgatattgatcagcggcaggtggacttttcacttatcccggatgacaagacgccgacgagtgatttaggcaagctggtcaaaaaagatgaccggcgcgatcgccgctcgaacggcaatcggccaagttttggcaatggtaaccgaggcggcaatcgcaatcagcataataatcagcgcccacgtaaaccggctggggcaccgcatcaagggaagcattataatgctaagcgtggcgctaagtagggctggtatgcgataacgcgctccccggcgcagggatctgcgtgtaaggaccttggtcgcaatggcctaagttcgggccattgcgaccaaggccgcttacactccgagccctaagcgcgccagctcgcgctcacacaaaaggaagggtggtttaatggctaagaaacatcgacaaaaacctgataacctgctcgcccagaataaaaaagccggacatgattacaacattcttgatacctatgaagctggtatcgcactgacggggaccgagattaagtctgtgcgggatggtaagatcaatttgcgggatggttttgcccgtattcgtaataatgaagcatggcttgaaaatgtgcatatcagcccttacaaggaaggcaacttgtttaatgttgatccgatgcgcaatcgcaagctgctgctgcacaagaaagagattcgcaagcttggccagttgacagcgcgccaaggcgtgacgcttgtgcccttgcggatgtatctgaaacatggctatgcgaaagtactgataggcgtcgctgaagggaaacacaactatgacaaacgtgaaactctgaagcgtaaagatcaagaacgtgaagtccaacgcgccttgaaagctcgctattaattgaatgcatgcactaaaaaatagaggctggttcataattcacagccacaataaagaagtgaacatactcggcaatgagtgtgttcactctttttattttcctgagttattcaagatatgagtgccaaagcggagcaatcgtaggccagaggggggctcagctgtgaaatagactaacttagttgatagatattgatcaggccagatcaatatctatcactttttttgttagagtgagcgtgaagccaacgcc

SEQ ID NO: 307 - DNA, 79157 bp, Lactobacillus casei
cgttatcgatacgccacaagaaaaccgcaagaacactgaaaaacctaatgaatgagacttgacttctggtagaaaattgtactagccgggtgctcttcccggcgtagtacaaggccgagctttgagactcagcgggctttgctgaggctcaaagtcgtgcccacagcgttccagccccctctggccggagattgcagagtttggcacgactcgggactcattgcctaagctttttgtgatgatcggggacagcaaaaggtaaaacagcatgcggattgattgagtgtgctgcgtgaaggctgtatgatcgccgtatagatatcaaatcgtatggctcaaaccaatgcggtgaatttttaacacaggagtcagttcaaggaggggttgcgtcatgaatttggcggctttagcgcatcgaccggaaagtgaagatagctttttatacacggataagacgcttcatctgcgttttcatactgcccgccaggatgtcgcaaaggtgacggttctgtatggtgatccgtattggcgcattcccgatgcccatggcgctgatcagctcgtctatcagcgcgaaacaatgacgcttttaggcaccgggcaagtgttggaccattgggtcgtgacgctggaggcgccttatcgtcgactgcaatacttgtttgaagtgactggccaagatggcacggtatggctgtacggcgatcgtggcctgcgcaaagatagcgcggacgcacggcatgaggctgaaaactattttcggatgccttattttcaggcgattgaccgcgtcaaaacgcctgactgggtgaaaacgacggtgtggtatcagatttttccggagcggtttgccaatggtgatcctaataacgatccagatggtaccaaaccatggcacccgacggatcatcctggacgagaggatttttatggcggtgatttgcaaggggtgctggatcaccttgatgatttacaggccctggggatcaatggattgtacttttgcccgatttttactgctacttcgaatcacaaatatgacacgatcgactacctaaacgtggatcctgcgtttggcgataaggcgttgttggctaaattgattcacgcggcgcatcaacgcggcatgcgggtgatgttggatgcggtgtttaatcacatgggttatggcagcctgcaatggcaagacgtgttgcgcaatggtgaaaagtcccgctttgcatcatggtttcatttgcatcaaaccccggtgacgccttttcataatccgcttaagggtgaaggtcaaccgcaatatgatacgttcgcctttgaagaaaaaatgcccaaattgaacactgccaacccggaagtgcaggactatttgttgatggtggcgacgtactggatcaaaacgtttgatatcgacgcttggcgcttggatgttgccaatgaagtggatcatcatttttggaaaaagttctatcacgcggtcacagcaatcaaaccggacttttatgtgctgggtgaggtgtggcatcgcagtcaggcgtggttaaatggtgacgaattttcagggacgatgaattatcctttcacgcaacagattgaagatcactttttcaagcggcggcggacggcagcggaactggttgccttgttgacggatcaattgatgttgtatcgagatcaaaccaatcaggtgatgctgaacatgttggattcgcatgatacgccgcggattctgacgttggcgcatggggatgaggacttggcgttgcaggcgttggcattcacgtggatgcaaaccggcagcccctgcctttattatggaaccgaaatgagcatgtccggtggtgccgatccggataaccggaagccgatggattgggctaaactgggtcagccgatttggaaaagggtagccgcactggttcattttcgccgtcagcatgcaaccacgcttggaaccggtacgacaaggctaagtgtgactgataccggcttgattaaagtggttcggcagggaaacgagatgctgacaggctattttaataccacggagcagccagttgccgtcaatagggaggctgttttcgcgcaaggatttgtgaatggtcagttggcgcctaaaggattcatggttgtcgcgggttgatgacaaattgacagttgcacgttcaatttgcatagagagggcaaaaatttgaaacgattatttgaaattgatccttggctggttgccacgcatcatttagataagattgatcggcggttgcaggaaagtatcacggccgttggtaatggctatatgggcctccggggtaactttgaggagggctatagtggcgattcacttcaaggcacttacttaggcggtgtctggtttccggataaaacccgggtcggttggtggaaaatcggctatcctgaatattttggcaaggtgattaatgcaccgagttttctggggatcggaattacggtcaatggcgagcaggtggatctagcaacgagtcggtaccgggatttttatcttgcgctggatttgcatcagggcttgctgacacggcgttttgtctatattggcgatggtgtggaagtgcagtttgagtttgcccgctttctaagccaaaccattaaagaagcggcatttgtgagcgtcaaggccacggtgctgcgtggtcatgccgcgatgacgtttgatgcatctttggatggtcaggtcaccaacgaagacagtaattatgatgagcgcttttgggtgccattgcatgaagatgcggcagccaaaagtattcagctgcaaactaaacctaatccttatggggtaccgcagtttactgttttgctcaagcaacagttgcgcgtgaatgatcagccagtgaatggtcaggtcgccacaacaagcggtcaattacatgagcaggtgacggtgcagttagcggaaggccagagctatcaactggaaaaagacgcgattgtggttaccagccgtgatgttgcaccggcggcccaagcaacggcggcggctcagctgatgaagcaagtaaccgcccaaagctttgcagcgcatttggccgcgcacactgcccgctgggaccagcgctgggctaaaagtgatgtcgtgatcgaaggcgatccagccgcccaacaaggcatacggtttaatattgcccagctgtttatgacttattacggcgaagacaagcggcttaatatcgggccaaagggatttactggcgagaaatacggtggggcgacgtattgggacacggaggcatttatcgtgccaatgtatttggctgtgaccccgtcggaagtgacgcgggcattgttgcaatatcggcatgatcagttgccgggggcttttcacaatgctcggcaacaaggcttagctggcgtactctatccaatggtcacgtttaacggcattgaatgtcataacgaatgggaaattacgtttgaagagattcaccgcaacgctgccattgcatttgccatttatcaatacacggcttataccggcgatgagagttatgtgaagcatgacggcctggaagtattggtggggattgcacgcttttgggcggatcgagttcattttagccagcgcacccagcaatacatgatccatggcgtgaccggtcccaacgagtatgaaaataacgtgaataacaactggtacaccaataccatggccgtgtgggagttgcagtataccctagaacgattggcaaaaggcgatgccgatattgtggctgcacttgccgtgactgatcaggaaaagcagcattggcaggcgattatcgaccatatgtattatccgaccgatgaccaattgggtatttttgtgcaacaggatgactttctggataaggatttgcggcctgccagcacgattccggcagatcagcggccgattaaccagcattggtcatgggatcgcattttgcgctcaccgttcatcaaacaggccgatgtgttacaaggcttgtatttcctgaatgatcgttttaccaaggcggaaaaagaacgcaactttgacttttacgagccgctcacggttcacgaaagttcgctgagtccttccattcatgcagtgttggcagctgaactcggcaaaatcgataaggcaactgaactttacgcccgcactgctcgcttggatctggatgattacaatcacgatacgcaagacggcctgcacatcacgtccatgagcggcagctggctggcgatcgtgcagggcttcgcgggcatgcgctacgatcatgatcagttgcggttccacccccagttgccgaaaaattggcgccgatatcagttcaaactcaactatcgcgggcgcttattagccgttgatgtcgggcaaaaggtcactgtctcactactggccggaccgtcattggatattactattgatggcaaaacggtgcacttggaagtggaggatggccatgcttaaaggctttatttttgatttggacggtgttttaaccgacacggcaaagtaccacttagcggcgtggcatgagttggctgagcggctgggcattcacttgccgcctgaagccgatgcggcgttacgcggccgcgcgcgcatggactcgcttgaactgattttgcggtacggccatcaggaacggaattatgatgaggcgcaaaaggtggcgttggcggaggagaaaaacctgcgctaccgggcattagttgcgtccattacgtccgcggatatcctaccggggatcccgttgttactggaaaaggccaagcaacaccgcttgaaaatggcaattgcttcggcatctaaaaacgccccaatgattttgcagcgactgggcttagcttcacagttcgatgccattgttgacccgagcagccttcaccgtggcaaacccgacccggaaatttatatcaaagcccagcagttgttgcagttgcaagccgctgaggtcatcagttttgaagacgcgccgatcggcattgcagcgatcaaagcggctggccaatttgcggtgggcattggggatgcggacaagttagccgcggccgactatcgcgtgtcaacgacggatcagctggattatgatcgcattgtggcggcgtttgaacggcggtaatgagcgtaataagagctttattgaaaggatcggtcagtgactggttcttttttaatttggcattagtgggttactggtttaaatgctgcggggatcattaaatggtttatgtttgaagtcaaaaacttttgacatctattttgagtggtatataatcgtaatgtaaaaagtatttgacattaaggggtggcttccttgagaaaaatggatgaaatggagcgcaagtttgctgatcgctcgattagaattgcttacctaatgatgtttttaatgctgtggtctagtggaacctatgaactaattcgaaccggacagacgaactttgatttctttgtggtcaatgttgctatggttgttcaaattgccagttatgaatggttcaagcatcatgctgatcaaacagataaagaaccaggccgggttttttatctgacaattgcactagtggcgatcatcctcacgcttggattgctctctttgatgttccatggaaaataaaatccgcaccctccgaacccggcaaaatctgactcagcaggaactggccgatgctgttaacgtcacacgccaaaccattaacgctattgaaaacaataagtatgacccgacactttccttagcctttgctttagccaagcagctacagacgacagtggatgaactgttccggcattaaaaaagcaggttgcaaagtgtttgctttgcagcctgttttttgctaactattcttcttcagttaaaggatcgaaatcgtaatacaaatctttttctggcaatagaacatcggcatttgtctgggcatcaatcgcgtcagcctcgcgttcgggatggaagctatgccacggcacgacgacacgcgggttgacttctttgactagttcaatcaaatcttcccgagcggcgtggcctgaggcattcatgaacactaatggaatctggtgatcagccaaccaatcttttaactgagcgaaacgcggatcatagtcgcccagcggttcaccgttgctgtgaacgtacgcgctgatcggtaagtttgctagtgaggccagatttgcaaagctgttttgaagaacgtagcgttgcggttgctgggcaatgtcagtcagctggatcgtttggccgagaatggcatcgggctgcgtaccggtcatagatgtcaaaatagccgcttcattaggctcccaaaccatttgccgaccattgacatgagccgaaacttgaaatgcctctaagcgctcgtaattgcgattgtaagggttgatgaccacgagctgtgagctatccgccaataattgctgaaacttggtctgcaggctcatttccgtcaatggcacactgggatgatcctgatcttcaacgggaatcggggtgtcaaacgaaaaactagtgccttccagcatcaaaagactcactttttcttccttaaaccgtttggcccatgcgtgaacccgatcagcatgcgggccgttgagccggacatcgcctgagtgcgcaaaacggcgcgaaccgtcatcgaccagcaacgccatgacacccggctcgtcgtgatcactgtgaaacccagtgaccgtcagatcgccaacggcaagcggggtttcaaaagcgagaggatgtaggttagcgaccggtttttcgatacccaactgaatgagcagtcgatagaggcggtaggacggttccgaaagataaatcgggatatccttttgcaagtactgcaaagcgcccatgtggtcaatatgcagatgggagataaaaattgcttcgtcggaaaaatgatcaggttgattgaaaaagagttccggcacatgcggcagttttccctgctcgagggccgaagctacagtttcctggcttaaatcagccgcaaccccaaagtccatgatgacccggctggttttagtggcaaactcgacaatatttccgccaatggtatttaacccatttaaaaagcgaattgtagtcacgtgatttcctccaatgtctcgtcaatatttttgagaacattaaatcgtactccgcggatgtttgaaaagcaaataaagaatttcatttgagcaatcatagcggccaggtatcgcttgaaacaaatcgaccccagagacgcggtgcatctctggggtcgatcatgtctggcgctatttaaaacaatgcttagcttcaatcatctacgcgaatgattgagctgctttacttgtttgtcttgataatggtttcagcttggccttgcaaggtctttaatgcctgttccggtttttcgtgtttcgtcagcatagcatcgaccgcgttcagaagatcgttacgatattccgagaagccgataaatgccgtggactggaaaccaaagccgagggaatcaacggcagccttactggtttcgttttcattcagatatttcttgaagtcagctgattgaaccgcggacttacgcagtggaacataaccggtcagctgggcccacttggaagtttccttttcagatagcaggaacttcatgaatgcccatgcgcctttttgctggtcggttgaagcggacttgaagaggacaatatcgttaccggcgagttcggtcgctttcttgcctttgtaacttggcagcggcatggtgccccacttgaagtctttaggtgcattttgcttcatgttcgtgatcccggcacttgaaccggcatagaagagggtcttgccggaagtgaagttcttgtcgccgtaaatatcttcaccggcagttttggcttcaccattgttgaccatgtccatgatgaagttggctgcggtgatggtcttcttgctgtccaagttggctttcaatggcttggctgaaatgagcggattgccggcttgacgggctaagccttcaaattccatatcgaaactcttgtcaaaaccaatcgcggcaacgccatcagccttcagcttgtcggcatctttcttgatgtcttcccaactcttaggcttgtcgatgttgtacttcttcatcagggcttcattatagaaaaggattcgggttgatttggagaaaggtacactgtagtacttgccttgatacttcgagcttgacaggaaggctggataaatatccttcaagtcgctggcactcatcttgttgtcacccttcagcatgtactgatcgagtggggtgataaaaccgtttttaacgtaatcaggaacggtggtgtaggtggtctgcgcaatggttggcaggttgcgtgacttagccgcagccataatcttttgctgcagggccgtgtagttaccttgggcggttccgactaccttgtattgcttttgactcttgttgaaatcggtaatgatttggttgatggctttttggtaagggccgttcatgccatgccagaaggtgatggtgacacgtttgcctgaatcgctcttagttgtggaactggatttgctgctgctgttgctaccacacgcggttaagacagcaaccagtgtgatcgtcagcattgcaagtaagactcgttttacccaattttgctttttcattttgatagattatcctttcaatccagctttagaaatcccagcaataatgtacttctgcaagaagatatacaaaatgaccattggaatgatgacgaaagtagaagccgccatcaaaagttgatattgtgtgccggcatcggtcgtaaaggcctgcaagccgactggcagggttcgcatcttatcggagttggtgacgatcaacggccacatgaaggcgttccatgaaccgatgacttgaaggacggtcaccgccgtgatggtggacttgctcattggtacgagcacctgccatagatatttccagtccgaggcgccgtcgattttggcagcgtaataaatctgatccggggtggactggaatgtttgacgtaaggtgaaaaccgtaaagaaactggccaaccatggtagaatcaacgcgccgtagtggtcgatttgccctaaatgcgacaaggtcacaaagttagggatgatcagcatttccccaggaatcatcatcgttcccaaaaagatgatgaataaaatgtttttgccgtaaaacttcagccgtgcgaaggcaaatgcggcaagaatactggtgaaaagctggccgaccgtggtgacgaccgtgacaataatactgttaataaagtactgaccaaacggtgcttcattccatgccttgacgtaattgccccactggagggacttgggaatccagatcggtggtaccgcaatggtttctggtgctgttttcaatgacgtcgagatcatccataggaagggaatcagcatggtgatggcccctaaaataacgatcagatagagtaaaaccttactgagctttttagccattttttgcttccccccttaatagtgaacgtgcttgcgcgaataccacaactgcacgagtgtcacgagcaagatgaggaagaaaagcacaacgcctgatgccgcggcgatcggatacttatactcggtgtaaaacttctggtacaagtaatacacaatcgtcaaatcggccttacccggtcccggtgttccttggaacaaggcaaagatttcatcgaagactttaaagctaccgataatcccattgaccgaaaccaggaaggtaatcggcgaaagcatcggaatggtgatgttccagaatcgttgacgagcattcgcaccgtcgatttccgccgcttcatagtagccatgatcaatgttgttcaagccaaccaggaagagaatgatgttaaaaccaagacttttccaaatactcataatgatcagcgccagcaaggcatagtgcgggtcggtcagccagttaatcggatgaacaccaaaccaactcaagaagtaattgaccaggccgtaattgccatgaaacatccagttccagaccatggcaatggcgacggtactggtcacgaacggcaagaagtagacagttcggaaaaagccggaaatgatcttgacctgattcagcagcaacgcaatgatcagggatagaatcaccgttatcggcaccacgccgaccacaaagaccaacgtattccgcacggcaaggtgaaagtcaggatcattccagagatagacgaaattgtcgaatccccagccgctcaccttatccgtgtaaaagtcatacttggtgtaaaggctcattaaaaaagaattgatgatcggccagatgttaaaggtaatggtaatgacgagcatcggcagcaaatacaacgctgcctttgctgtcgattttaagctggctttttcatttagcatgactttcaccaccaaaaatcaaggcgccagactgatcaaagagaaagaatcctgatttggtgagataaaaatccaactccggttgactaccggaaacaccggccatttcggtcgacaagagatgttcaccgttgtaagtaatattggcggtggcttcccggccatatttagaactttgggtaatcttgccatggagtttggccaacacattctcaccggcatcgtaagggatgagtgcttcactgcgaatgccggcggtttcggcttgcttcaaaatatcttccggaacggctcctgcaagatcggcagctaaggcctgtgccggaatggtgttaatgacaggttcgccgataaacttagctacaaacaggttattaggctgatcgtagagtgtctgcggtgaactgaactgctgaatcgacccattggccagaaccatgatattgtcggaaatatgcaaggcttcatcctggtcatgggtgacgaagatggtcgtaacgccggtttcgcgctgaattcggcgaatctcttcccgcatctcgattcgcagccgcgcatcaagattggagagcggttcatccagcaacaataggcttggtgatttggccagcgcccgcgcaatagcgacacgctgctgttggccgccagacaaggcacccggtttcttgtcaagctggtcttcgacatggaccaacttggcaagatccttagctttagcgtggcgctcggccttgctgactttagccattttcagcggaaaggcgatattgtctaacactgacaagtgcggatacagactgtagttctgaaataccatgccgactttacgggctaaggcatcttttttggtcacatcggtgtcaccaaaaaagatttgcccagcagtaggggacaacaaccctgaaatcaaattcaacgttgtggttttaccgccgccggaaggacccagcagggaaaccagcgtgccgtcgggaatggtaaaattcagatccttcagggtatctgtcttgccatcgtaggacatcgtgacgtccttgaaagtaactttcaacccagtacgctccttcaaatagttttctgctcctcacctccgttcgtcggtcccgcatggtttgccaaacagggtcgcgccaaaaagaaaatttggaacaagatattgcgtcgtagctataccacttgactacatctagtaggcagcaactcaacacaactcttcacatattttaacccagaacggcggaaaattggacttattcgcttaaaaacattcgattaatgatccggaagcggtaacacgcgaacgttcgctttttttgctataataaacaacaagaaaaaggagcgatttttgtgatcatacgtccaagtaaacctgcggatgccgctcaggtggcaccgctgattgatattgtttttaccgaaatggaaattccgcaactgatgcgcgtgccgaagaagacgctttatgcagtattgcaacaggcatttcttctgccgacttatcgctacggctatccccagatgctcgtggccgatcaaaatggcaaaattgaaggcatcgcagtcggatatctgcacgaacaggaggcacacattgatgacgccttgcaaccgttattgccaaagctgggcttaacgccacaatccttgctgtttacggataccgaaacttacccgggagaatggtatctggacacactggcagtggcgccaagtgctcaaggccatggcatcggcacaaaattgctgcaagccgttgacccggttgcccgctcacgcaaagcagatgttgttagtttgaatgtcgaccagcaaaatccgcgcgccaagaaactttatgaacgcaatggctttgttaaaaacggtgaactcatgatcggcagtcaccgttatgatcatatggttcggccagtgggtgagtagcggctgagatttgcggcagagacacaatgcactaaacaaatagacatcagagatgcattttcttctctctgatgcctatttgtttgagaaacttttctaaaccagacgctaatccggaaagtctaggccatactcgtaacgtttgagcggatcggccacgccgacgtggcggaagcgatcgaggatggcggctagcaaaatggcggctggaatgtcacgattgttaggaatggttagcttgacgatcgccggggcaacttcttcagcactgaaaatcgttttaacgccgtggaagacctggtaatggttatttaagagattccccatagccacccagttgagttttgaaataaaaataaattgatgccagacgccgaacatttttttgacgctggcaacattccggttggcgatgtacagatcatatcgcgggaaaacactaaccgttttctgccggatcgaacctaacgggttgccactgagcgtattcaaatcgaaaccaccgttaatgagaccgtgacgggcggtcagaatgtaggcaggcttaccattgtcggttttgaccacactaagactgccggtactcaatgcattgatgtcaagatataacgccatttgctaacctcccttgaaggtttgcatgatgtggttcagttgtcaatcctagaaacgcgcgttagttgcttccgctttattgatccgaatggctttgcgaatcgcctcggcaacgccattttcgccattggtgccggttgtaccccaggctaagtcggtgatttcagggatcgcgttgcccatggcgatgccgtatttggccattttgatcatgctggcatcattcagattatcaccgatggccatgacctcatccattgtgatgcctttttgtttggcataagcttcaaccgcataacctttctgcgccttaatattgttgacttcaatattgttaacggaactggatgtgacacttaatttgccggtcgctttaaatactttagccggagcctttaaaatgtcaggagtttcgccggtgtaagcgatgattttcataatcttaatcgtcggatcgtccagtaatttttgatagtcatccacataattaatattcatgatttccaaccgggcagccgccaaagcaacggcgagcttgtaagtggtatcagggttgagatcgactagcaagtctgccacgttctgaatgcgcttaacccgactgtcggaaaagacgcctttgttagttgtgatttcaaagtagatgtcggctgcttgtaaagtatcgataacgtactggcttaaatcatcggcgatagggatggtgacaaccggtttgccggcctcgtcaaaaaccatggcgccgtttaacgtgatgaacgcgggctttagctgctgtgccgccaataatggcttggcttcggtaacaccgcgcccggtggcaaccatgaactcgataccagcggcttgcgcttcacgaatggccttggcattttcgtctgagacttccattttgtcattcaaaagcgtgccatccatgtctgatgcaataagtttgatcatattactgtcccctccggtttgtcatggtgcgattacgtccttaattttagcatgaaaagcggttacccggtagcaaacgcgcagggattcttgtacactatttgcggaggtgcagcttttgaaaacattaatacataatgattggcagacggtgctggaaccgatttttgaaagtcccgagtatgcccggctgcatgagttcttaaaggaagaatacacgaccaaaacgatttatccggaaatgcatcacatttttcaggcatttgaatggacgccgtttcatgacgtcaaagtggtcattttgggacaggatccgtaccataatccgcatcaggcggtgggggcgagttttgccgtggcgcctggtgtggcattgccgccgtcgttgcaaaatatttataaagaattacaaagcgatttaggctatccgccggtacatcacgggtatctgaaggcatgggccgatcaaggggtcttgttgctgaatgcggtcttgaccgtgcaggcaggccgggcttattcccaccagaatcatggttgggaggagctgaccgatgcagcaattgcggctttatctgcgcgtggcggggttgtgtttattttgtggggcaatgctgccaagaagaaagctgcgttgattgataccagcaaaaatgcgatcattgcctctgcccatcccagtccgttgtcggcatctcgcggctttttcggcagccgaccattttcccgtaccaatgaagcattgaagaaaatgggcgaaacgccgattaattggcaactgccagaaaccgtgactgcggcgagttaatcaagtcacgtaaagtgtttttccattgtcttccgctggtcacgacccgataaaaacggtatgatgttaaggaataaagcgcttttatggagggataagatttggatttatttgaaagcttaaaagacaagattaacgacaagcatttgcgcattgtatttccggaaggcgaggatccgcgtgttctaggagccgcggtacgactgaccgccgatggattggtgcaggcgattgtactgggtaaccctgagaaaattcataacctggcaaccgaaaaaagctgggatttaagcaagttgacggttcgcgatcctgagcatgatgatcttcacgccaagatggtgaccgcgttcgttgagcggcgtaaaggcaaagcaactccggaacaggcggaaaagattgttcaggatgccaattattttggcaccatgctcgtttacatgaaagaagcagacggcatggtttccggtgcggtgcattcaacggctgataccgtgcggccggccttgcaaatcatcaagacccgtcccggcgttcatcttgttagcggcgcgtttatcatgcagcgtggccgggatgaacggtacttatttgcggacaatgcgattaatatcgatccggatgccgatcaactggcagaaattgcggttgaatcagcgaaaaccgctgctttgttcgacattgatccgccacgcgttgccttgctgtcattttccactaagggaagtgccaaagggccacaagtggacaaagtggtggccgcaacccagaaagctcacgagctggcaccggatttggcattggatggtgagttgcagtttgacgcggcgtttgtcccgaccgttgctaagcaaaaggcgccggagtccaaagttgccggtgaagccaatgtctttattttcccggaattgcaatccggcaacattggctacaaaattgcccagcggtttggcggctttgaagccatcggcccgattctgcaaggcttgaatcagccggtttccgacctcagtcgtggcgctaacgaagaagacgtctacaagttggccattattacagcggcccagaccttgctatgacaagcttgaaaaaagattttaccagcgaagccgaactacaggcattcgccgcttcgctaggtccgcatttacaggcaggggatgtccttctcttagatggtgatcttggtgctggcaaaaccagctttaccaaaggcttggctaagggactgggtattacggattatgtcaaaagcccgacgtttacgattattcgcgaatatcgtcacggtcggctgccactgtatcacatggatctttatcgcttggaagacggtggtgccgaggacctcggacttgaagaatactttgaaggcgacggtgtctcggtcgttgaatggccggattttctaggcgcaagcgaacccgaagccgatttgctggtgcactttcaaaaagatgagcagtcggatacaacccgtcatcttgaatttgttccccagggtaagcgttatgaaacattacttcaaagcttaaaataagttcggcgacatcgatttttatttcaatttcaactaaaatagcactgagaccggtggtggctccagtgctatttttagtgtgataggttaatcattgcccgtgatagttaaaaattatattttgataagcaaagtatacatgctacactgttagcaatgtggcgtgtgacatggattaagaaagtaggtgtgccatgttagcagttaaagatctcgtcaagacttttggcaccatgacggcggttgatgatgtgagttttaccgtcaagcctggcgaaattatgggactgattggccaaaacggggccggtaaaacaacgacgttccgaatgattttgaattttttgaccccagacgccggaacgattacctggaatgaccatccgttaacggccaaggattatgacatcatcggctatttgcctgaagaacgcggtttatacccgaagatgcgcgtgcaggatcagattatttattttgcccgattgcgcgggatgaagacggcggatgtgaaagcccggattcccgaatggctggaacgttttcaggtgaaaggcaaggcaaccgataaaatcaaggacctgagcaaaggtaaccagcaaaaagtgcaagtgattgcgaccatgattcatatgcctaaactggtgatcctcgatgagcctttctctgggctcgatccggtcaatgcaggcttgctaatggttgggattgagatgttaaaagacaatggtgcggcgattatttattccagccacgatatggccaatgtcgaagccatctcggatcatttggtgatgttgaaacaaggaaagatggtcttaaacggcgctgttggtgacatccgcgaaagctttggccggacgaagctcttcattgaatccggtttaacccgagatgatttgcaagcctttgacggcgtgacgaacattcgtcaacatggtcaggaatttgaattgacgctggcagatccggcagtgggccgccagatttttgaaaaagcggtcgccaatgggtacataccggaatttcggcaacaaccaccaacgcttgatgagattttccgcttgaaagtgggtgaaacacatgcataaattctgggtcgtcatgagtcaggtttacaaaaagaatgccaaaagcggttcgtggatctttttggtcttatcgccattgctttttctggcgattggattcggcattgctttttacattgccaaaacgcaggcacccgcccaagtggcagtcgtcagcgatgtcagcgcggtcagtcaggcattaagcaagcaaaacaacgatgatttgcattttaaagtgtactcatcgagtaaaaaggctgatgcggcgctgaacgatgagaaagttgacggcattttaaccgtcaatgccaaagatcaattccgttcgcgctatgtttcgcgggataacggccaagaggttgataaaaccactttggttacggccctcagcggcttaaaacttagcagcaccgcagcaagtatgcatctcacggcagcgcaagtcagtgcactgacgcaaccgccaatggtcagcactaaaacggtggccatcgaaaacggcaaacaggtgaccaagtcaaactcaacgcaattgatgaatcacggggttgcggttgtggccatgattttgatcctgatggtgaccatggtttatggctcgattcttgctcaggaaattgccacggaaaaaggctcgcgcatcatggagattcttttgtcctcggtgagcgcgaccacccaattcttcggtaaactggccggaatcttcgcgttgttactgacacagctggcaatttatgtggttgccggggtgattagttggcaattcgtcaaaaatcagtcgtttgtgtccggtgttttgaaacagtttgacttctcgattctggtgtctggcaccacagcaatgattgtcgtcttcttcatcatcggcaccttgacctactcagtactggctgcactgaccggttcgctggtttccaatcaggaacaggtccaacaggcggccatgccgattagtatgctggggttgattgggtatttcattacgattgcggctcaatcaagcgattcggctttggcacagattacgagctatgtcccattcctgaatgttttcgtgatgcccacccagatgtcactaggccgcgcaagcatgggtgaggcgtggatcagcgtcgccatcagcctcgtcttcctcgtgctgtttaccatgtttacggtaaaagtctaccggaacaatgtattggtttactccggttcaggcttgtggcagtcgatgaaaacgtcctttagcatctggaagtcagagcatagtgttgctaaaaagtgatatagcaggataaagctatcttctaaatcagtttagtctgggtcataattcatagctataataaaagggtgaacatactagcgataagagtatgttcaccttttgtttccccaaggtaatttgttgggttatttaagatatgagtgccaaagcggagcaatcgtaggccagatggggctcagtggtgcaattgtacttgccgggcgatcttcccggcgtagtacaaggccgagcttagagactctgccggttttgcagaggctctaagtcgtgcccaccacgttccagccccggctggccggagattgcggagtttggcatggcatgaagaccgattgcctaagctttgcttggtcatcaaccagccttagccagtttcatcataactttcgttcgggcttcgccaaaatgttcgttctcggcaatgagaattcgtgcgcaggcataactatctgccaacgcgttgtggtgatgttccagcggaatttttaacgcagcactgaccgtatccaaccgatgattcggcagcttcggtaaaaattgccgtgaagtccgaacagtgtcgatcacctgatagcgcggcgcagcgatgccataccggtcaagtgtcaggcgcaacaccgacacatcaaacggggcattgtgagccgtgacgatgcgacccggagtataaaacatctggatatgtggccaaacctgatcaaacgtcggctggttctgaaccatatccggtgtgatcccgtgaatgcgaatattttgcggatcaaagcgcatctgcgggttgatgagcgtgtagaaactatcaacaacccgattttgctgcacgaccactaaggcaagcgaacaggccgaggcccgtttgcgattggcggtttcaaaatccatggcaataaagtccattgtttaaggctcctatagtaaatcttgcgtggtgagttcaaccggacagtggtcactgcccatgatatcggtaagaattttggcatctttgacatatggctgaaagtttgaactggcgacaaagtagtcaatgcgccacccggcattattggcgcgcgcgtggaaccgataactccaccaagaataagtgaccgtgtcgggatagagatggcggaaagtgtcgataaagccgctcttaagctgcttggtaaaatcagcacgttcctcatcggtgaacccagcgttgtggtgattggtcttatcattcttaaggtcgatcggttcatgggcaacgtttaagtccccgcagtaaacaaggggctttttggctgccaactggttagtatagtcgcgaaaatccttatcccactgttgacgataatcgagtcgcttgagctcgccgccagagttgggagtgtaaaccgtcatcaagtaaaacttgggatattcaagcgtaatgatgcggccttccttatcatgctcgggaatgcccatcccataagtcacattgagcggtttgtgtttcgtaaaaatcgcggtacctgaataacctttgcgttccgcgtaattaaaatactgatagtaaccaggaaggtcaagcgtcacttggccttcctgcattttggtttcttgaagacaaaaccaatcagcatccagttcattaaaaatggtcataaagtctttttttaagacggcccgcaagccattcacgttccatgaaattaatttcaaaacgttcactcctatcgctacattgctcttttattctactagacttttctaacaaacgcacggagaggtcagtgttcacaagcgtcaaattctgctaaaatatataagtagtcattttgaaaggacctgatgttgtggtagatgcaccacggatgcttgaagggatcaccatcatgcatgatgaaccgttaagccattatacgtttacaaaaaccggtgggccagccgatttactggcttttcctaaaaacgttgccgaggtccggactctggttgaatcggtgcgggaacagcatttgcctttaacggtcattggaaacgcaagtaatttaattgtgcgcgatggcggtatccgtggactggtcttgattttgacggccatgaacgagattacggtgacagataacaccgtaacggctcaggctggcgcacgcctcattgacacgaccgaagctgcgtatcgcgccggattgaccggtcttgagttcgcggccgggattccaggtagtgtcggcggcgcacttttcatgaatgctggggcatacggcggtgaagtctgcaatgtcatcagcagcgcccatgtgttgacgcgcgcaggtgaattcaaaacctataaccatcgcgaattgaagttctggtatcgccatagtattgttcaggataccggcgatgttgtcttaagcgttactttttccctgaaacccggcgataaaccggcaattcgcgccaaaatggacgaactgaatgcaagacgggcggctaaacagccattggaatatccgtcttgcggttcagtctttaagcggccgccgcatcattttgttggtccgatgattcaaaaggccggactgcaaggccacattattggtggtgcgcaggtttcaatgaagcatgcgggctttatcatcaacttaggcgacgcaactgccactgactatctggatatgatccacctgattcagaaaacggttaaagccaaatttggtgtcgatttggaaactgaagtccgcatcattggcgaacccttgcagtcatagcctacattcaaaataaaagaaaggggccccacaatgcatttagtcgaagccgtcttgtttttgatggcgctggtcatcgtgtcaaacgtgctcagccactacattgtcgctgtcccggtatctttgattcaagtcgcgctgggactcggcgcggctttgttttttcatttaacgataaacttagcgactgactggttcatgctcttgttcattgcgccgctattgtattacgatggtcgccatttcccgcggcgagagttgtgggaattgcgcggcccgatcatcggcaatgcgatttttctggtttttgccacaatgctggttggcgggtatttgattcattttctgattccgccgttgccattaccggcgagttttgccttagcggcgattcttagtccgactgatccgattgcggttcagagcctggccaagcggactcatctgccgagtggggtcttacacttggtcagcggtgaaagcctgatcaatgatgccagtggcttgatcggcttcaaatatggcattgccgcaacgctgaccgggacatttgcttttggacacgcggttcaggatttcttctatgtggcgttagttggcgcaatggctgggcttgttttaattgggatcatcaacctgagtcgtaactggttattgcaacaagggatcaatgatgtgattctgcatacgattttgcaggtgttaacgccattttttatttatttgattgttgacgaattcatgcacgcttccggcgtaattgctgtggttgtggcggggttactgagcaatacgcagcacaatcggtatgtggcggcgttaccggagttaagaatcgtctcggagcgaacttgggatttaattgtgtacacgcttaacgggattattttcctgatcctgggcattgagcttccggtggcgatgcgcgatacgattgctgatcatgaagtcagcacgttacaggcactcggctttgtcgtgttggtctatctaggcattctgattctacgaaccttatggatttatggctacatgttgctgacagtgcggtcaaaaggcaaccagccttcatggcgcgcagccttgttgagtggcatttcaggagttcgcggtgccatcaccttggtcggggtgtttgctgtaccggctgcactggccaatggcgatccgttccctgagcgcagcctgatgttatttattgcggcaggcgttgtggtgctgagtctgattgttgcgatcatagccttgccgatcgtaacccgatctgtcgcacctttgcaaacgcgtggttccaccatcgcggcgaccgatgatgagactgaagctgatgaggatcacgccaatgatgtgcggattatttcgttgagtcaggcacagatgtttgtgtaccaaatggccgtgcgccgcgttgaatcagagcgccgggaaaataatcaaaaagcggcattggatctcatcgcggaatatcaaaatctgattcggcgactggaactggctgaagacaccggtgccgcgattccgccgctggtccaagatgaacttgacctgcgcaaagtcggggttcaaggcgaattatatgcgttggatgatttgtggcgcgaaaataaaatcatgtcaaaaagttacgccaaagcgcgcaagcaattaaagcaccgaatggatgatttggactcgatggctaaacgctcaggacggccgacgctgcgcatgctttttgaccgttccgcgttgcgactatcacacttctggtacaccgtggccagtgagcaaaaccgctcgcatcgcttctttaacgagaaattgttcattgaaaaagaaacggcaaaaggcgggttgaagtacttgtcgaaatttctccggcaaaaagaaaacaaggcccaccattacaatcgccaggtgatttattcattgattgtccagtaccgcaatcgcatcgcctcggtcaaggcgttgaatacgcataaatccacccagtacgaacatgagctaagtcgattgcgtgccattgcgtttgctgcagaacgaacagctatccatgatttgatggaaaaaggctacatcaccatgacgatggcccagcggctgaatcaaaatgtcaactttaccgaaaatgcggcgactctgacgtctttagaagaagtttgattctagaagactgacaagattggtgtgattcttggttaagaaacgaatggcgacatcatgttttctcaaaggaaaatgtgatgctgccatttttttgtgctgctaacgatttgtggcggtatttattaaattttcagacacgtagtcttgcatgaaaaaatatttctgcccatctcagttataaaagcttgcgttggtgcatgacatttgtataataggcagagtcagtaaacttgaagtttagtttaacgaaacctaaaaaggcggtgtgccatggatattggcagtaaaattcgtgatctgcgcattcgaaaaaacctgacgcaggaagaacttggcgaacggacagatttatcgaaagggtatatttcgcaggttgaacatgaccagagttcaccgtcactcgagaccttctttgatattctgagcgttttaggcgagtctccggcagactttttccgggaagagccggttgattcgctggtttaccacgaagaagatcaggtcacttatcttgatgaagataaaggctatcaactgaaatggctggtgccggaaagtaatgaaaatgagatggagccggtgatgatcgattttgcgccggatggcattttcaaaacgtttgaaccatccccggccgagacttttgtttacgttgtcagcggtaaagtaaaactgctgctgggcgatcaggcttatgttgccaaaaaaggcgaaaccatttattttcatgcgacgaaacaacatcaacttgtcaacgcagcaacgggtcgcagcaagtgcctgctggttgcgacagcatcttatctataaggagttggggtcattgagcaacattattgtggaactgaagcatgtcggcaagcgttatggcgacacgcaagtattaaaagatgtcaatatcgaaatcgaacaaggaaaattctatacgctgcttggcccgtccggctccggtaaaacaacgattctgcgcgccattgcgggatttttggatgtctcggaaggtgaagttctttttgatggcaaaaaaataaacgatgtcccggcaaatcaacgcaaagtgaataccgtttttcaggattatgcattgtttccgcaccttaacgtttttgacaatgttgcgttcggattgcggttgcatcgcatgagcaaagaaacgattcagactaaagtgacggatgcgcttaaaatggttcggctgcaaggttatgccgaccgggagatttctgagctatcgggtggccaacagcaacgcgtcgccattgcccgggcgattgtccttgagccgcaagtgttgcttttggacgaaccattgtcagcacttgatgccaagctgcgtaaggatatgcagtacgaactgcgcgaattgcaggaacggctggggatcaccttcttatttgtgacccatgatcaagaagaagcgctggcactgtcggatgaaatttttgtcatgaatgatggccaggtccagcaaagtggcacgccggtcgatatttacgatgaaccggtcaatcactttgttgcggactttattggcgaaagtaatatcatcccaggccatatgattaaggacttcctggttgaattcaatggtaagcagtttgaatgcgccgacgccggcatgcggccaaatgaaccggttgaagttgtcctgcgtccagaagatttggacatcacggcagccgatgccggtaaagtgaatgtcgaagttgatacccaactgtttcgcggcgattattacgaaattgtcgcgtacgatcaactgaaaaacgaatggttgattcactcgacaaatccggcaaaagacggggaaacagtcggattaacctttgatcctgaagatattcacgtcatgcggttgaacgaatccgaagaagaattcgacgcacggctggaaacctatgaaggcgactgatccgtggtagggggatcggtgttctgtcggcgtttgtagtctggaaaaaccaacacttggcaggcaccattagattttgaatctgaggagggtcatcgtgaaaaaatccaccacgaatgttgcattttacacgccttatgtgatgtggcttgcactgtttgtcatcgcgccaatggtgttgatcgtctatcaaagcttttttgatatcagcggccattttaccttggcgaattaccaaacttattttcaatccggcacttatattatgatgacgattaattcggtttggtatgcttttttgatcacctttgccacgttgctgatcagttatccgactgcttatctgctgcattatgccaagcataagcaattgtggctattgctgatcattttaccgacgtggatcaacttgttgctaaaagcatatgcgttcatcggcatcttcagccaggacggcggggttaacagtttcttaggaatgtttgggattgcgccgcaacaatttctctttactgatttcagctttattttcgttgctgcctacatcgagattccgttcatgattctgccgatcttcaatgcgattgaagaactaccggaaaacctggtgaatgcttcgcaagatctaggggcaaaaggctggcagacctttactaaagtgatttggccgttgacgatttcaggggtcaagtcaggggtccaggcagttttcattcccagtttaagcctgttcatgttaacccggttaattggcgggaatcgggtcatcacccttggtaccgccattgaagagcattttttgacgacaatgaactggggcatgggctcaacgatcggcgttgttttgattgtcgccatgtttatcatcatgttcctgaccggtgagcgaaagaagaagggggtgcgccggcatgaagcgtaagtttaaatggtccaacctttatctgattttcgtgttcatctgtctgtacgtgccgattttttatcttgtgatctattcattttcgactggggatcggatgagcaacttctccggcttcacctggaaacattacgctgagttatttgcggatacgcggatgattcagattgttttggatacgttgctggtggcgttgctgtcgagtttaattgcgacgattatcggtgcattgggcgcgctggccattgatcgaaccagccgtcccgtgatgaaaaatacggtcttgtcactcaacaacattctgatggtaagtccggatgttattatcggtgccagtttcctgattttttacacggcgctaaaggttccgctgggattctggtcagtgctgatgagccatatcgccttttctatcccgattgtggtgctgatgatcctgccgcgtctgcaggaaatgagtcactccttgctggacgccgctcgtgacttgggtgcttccaactatcaggtgctgacacgcgtgatcgtgccgtacatcacgcctggtattttctcgggattctttatggcctttacgtactcgctggatgattttgccgtgaccttcttcgtcaccggcaatggttttgaaacgttggctgtcgagatttacgctcgcgcccgccaaggtatcagcttggaaatcaatgcgttatccggggtcatgttcgtctttgccttactgctggttgtcggttactacttcctccaacgggcgggtcaaagccggcgggccaagcacaagcgagaaagcgaggcgttgatcaatgaaacgactcattagtattgcggtcgccatcctggccgtctgcctgggattagccgtttggagtcaggacctgcaaaaatcccaaggcaataccggcgacaacacgctgaatcttttcaactggggcgattatatcgatcctgcattaatcagtaaatttgaaaagcaaaccggctatcacgtgaatcaggaaacattcgattccaatgaggccatgtttaccaaaatccagcaaggcggcaccagctacgatttgaccgtcccatcggattatatgattgagaaaatgaaaaaggctaatctgctattgccgcttgataaaagtaaactgaacgggatgcagaatatggatccgcgcttgattaacaaagaattcgatccgggcaataagtacagcattccctatttctgggggacactggggatcatctataatgacaagttcgtcaaagccagtgaagttcaacactggaatcaattatggaatcctaagttcaaagattcgatcatgctcatcgactcagcgcgtgatgttttcgcgccggctttgatctcaatgggccagtcagttaacgaaaccaatccgcagacgctggcagtggccaaagccaaactcgatcaattgtcgcccaacgtcaaggcagttgtcgccgatgaaatcaaaatgtatatggctgaaaacgaagctaaaatcgctgtcgactggtcaggtgaagccagtgaaatgctggccaacaataaacacctgcactatgtcgttccgcgagaaggcagcaatctctggttcgacaacctggtcattcccaaaaccgccaaacatttcaaagccatttacgcctttctaaacttcatgatggagcccaaaaacgccgctcaaaatgctgaatatgtcggctatgcgacgccaaacgccgcagccaaaaaactgctaccaaaaagggtccaaaatgatcggcaattctatcctgatgacgagaccatgaagcaccttgagatttactcagaccttccgccggcgaaagttgggctctacaatgatttattcttagaatttaagatgtaccgccggtgagaaaccacatctaaaaccatccgcatcagttgggggaaagtccctgattgatgcggattttttgttttgaatttgtgatggtttttatagtatcaaacaagccgcaaccattaagcctccaaaatggtgtcaagtcatcttaaccagacagattgaaagaaagcatacagtagtcccaggcagctcaatcaggtatgataggttgtatatgaggtgacccaaatgagaaaacatagtcggcacaacgaaggtttgtggctcgatatcatttgttgtctgagtctgtggttggcagtggtttgtctgctattagcagctttggcaattaaagtgaaccgaccttatatcatcatcatgctggcctttggactttgcgcactaggtgagacggtcacggtttttaaaaagtggtgatactgcagctggtctgttccgttaatccggttggtgaggcaatgagaacacatagagtcattaaaggcttacaaacaatgaccaactagaaaaggtccaaaaggcatatgtaacacatgtcttctggaccttttttaattgatttacaacacacgggtcgttaacgagtagcgcttgacgcacgcgcggtagccgtgactttttcacgcgataaacgccggcgattaagccatttgcggccttcttcgattaggaagaggggaattggaatgattgccaggaaaagccagtcggtcagtgctagcggtccggtgtggaagagattctgtaagaatggcgtgtagctaagcaatgctaacaaaaagatttcaaagccaataccgaaccagaccaaatgattagtgaacaaaccgactttgaagaccgaagcattttcggtgcggcagttcatggcggcggcaatctggcagaagatgatcgcggcaagggtcatggtcgtggccatgacgtaggttgagccgctggttgccaggccgcgtaacggccagccgtttagatggttgacgaagaagtaagcgccgctggaaatgatggatgcaattaagccataccaggcaaacgccttccataaaacagtgcggttcataaggtgagcatcacgtgcgcgtggcggtttatccataatgccaggctcggctttttccgatcctaatcccagtgccggcatcatgtctgttccgaggtcgactgtcaggatttgcatgacagtcaacggtaacgggatggcaccgcgcgagaagaggaagagcgcagatggtaccgcttctggcaggttggagttcaaaatgtaaaccaagaacttttgaatgttgctgtaaacggtacgaccttcttcgatggcggcaacaatagaggcaaagttgtcgtcggtaagaatcatgtcggcagcatctttggccacatccgttccggtgacgcccatggcaacgccaatgtctgcttttttcaacgcaggcgcatcgttcacgccgtcaccggtggatgcaacgatttcgcccatcgtttgcagagtggaaacgatcttatatttttgttcaggcgccactcgggcaaaaataatttcgcctgccagtgcctgcttgagctcgtcttggctcatggcatcgagttcactgccggtgacgacacgcgctttgtcggacgtcaaaccaattttaacggcaatagacttcgcagttaacgaggagtcaccggtcaccatgatgattttgatgctggcccgatggcatttctcgatggcatcgtaaatttccggacgcggtggatcggacatgatggccaagccgacaaaggtaagcttggtttcggccgtctcaatcgtgaggttgtcgagctgactttgtttatcggcttcttgaggaacttcacgataagcagtcgcaattgagcgaaggcctagagaagcatacttgcggttggcagcatcgatcgcgtccttgtctgctgcggttaaaggccggactttgccgttttcctgaatggtatcgcagtgcggcagtaaatcgctgagagagcctttggtacagatggacagcgtgtgatcatcgtgctggtggatggtggtcatccgtttacgatcggagtcgaaggggagctctttaagccgcgggtattttttggtataagcattcacgtcaattccggatttttgcgccaggattacaagtgaagcttccgttggcgtccccagaatcttcggtcgcgcttggccttttgccggttcgacttcggtgtcgttgttgaatgcaaccagacgaatgagcagatccaagtcaggatcgctgccgtattgaactggtttgccgtctaactcaatatggccattattgacatagccttggccactcacggtataagtatgtgaccgggtccaaatatgatcgactgtcatctggttttgggtcagcgtaccggttttatccgagcagatcaccgttgtttcacccaacgtttcaacactgttcaagtctttgagtaaggcgtgtttcttggccatgcgctgcacgccttgggctagcgaaagcgtcaccgttggcagtaggccctcggggatgaacgcgacaatcatgcctaacgcgaaaataaagctttgagcgactggataatgaacgaagaagatggcagccacaaagaaaagaacgcctaagctgatggcaatgagcgaaatctgttttgtgagacgattaagctctaactgcagcgggcttaggctgcgtttttgttgttgagtcaacgcggcgattcgcccgaactcggttttcatgccagtcgcaaaagcaatggcagttgcggtcccggcgccaaccgtggtgccggcatagacaagattggattcagcgaattcgccttggccagcattatagtcaacctttttggattcggggacggattcaccggtgagggcactttgatcgacttggacggaagtggccttaatcaggcgggcatcaaccggtacggcattgccggcttgcaggttgaagacgtcgcctggcacgatttgggtagcgttgacttgttgcagtttgccatcccggtagacttgcgtataagtcggcaacattttcatgagtgagtccgttgccttttgggcttcatgttcctgccagtaactgaaaataccattaataacattgaccagccagatggcaatacctagctcaagggtgccggataggattgcaacaaacccgctcacccagagtagaatcgccatgacactggtaaagttcttaagaaagactagtaactgggatttttgcttttcacgggtaatcgtgttttcaccatatttggcaagacgcgcagccgcttctttttgacttaatccagttgacgttgtgtgcaagtcgttcagtaaatccgcaaccgattcagttgcaaacttgcgccgcgtctccttttcacttttcatgactcaagcacggctccttttttaaaacgtttaaatacattctaacgttctgtgggttgtaaaacacccaaaactattgaatttgggtgattaaaatttagcgatttatagctggtatatctggttttatcaggcatgtaacccgcgttccagaaatgcgacggcctcggaaaccgcagtctcaaggtcaaaatcagattgcatctccaagataactggcagcaggtaacttaaaatggtaccgaaaagatagcgaaggatgcgagtcagcggccagttaacaagtgcaccttcctgctgatagaaggcgagcagttggacggccttgtctatgaattgcttttgaaacttttccgccagtgcctggcttagcgccgcatcttgcaaaagagtggcggccagtatccgaagttgcgcctgattctcaatggcaaaggccatgcgattatgcacgatgaaggttagaaacgtatgcagatcaggtagttgttgctcgccgatttcatgaatgaactcagtgaatgcgttcgggataacttgttggatcatgggcgcgagtaacgcttggcggatgccttctttggttttgaactgcttataaaccgttccttcgctaacgcctgccaggtgggcgatatcttttgtgctggtacgatcgaatcctttttccgaaaaaaggctcagactcgctttcaaaactgcttgttgcttggctgacaactggctttcagcaagcgatgaggagaatagatccgtcagattatgcggctgcacgatcattcacttccttctttagtcagatttgtttaaacctgtcgataatgccgcatggtgacaagattcaggcttaaaaatagtaagaagaagcctaggagggcaatgacgtccggatacaacacacttaatgactggccttttgcaataatgccggttaacgcatcggcaccgtaataaagcggcattaagcgggcaatcggttgcaaccagccaagcatttgattcacaggaatcagcccggtaaagaaaatttgcgggacgacaaccaatgggatgaactgtaacatttgaaattccgtattggcaaacgttgaaatcagtaaaccaagcgaaagcgccgtgattgccagtaataagttgattagaaaaattgcggcaatgcttccgagaatttggattttaaagacgaacaaagcatagccgacaatcaagattgtttgaatcacagcaaaaataccatagcccaataaatagccactaataatttctcctcgccgcacaggagttgccagtaatcggtcaagcgttccggttgtgcgttcacgtaatagcgcgatgccggaaatcaagaaaacaaagaagaaaacgatgaagccaatcagaatcggcagtaaggtgtcaaagtaagtcgaattagccgatccgtaacgataatgagttgcgattcggtagtgagtagcagttgacgccggttgggaccctgctacctgtgcagttccacgcgtggaatgttgtaacgctgatgccagtttttgtaaagcggttgcttgatttttaatcgtagtagcagctgcctgcattttaagcttgatggttgccgcctgtaagccctgtttcaagagggcacttttcccttgatcggcattggcgagtaatagtgtcagtttgtcgcctttctgagtcaggatgccagcataatcgtgatctttgataagcatggtcagatcttcattgccgacatggtggagccggattcgatccgtatccaaggcctgaaccacagatgtatctacaccgtgtatccctaagtcggcttttgtatttgtgttggattggaaaaggaaaaagattaacgtcatgataaacaatggcgcaatgaacatcagtgccagtgtccgtttatcgcgaatcatttctttgaaaatacgactgatcaatgcattaacgcgcatcttgctgcctccctgcggccaaaaagaccgcttcgatcgaatctgtgtgataggttgctttgagttggtcaggggtgccttgggcgatggcttttccgttgcggatcatcatgagcagatcggcttcttcagcatcggccatgacatgggtcgttaaaataatcgtgacgccttgatcgctagctaatctgtgtaattcctgccagattttgcgccgtaattcaggatcaatgccaatggtcggttcgtccagaatcagaagcggcggtttgctaattaacgcgatggcaagcgataaacgccgcttcatgccgccagaataagttttgacgctttgatcaagcgctgattgcaagttaacgacatgcgcagcgtagcgtaattgttcagccatttgcgtctgcttgacgccttgcattttggcaaaaaaagtgagattttctgcgccggtcaggctttcgtaaagggcgtcagtctgagccatgaatccgatccgcgctagcagcaagcgattggggacaggccggttaaaaaccagtacctgaccggatcggggacgtatcatacccataatagttcggatcaaggtcgttttgcccgcaccgcttgggccgattaaagccaggatctgaccagggtttaaggtgagatcaatgtcactaaggacgattttttgaccgtaaccttgctgcagggcgatcacttggacaacgggttctcttgacatattttagccgctttctttttaaatgtagtgagtactcactcacttgctattatcacgacttttgccaaaaaagcaagcttatttttttgcgatcaacgccgcagcaccgcttcattcggttcagcgcccgccgtttaggcatctcgtggtataattattcagaagtttgatttcaaaccacaatggaggaacgcggatgcgcacctatctcgcaaatttattaacttggtccactcttatcaatctggttgacatcctcgtcgtctggtacgtcatttatcggttgatcatgctggttcgcggcaccaaagccgtgcagctgcttaaaggtgtttttgtcattgcggccatcaagatcatttcctggtttttgcaactcaaaacggttggctacctgacagatttggtcattacctggagtgtgccggcgctggtcattatttttcaaccggaaattcgccgcggcctagagcatcttggacgtggatcgttgattttccgctcaaacaataaccaacatgaagccgaaacgcgtatggtcaaagagctggataaggcgattcagtacatgagcaaacgccgcatcggtgctctgattaccattcaaaaaaataccggccttgaggattacatcgagactggtattccactggatgcggatattagtggcgagttgttgatcaacatttttattcctaacacgccgttgcatgacggggcggtcatcattcgcaacaatcgaattgcggtggccgcggcttatttgccgttgtcggacagtaacctgattcccaaggaactgggtacccgtcatcgggcagctgtcgggatcagtgaagtgaccgatgccttgacgattgttgtgtctgaggaaaccggtgaagtcacgattacgaacaataataatttgattcgtaacctgacgcgtgaggattacatgaagttcttgacggctcagttagtaccaaaagaagaggcacccaatccaaatccggttgtcagtttcttttcgcggctttttagtcaacgcaaaaagaaggagggcaagcaatgaatcgcttatgggataagccatgggttaatcggttgttagccttgcttctcgcgatcgggttgttcgcttatgtcaacgttgagagtatcaacaatacgcggcagaatgccaacgatgatacaaccttggtagcgaacaagactcagaccgtgaaagtaccgttgcaggttaacgccaatactgacaagtatttcatcactgggtacccatcaaaagtatcggttgcactgacaggaacggcttctttagtgaccatgaccgccaatacccagaattttcgggtggttgctgatttaaccaatttaggggttggcaagcatcgcgttcatttgaaggcggaaggtttgaacaaagatttgagctactcgatttcgcctaaatcagtgactgtcgacatccaggtgcgggacaataagaccatgccgattcaggttcgctataataaggccagcatcgcttccggttatgcagcaggtgatcctaagctttcggcgcgaaccgttgaagtgacgggtgcacgctccgtgattgactcgattgcccaggtcgttgccaatgtttcgttggcgcacaatacccgcaagaccgttgaccaggaagtgctattgcaagcgttggatgataatggcaatactatgaatgtggtgctatcaccgcaaaccgtgcatgtcacgttaccgatttcccaacccagtaaaaaagtaaatattgagttgaagcaaaccggcaatgcggcaagcgggcatacgtacgccttgtcgtcagacacaaaacaggttaccgtatatggagaccagcaaagtctggataagttgagtaaattgaccgttcctgttgatatcagtggcatcacttcgacaacaacgcggacgttcaacgtaacagatctcaacgacagtatttctgcggctgatccaaaaaccattaaggtgacggtgagtgttggcaacacagggactggtaatggtggtggtaatgacgatgatgatgtgggcactaacgctaacgctggcacgtcaaccgcttcatcgaattcatccagtgccagtagttctcaatcaagttcatcaagcgaaagcacatcagcaagtgaaaaataaccactggaagaaatgaggaaaaattaagatgacaaagtattttggtaccgatggtgttcgtggcattgctaataaggaattgagcccagaaatggcgtttcgactcggtcgcacaggcggctatgtgctgactcagcacaaagaggatgccagtcatcggccattggttctggttgcgcgcgatacccggatttccggtcagatgttagcagatgctttgattgccggattactgtcggttggcattgaagtgctggatcttggcgttatcacaacaccggcagttgcttacctaattaaaattcaaggggccgatgccgggattcagatttcggcttcacataatccggttgccgacaatggtatcaagttctttggcgcagacggttacaagctttctgacgaaacggaagaagaaattgaagctttgttagatgcaccggaagataacctgccgcgtccggctgcagagggactgggaaccgttgacgattatcctgaaggtgcgctcaagtatacgcaatttttggagcagacactctcggatgacttaagtggcattcatgtttgtttagacggtgctaatggtgctaccagtggtttggttagccggatttttgccgatcttgacacggacttcgatacgatggcaaccagcccggacggcttaaatatcaacgctgacgtaggttcaacgcatccgcaagcgttggccaagtttgtcgttgaaaaaggtgccgatgtcggcctggcctttgacggcgacggtgatcgctgcattgctgttgatgaagaaggcaacattgtcgatggcgataagatcatgttcattctaggcagctatatgaaatcacaaggccggttgaaacaagatacggttgtcaccacggtgatgagcaacctcggtttgtataaggcattggaagccaatggcatgaagtctgttcagaccgcggttggcgaccggcatgtggtggaggccatgcgtaaagatggctataacatcggtggcgaacaatccggccatatcattttgtttgattatcacaataccggagatggcatgttgacgggtatccacttgctaaatgtcatgaagaagacgggcaagaaactgtccgagctggcagccccggttcaggattatcctcagaaactggttaacgtcaaagttgccgacaaggataattggcaagcctatccggaaattcaagaagctatcgatacggttgaaaaagaaatggctggcgatggccgtgtgctcgtgcgcccttcaggtacggaaccattgcttcgggtcatggctgaagccaaaaccgaagacctagtatcgcgttatgtcgatcagattgtcgcagtcgttaagcgcgagatgggcagtcaaaaagattaagattcatataaattacatgagagtttaaccaaaaaagctactgaggaaaaatctcggcggcttttttgttgcagtgtttatggtaaatctgaagcaatcaaaccttgaattttcaaggttgatcgcgttttcgggatatagatatagaccaatgatcttacgaaaagtataccattgaaaatttagtattgacatactgccgcttaaaacatatagttagctttgtttttagcgataccaataaaaaaatctgtctaaaccaatttgtagacattaggaaaaggatgttgactatgtgtggaatcgttggtgttatcggtaagaaaaatgcaacccaaatcttgcttaaagggctcgagaagctggaatatcgggggtatgattcagctggcatttatgtaaacgatcaagccggtcatgaccatctgatcaagcgggttggccatatttctaatttggaaaaagcagtgacaccggatgttcagggcgtcatggggattggtcatacacgctgggcaacaaacggtgggccgaccgaagccaatgcacatccgcaggtttctaatgacgaacgcttctatctggtgcataacggggttgtgaccaacgccaatgacctgaagcagcaataccttcaagacatcgaactgcatagtgacacagatactgaagttgtggtacagctgattgccttgtttgcccgtcaaggcctgtctgccaaagaggcgttgcgcaagatattgaagttaattcaaggctcatacgctttttccatggttgatcgcctggatccaaccgtgctgtatgtggctaagaacaagagcccgcttttgatcggtcggggcaagggcttcaacgttgtggcttccgatgcgttggctatgctgagcgaaaccgaccaatttgttgaactcaaggatcaggaaattgtgacgctgacggctgataccattcacatcgaaacacttgatggcaaagtcgaagaacgtaagccatttacggttaaagttgatgacggtgaggtttccaaaggcacgtacccattcttcatgctcaaggaaattgacgagcagccaattgtaatgcgccgtttggttgaaaaatataccgatgatcaacatcatgtggtgattccagaagacctgatgaaggctttacagcaagccgatcgtctatatattgttgcagccggcaccagttatcatgccgggttagtcggtgccccgttgtttgaacagctggcaggcatcccggctgaagtacacgttgcttcggagtttgcttatcatcagccgttattgtccaagcatccgctgtttattttcctaacccaaagcggcgagacagctgatattcgtcaggtgttggttgaagttaagaagcaaggttatcagacactcaccattaccaatgtcggtagttcaacccttgcccgtgaagcaacatttaccttgttgctgcatggtggtccggaaattgcggtggcttcgaccaaagcctacaccgcccaaattgccgttgaagcattggttgccaaggccgttggggaagctaagggtctgcaagcagctaaggactttgacgtcattcaccaactgggtttggcagcaacgggtcagcaagccttgattgatcaaaaagatcgcatccacgaactggcgacggatatgttcaaaaccacacgcaacgccttttatatcggacgcggcggcgactattacgccagcctggaagcggcgttgaagctcaaggaaatcagctacgtgcaggcagaaggttttgctgctggtgagttgaaacatggcaccattgcgttgatcgaaaaggatacgccggttgtcgccatcatttccgatccggtgacagctgcccgcacacgcagtaatgccgatgaagttcaggcccgtggtgctaaagtcttgcacattgcgatggctggtcaggcacaaaagggtgaccagattattgtggacgacatcgatccactgctggcaccactggttaccatcattccggcgcaattgctggcatacttcacaagtgccgatcgcggctatgacgttgatcgtccgcgtaacttggcaaagtctgttacggtcgaataagacgcgtattgatggaaaagtaaatgttaatcttaaaacggtgatattgcccactaaaaagcctgtttgctggcattttagcaaacagactttttgtctcatcagaatctttacgttaagaagaaatgggcagcaattattttaagtaatcctcgctcaactgcataaactgttgcgcatccttggcggctaggtcgatgccttgctgccaaaatgccggttgcgtcagatccacaccgagatgctttttggccagttcctctgtcgacatgttggccgtgtcccgcagcagtgcgatgtaatcatcttcaaagtttgcggtttgttgcgccttggcgtaaataccgctagagaacaggtagccaaacgtatacgggaagttataaaacggcggattgtcaaaatagaagtgtagtttgtccgcccagtacattgggtcaaatgaactcaacccgccagcataggctttttgctgggcctcggtcatcagttcctttaggcgcggcacgctgacaatgccgtgttcccgttcttgatagaagctgtcttcaaacaggaagcgggcgtggatgttcaacagcatggctattggattggtcattttggcatcaagtaggttaagcttttctgcgggatcggtggcggctttgacagtcgcatcggccacgattaattcagcaaacgtcgaagcagtttcggcaacgttcatggcataatcttgacgcagaaccggcatgtctttcaaaatatcactgtggaaggcgtggcctagttcgtgggcgatggttgaaacgccagatgccgagccgtcaaaagtcatgaaaattcggctttctttaacatccggcacactggtcatatagccaccggcgcgtttgcctggccgatcttcggcttcaatccagccgttttcgaaggcgtgtttggcgaaagcggccatttttggtgagaacttggcaaaattgctgacaatgaattcggcagcttcgtcaaaggtgtatgtttttggcttaaaatcgccaacgataaccggcgcccactgatcataccaagtcatggttggctggccggttagttgggccttgcgggtgaggtaggcggcaaatggtgccttattcgcgctgatggtgtgccacatttgatctaatgtggcccgttgcatgcggttatattgaagcggtttgtaaagataatccggataatgatgcaagcggtaatcagttaaccggaatccggcaatgtgattgagcgtttcggcaaacaaactggcgtgatcgttccagacatgttcccaaacgttgaaaacgtcccgtcgcactttaggatcaggtgcaccttcaaacttgttctgcgtctggccggcactcagttcggttgttttcccgttttcaacaactggaaacttaagactgccgcttaaagtggtgtaatggtcactccaaccggtgtatccatcaactgccaggtcattgatcatggtttcggtttggtcatcaagcaggtccttggcttggtcgcgcatttcagcgagcccgaagcgactttccgctaaagtaccggttgccgtcagttgatcgaacgcggcttgtggcatggcggctaattttttggtgagtggattattgatattttgaaagcgtgtctcgagcgtggtgagccgaccttgtaatgggccggtttttaaattggccgtatcggcgctggcaatcatttcaacaaagctgccagtggtgcctaggcctttgctaatatcttcaaacagttgccaaaaagttttgaaatcggtaaactcaggagcgtcatcgctaggcgaccaagcagccacttgggtttccagttgcggcagttcgtctgctacctgttggattcgggcggcgagttgtggtgagtcgatgccaccggggaagattgaatcgagattccagttaatcgggtaagacatatcagcacttcctttcgaaatacgttcattatacagtagatgagaaaattatgagtgaaagtaggtcaagtttgtgcattcttttaaacgccattggggactttggttaaccgcagcacttttatttattttatttgtgagctcaagtatgacttataaagagcagacaaccgtgccactcatggaacggttgttgcaaagcgaaccatttaaaccatttctgagcacgattcattttgattatgccggtgaaacgcaatcggtagcaaaggtaggctactttaaatttgtcgagttctttattcgcaaaggcgcgcacgtcacgatctttttccttttggggctaggcttaacccaaggaacatttatgtatcaaaagaatcggtggcttcactggccactggtaacgttgagctgtaccgggattgccgcgtttgatgaattccaccagatgttgacaggcggccggacgccgttgtttcaggatgtgatgctggatacggtggcagcagccattgccgtgaccgtgatgtggggatggctgtggtggcggcggaagcgacgttgaataacggttcattctttgctataattttaacgattcgtatgcatctatacttatgaaaagagggtttatcatgtcaggacattccaaatggcataacatccaaggccgtaagaacgctcaggatgctaagcgtggtaagattttccagaaattatcacgtgaattatacatggcagcaaagcaaggtggtcctgaccccagtggtaacccatccctccgtttggtcatggacaaagccaaagctgccaacatgcctaaagacaacatcaaacgggcgttagataaagcgagcgatcgcgatgcagctaattatgatgaagtgacttatgaaggctatggtccgggtggcgttgcgattctggtcgaagctttaaccgataaccgtaatcggacttccagttccgtgcgggttgcaattacccgtcacggcggcaatatggcggcagctggtgcggtttcctatatgttcgatcgcaagggctatctggttatttcccgcgaagattttgacgttgacgaagaccagatgctggaagatgcgcttgaagccggtgccgaagatatgcagacgtcggatgaagcctttgaaatttataccgaccctaaagaattcgcgcaggttcgtgatgcgttagaagaaaagggttataaattcgtgcaaaatgaattaaccatggtgccgcaaaacctgacaccgattcctaaggacaaagttgaacagttccaggcgatgattgaccaactggaagacgatgacgatgttcaggaagtctacacagccggcgactggccagacgactaaatgatttattagaacatgtttgaaaaggcaatgcagatgcgttgtcttttttattttgcccaaaaagcggcagcaaagggagttcccccgtgaattgcgaactcttttagtgtagggggggaaaggcatgcaatcagtgaatgaattgttgacgagtgcgttagcaaaaggcgccagtgatatctattatttgccgagtgcacaggggtatcttgttcgacttcgactacctacaggactgatgaccctggcaaaacgggaggcgcgtttagggcaacaggagattaattatctgaagttcatggcggggatgaacgtggcagaacatcggcgcgttcaattgggtgcgttctatcaagaagcgccgtctgtctttctgcgactgagttcggtagcggactatcgcggccgtgaatcgttggtcgtgcggttaatcagcggcattccagatgcggacggcgcccgacaactcttggatcggttgatgagcattttgttgcagcgacgcgggatgttgacgctggccgggccaaccggatcaggtaaaacaacgctactttatcaattagctacgcggttggcggagtcgcgaatggtgttgtcgatagaagatcccgttgaaatcaatcaacctcaatttcttcagcttcaggtgaatccggaagcagagatgagctacccgcagttgctaaaggcggccttgcggcatcgacccgatgtcttattgatcggagaaattcgtgatcggcaaaccgcacaaagtgcctgtgaagcagccattagcggtcatattgtgttggcaacggttcatgcacgctcggctggggacacgccattgcgtttgacgagtttcggcctatctgaagaattggttgctgccgcgttgactgccagtgcggcaattacgttgcgctatcgtccggtgattcacccggtggcagaactggttgtttttgaacgctcgtcgcaaagccaagcacaagaggtggtttcatgaaggtgccgttaattgcccaagagcgtttttgtcgccagagtgctgcgttaatcacagctgggtttagtttgccagatgtttttgcttacctgcgcgtcagttcgccaaaataccggattgtttgggaacggattgaagcggaactggctaacggaattgccttttcagaagcggtcgcgcaccaagagctggcaccgatactttttcaacagttacagttggcacagattcacggtgatttggctaaggcgctaacagtagcaggcgactatcttggcttacgcgtgcgcaatcggcagaaaatgacccaactgcttgtttatccgtgtctgttattggccatgttgatggtcttacaggttgtggtggtgtttggcgtgctaccggccttgtctttgccgagatcggaattggtattggttcagttaggtggtctcgctgttctgatcgggctttgcgtgctgatttatttggtttggcgccgtttaaccccgcttaagcgtctcttggttctacaaaaagtgccgggaatgcggcaggttctgcggatgtattatcagtttcaatttacttccggagcggctcaatttttgttggcaggagctgatatttctgatttttgtcggcatttagcgacgctagaagggccactggggaatttaggcagtcggattcaggcgaaagttcaacgtggacaggaattgactgaggcgctccaggaaccttttgtcccagatgaagtcgcgcgtttattaacgatgggacagtcacgacatctggtggcggaaggcctcaagctattcggagagcaactattttttaatttgcagcgccaattggagaaattagttaatttgatccaaccgcttttgtttttgttaatcggcggcgagattttactggtttatttgcagatcttattaccactctatcaatccttaggaggtgtttgaacatgcgacggaaaaagttacgggcattcacgctcatcgaagtcgtagcagctttaggtgtgattattttgttaacgttggcactggtcttgacgattcaaggacagatgaaacgcgttgatacgcaaaatctgaaagccacggttgcgaccgtcaatacgcagttggaaatgacttacaacgagcctgatcaagggggcgttgattttagctctgctgatcaattggtcaaaaaagacgtgatttcgcaaagtcaggccgatgcgcttaaaaaaggcggctataaactaacatccggttcgccgccaaaattcgctaaatgaaacggttaagtggatttaccatgatcgagatcgttgcggtgatgtttattttgacggcattagctttggtagcggtgccggttggacgaggggtcctgacgcatcggcaggagcgagagtttatggagacgctcatcgaagagtgggaaatgttgaagatgaaggcaaggagcgatcacaaaaacggcgatatgtacgtaaaaggttcaaaaagacaggtggagtttgcaacgattgacggtaaatttcgagtattaaaatttccttcttctttgacatatgacggttcgtcaacaatttcttgtaacccaagggggaaaatcactcaagctggttcgctaaattttaaatacgctgaaaaacgattttggagagtgagttttcaactaggatgggggcgaggcgtattcgtcaaaaactgagcggtgttttgctagttgaacacttggctgctttgggggtggttttaattgcagcaagctggctaacgcttttaattcgaacatatcagcgggttgtgattccagcccgccaggaaacgacggcttattatgcagcacgaattgcgttggttcgattaccatcaccaggtggaagaaccgaggtcaaagtagggcctgatgtgtggcaggtggagttgcgcgagaagggggtccgcgttcatgacaacaagaaagggaagactttctcatttaccccttgaagcttttagtttggtcgaggttgtcatcggactgggattgatgatggtagttctgttgctttggcgaccgcttttaactgggattcaacgttttacccaacaagaccaatatttaattcaagctttacaagcagagcaagatttacaagcagatgtgtacgctcataaaatgaaacaactcgagctgaaggataatcgcgtgcgcctgcaaggacaggatggtgccgaaaccaagatatatgcatatgagttttatgccaaacgtggtaaagaaggcattattcgatctaggacgaatgatgatgggcacgtacctttatttatgcaagttaagtcagcaaagtttcaagctgctccacagggcttcttgtataccttacgattaaagtcagctcaaccatttgaaggtggggtgtttttggagccatgaagctacgtggaagtgtgtttgtcaacacgttgattttatttgctgtttttctaaccctgactgttggcttgttcgaacagttcaaactatggcagcagcggtatcaagtaatcgcaaaagtcgaaaaagctcaatttgaagcggcgtattctcgttggaggcaacaaggcgaagtcacgagtcaggcggcggaagaagcactggccactcaaactgtgccatggagtgacaccaccgaaccaaatacatcaacaaacgaagcgtcacaaccttcagaaatcaaggcttccaaggcagagatgcttgaataagcttttatcaatcagtacactaaaagacaaggcggcgtctaagagtcttggaagatttcgtataggtacacgtcttggctgacagagtaatgaggaggcactggtttggcaaacgaacatcttgaaaagctttaccatgttttagatgacagcacgacaatcttgaatcagcagttgaaaacatcctttattgcggcgattaccgaggccggagaggatcttgactcaggtgaggtgatgcaggaagatggtttgcctaatgatgaggcaaaaaagaagctaactgcgctgtttgatcaaattaagctggctacctacgagccggaagaaattcgtcaggcgttacagttggttttggtgaaggccatcaaagtcgatgggattgagccgaacaagcaaataacgccggatgcgatggctagtctggcaacgtttatggtcactatctttattcaacaacatcccgatcaactgcgggttgctgatttggctgttggcaccggaaatttgttgtttgcggtcatgaatcagcttcacaaggcttggaatgtcgaagtcaaaggctttggcgttgataatgatgaggcgttgctggcagtagcaggaatgagtagcagtcttcaacacttagacgttgatttatttcatcaagatgctttggacaatcttttgtttaaagatgctgacgtggtggtttcagatttgccagtgggctattacccggttgatgaacgcgctaaaaagtttgcgactgtcaccaagaaaggccattcttatgcgcaccacttgttaattgaacaaagcatgaacgtcctgaagccgggcggattaggcatgttttatgtgcctagtcaggtgtttcgctctaaagaggcagaaggcttaaccaaatggctggcaaaggccatgtattttcagggcttgttaaacttgccggatgacttttttgctgataagaatgcggaaaagagcctgttgattttgcaaaagccaagtccagacgtcaaacgtgctaagcaggtcttgcttgggcaatttccggacctcaatgatcgtgacgcatttgcggccttcattgctaaggtcaaagattgggcggcagccaatattgtgttgtaaataacgttgcattagaagcgctagcgtcagcggtttttgcttcagtggagcacatccacacagaaacaccgtcatatttcattaaactaaacaggcactggagacgtgttgctaagtctccagtgcctgtttggttttctttgctgcccgcataaacgcactccctgctttttagcgcgcaatcggttagaataagttatcaccaacaggaggatgtttatgtcgttattaagtattgcgtatgttttaattgctattgtttcggtcggcgtcaccatttttgatattgtacatgtgcggatccgcgcaacgccaaaagtctggcgaattattctttatctggcgattgccgcttttagcctggtcctaacgctgcagcaaagtcgccattttgacgatttggtcagtggcgggtttattgtggttatgtttctttgttttgcaagctggcaaaaaggcttggcggatcctgctattattggcggtttgggcagtattcgaatgtaccaaaatctgagtggactcgttttgcaggcgcaaggcaccgggacacttttattagcgcagatggggcaggtgactgtcttaagattacacttccgccaagcgccgcaaacccttcaaagcttcctggcagataaaatggcgcccgagcaaatcaagattgtcgatcactgattggtttggggttttctgaaaatggtgtataatttttctaatacggacattcgttaaacgatatgtaccattcctgataatgacacgatattgctgtgatgaactggttgaaagcacctgtcagtatttgttgtcgtgtactatggcataacagcggtcatattgtcatattcgaatttaacatccaaacttttaaatttgtcgaatcgaaaacatttggctaagaagtcgggcttttactgtcttcttagtttacccgggtcatttatatttaaggaggaagcgcatgcaagccgaaaaagatgatcaacctgaactcgcgcggaatttgaaaagtcgccatgttcaactgattgcgattgggggcaccattggaactggtttgtttctgggttccggtcaatctattcactcggccggtccttcgattttgtttgcttatttaataactggtggcatttgtttcttgttgatgcgggcattgggcgagttattgatgtctgatgtggattcgcacacatttattgactttattaccaagtatttgggtaaagatgccggctgggtcacaggctggacttactggatttgctgggtcgcgctggcaatggccgaagtgactgccatcggcttatacattaagttttggttgcctgacgttccgcagtggttgccgggcttaattgcattagctgtcttgctgttactgaatttggttagcgtcgggcttttcggtgaagcggagttttggtttgcgttgatcaaaattgtcgcgattattgggctgattgtcctgggcattttcatgatgattgttcgtttcaaaacgccgctcggccatgcgagtctggccaatcttgtcaatgatgggggccttttccccaaaggatttggtggctttttaatgtcactgcaaatggttgtgtttagttttgtcggaatcgaaatggtcgggttgacggcaagtgagacaaaggatccgcataaagtgattcccgaggccattaacgaaattccgatgcggattctgttgttttatgtaggcgcgctatttgtcatcatgtgtatttatccgtggcggcatgtttcgccggttaacagtccctttgttgaagttttcaataacgtgggtattccatttgccgctgatatcatcaattttgttgtgttaactgctgcagcttcggcatgtaattcgtctattttcagtactggtcggctacttttctcattgacggtcaccggtaaaagtcaatcagcgcagtgggcggccaaattgtcacggcggcaggtgccggctcgtgcgattttgatctcgacggccgtgattgccgtggcggtcgttttgaatcttttccttccaggcgcggttttcacgttggtttcaagtatggccacgatcagctttctgtttgtctgggccatgatcatgttggcgcacttgcgatataaaaagttatatccacataaggaaggctttcggatgccgttctatccagtttcggattaccttgttttagggtttctcctcctgaccgctattatcatgctgttcgatcgggcaatgctttcggcactgatttttgcggttgtttggattgccacgctctttatattacggcggttacggcgagctgcaaaagcgtaaaaaatcgggttgttgaacattgacgataatttgagcgatcacttaacttctctttgacgcttgccggataaagcctttttaatgatgtgtatagattgagtgaccacttgccatttttaaatttaggattgactaactttgctgacgcgttatgctgttagtgggtcgcaaattgttttggtggcgttatttttgttattaatggtgatggtaccgttcttggcttgagagcggagtggtttacgttcgggcgccataacacgttcactcacggggagagaggagatcttgatggctaaagttttgacttatcggcggttgaccgatgacgttgttgcagcgcctaatcaaaattccgccattcctgctgattatcggtggcagcctacgcgtgggtttcgactgaaagcggatcttgtttatggcggatcatggctgtttgcccaaggctactgtcgcataaagctgcatgtccgcaatcggcaggcttttcgtcaggcagccggtcgcggttattttgtctatgggaatcatacccagccgtttggggatgttttcacaccaatgcgggtaaaccagtcacgtcgagtatttacactggcgtctgctgctaatttgagcgttccggttcttggccgtctggtaccttatggcgggggtgtcctggttccgcggcgtttacatcagttgcgagatttcaatgccgaaattcgccagcttattcaggctaagcatgttgtcatgatttatcctgaagcccatgtctggccgtattataccggcatccgcccgtttgagaccggtgcgtttcattatcctgttgaactcgatgcgccggtttttgtgaccactatgacgtatcaaaaacgccattggcggcgcaaaccgcggcggattttgtatgtcgacggtccattttggcctgatcgtcaactcccaatcaagttgcggcaacaaaagttagcccagcaggtaaaaaaagtcatgacgaaccgtgccactttaagcaataccgagtatattcgataccaacaggaagggagggcgcggccgtgaccaccaatattttgttttgcggtgacgcgagcatgacagacggcgttttgattgccacattgtcgctaatgaggcagacgcgccacccgttacatatttttattttgacggcgacgttaactgtcaagggccatcattaccaaccgttcgctgctgagacagctgagcggatggcgaagctgatgcaggcacagaatccggaacatcaactgacgcggattgacatcacggagcagttcttggctaatccaccgcttgctaacatgggcacgatgttcacgccttactgtatgcttcggctgtatgccgatttagtgccggagttgcccgatcgcgtgttgtacctggatacggatgtggtttgccgccgcccgtttgatgccttctacaatcaatccatgacaggcgttgatattgccggtgtcttagatcattatggcaaatggtggtttcatcatcggcttgcctggttcgattatcttaattccggcgtgctgttgatgaatcttgcccatattcgggaagatggtttgttggttcggtgtcggcggctggttcggcatcgctggctgttcatgccggatcaaagtgctttgaacataaaggctaaattcaaacgaatcttgccgcaaaaatataacgaacaacatcagcttaaaccggataccgtctttcaacatttcacgacttttttccgtttctggccatattttcggattgtgaccgtcaagccttggcagattcaggcggtgcatcagcagttaggcttacatgaatatgatgatttgttaaaagattatcggcatctagcccctaaattgaaagaagtgtcttaaatgaccaatacgaccacggttccaattttcttttcggtagatgatgggtacgtcccatgtctggccgttgcgctaacctcgattcgggccaataaaaatccccaagttgattttgagatcaatattcttaacagcggcttattggcggagaaccaaaagcgactggcggcattggcagcaccgcactttaagatccggttcattgcgatggatgcggtgacaaaacaaattagtggcgatacaaataagttacgcggtgattatgtgacgctgacaatttattttcggctgtttattgccgacatgtttccccaatatgataaagccatctatatcgatgcggatacggtagcagatggggatttaaccaccttgtttgcaacgaacatgggcgatcatttatttgctggcgtggctgatccggtgatgatgacttatccggagacgattgaatacatccaacgtgattttggcgttcaaccaggcgagtatattaattcgggtgtgttattgatgaatctggctcagttgcggaaggaacacttttcaagtcggttcctgcatttgttgaaaacgtaccatttcacgatgattgcggctgatcaggattacattaatgtcattgcgcaacatcggatcaagtacttaccgaaaatctggaacatgcaaaccggcgtgccgaccgctgcagaacccggtggcaagctgattcactataatctttttggtaagccgtggcactatcaaaatgccaagctaggcgaccgattctggcattacgcgccggcttcggggtttgaaaacgatttgaagcagcagttagcggcgtttacgccagctgatcaacaagccgatcgcgacagtatggccggcatgttgaagaccgcagtccaggcatgtcatacaaataacaccatcttgaatgccgtcaaacatggtgaacaggtggcgctatgaaatcgggaaagtttgtcggaccggatcgggcggcggtgattgagaacattcgccgagcggttactgccaaaacgttcaacgtcaaagtcgagcagcatgatccgactttttccgaagctgaggaaacggcgatcatcaaccgctacctgcatcagcgacaggcctggtcgtttcggctcaaaacattgatttgccgcctcatggtgaatgcttacgcgctgcgggtgacaaaggacgtcgacgttgttggcattgacaagattcgatccattaaaagcggcggagtcattaccagcaaccacttcagtccttttgaaaatatggcggtacgtaaagcggtccgtttggcaggtcgtcatcggatgtatatcgtgagtcaggatacgaacttggccatgaaggggttgttgggatttgtcatgaactacgatgacacgattccgttatccgggcgacccagttttctgaacggcccgtttatgcaaatgctgacggcggcgtttaacgggcatcattgggttctgatttatccagaacaggagatgtggtttaattaccgcaagccgcggccaccaaagcgcggcgcttatttttacgcggcatctggcaatgtgccgatcatttcctgtttcacggaaattcgcgatctgccggccagagagaatcaacaactgcgggaagttcgctacattctccacgtccttgatcccatttatcccgatcccaaattatcggttcgcgacaacagttttcaaatgatgcaacgcgattaccagcaaaagtgtcgtgcctatgaagctgcttatcatcggaaattgacgtatgccttttcatcacaagacattgcaggctgggatccgcaaaaataagaagaagccgggagccgttttcaaaattatgaaaacagtttccggcttttgtgtatggatgcgaactgacttcatttctgcgattggggaacattttgccatttaagcgaaaagtattcgcaggcaagtgcctggtgctcattgagaaaattcataattgctttttcagaaaacaacatctgcgcaaattctatgctataacgaaggtaatgaacaaaatcaaagggggatctcaattgatcgacgttattcacgatcatgcctttcatttgtataatcagaaaatcagttatctatgttcgctgttgccaaatgggcagcttgggcacctttattttggaccgcgactttcactaaccaacacagacttggattatttgtcacaaggttccagtccgtatgcttggatggctaatttttctagtgaccagccttttgctttaggcgatgcccagcaggaatatccggtttatggtaccggtgattttaggcaaggtagtttaagtgtgacgcaggacgatgcaccggtgtatccgaattttgtgttcaaagactatcatatcagtcacacgaaaatgcgtgatcttcatcatccgaccagttttggtaacccggctttgacggatgttttgacgattcatctggaagacgaaacggcacaattgttactgacgttgcaatataccattttttccgacagtgcgacggtggttcgagctgcgactttgaccaaccaaggctctgaaccggtgatgattcagcggatgttgagtggggtcttgaatctgccgcagggtcgatttgatgttgtgcacttatctggtaattgggcaaaagagcgacatattcaaactcagccactgacgcaaggtacgttttcggtcgagtcgttgcgcggggcctccagtcatgaacagaatccctttgtggccttacatgctgtcaatcgttcgtttaccagtggtgacacttatggcgccaacttgatttattccagcaatttcttggatagcatcgaggtcaacgaatgggatcagacgcggctactaatcggtattcatccggcatcctttagttggcgtttggatccgaagaccagttttaccacgcctgaagcagttttcagcttcagttccggcgggcttgccgggctggcacaggtcaatcagcggtttgtagcgcggcatattattgatccgcaatggcgccaaaaaacgcgtccggtggtattaaacagctgggaagcaacttattttgacttaaatgaacaaaagctgttgcgcttagccaaactcgggcgccaagtcggggtggactgttttgtccttgatgacggctggtttgggacgcgtgataacgatctgagctcgcttggggattggtttaccaacaagcacaagtttccggacgggcttggccactttgcccaggagattcataacctcgggttgcaattcggtctgtggtttgaaccggaaatggtgtcaccgcggtcgcagttcttccagaagcatccgaattgggtagtccggccaaaacgcggacgcttctcgatcacccgcaatcagtatgtgctcgacttcagcaatccggcggtcgtgaacaatattttcgatcagatgcaaaaagtcatcatcgaaacgcatctggattacgttaagtgggatttgaaccggagtatcaccgaggcatattcaccttatttggctaaaatcggtcatccgcagggcgagtttttccaccgctatgttcaaggtgtctatacactgtatcagaaactgttgacggcatttccgcagttattgattgaaggttgtgctggtggcggcggacggtttgacttgggcattctcttttatagcccgcaaatctggaccagtgacgattccgatgctattgaacggctggccattcagtcaggaacagcgcttgcctatccattaagttgcatgagcaatcatgttacggccgtgccgaatgaacaggtcggacggacaacgccattggcaactcgttttcgcgttgcagcgtttggcattttaggctatgaactcgacttaaccaagctgtcaccaaaagaattggcaacaatcaaggaccagatttcttactatcatgatctgcagccgcttgttctaaatggcgacttcagcttattgttgccgcgtcaatccaatggtcagaatcaggtggcatggttgctaagtgatcacgcccgcaagcgactggtcttaggcttctttcgcgtccttgccgatgccgacagtcggacagtgcaatatatgaaaataccgttagcccagccgaatcgacgttactgggtgaatggtcacaccggaccgatttccggcgacgtgcttcagcgagttggcgtccgcttaccgattcagtttaatggtgccaaccgcgagcaagcccaactcattggtgactaccagtctgccttgttgacgtttgacggggtcaccgatataaaggctattaatcgccggcgtgaagaagaaggcaaggaaaaagtcagtcacgcctgaataattttggcctatgaaggcagttgaacattaaaaaacgcctgctgtcgtgacgtgttctctaagaatttaggggacaagccgcaacggcaggtgttttgtttttcttttccgtttgatttacgattggcgacgcttggtcaacagcaggatgccggagacaaggctcatgccactggcaacaacgccgagactgccggcgatgatcgtgacaatcgcaatcggtcgatgctcgatcttcttcatggatccttcctttctagtgctgggtagggtcgtagctaatgacaatgcaggaatcctgattagggttttcaatccgttcgtcatttgattcattgttaagcaaatccggttcgtcgctgtgacggaatcgggcttgaaaaatagtttcgtcgttaattcgtttgatgtaacgtgcagcggcacctggactcacgagctgaatggacgttgcctgaccgttgttaacggcatcattcagttcagcaattgtaccggcaagctcgtcatgcgaaaaaccggcggattcgagaatgctgattaaggtcgtaacttcgtgattcatggttgttccctcctgagcgttcgccagcccggtttctgcgactacgaacgcgttaatgtggacgagttataactcttttgaattggctttattattttaccaaaacacggctaatctgaggtgatttttagctcgaggatgctgtcagaccggacactttagaaacacgataacgtgtgacgtcgttttgttttagatacgcatctagtcgactcatccgatcgctcccactaaatagttgattgcccaaactactgctgcgattgtcagcgtgatcagccacacgcgccggtattttctcgtttcaaatgacatactattacctccatgttagaataaacgtacaagaagtaagggcctcggcctttaccctgttacttttaccactttagaagccatttgatgaatgcggcgatgccggtcgcgattagaatgatgttagcagccgttcctgactgatagcgtctttcttcatcacttggcttttttctgtaacaattttgttgttaacagtttttgttatccttcaaaacattgtgctattaaaggtgtttcaagactgcaaaacagacaccagacggacacattttttaaaacaactccaaacacccaaaaacaaaaagccccaaaacgctgatttaacagcatttcgggactaacggaaagtatcggaaagcttaataatggaggtgaggagaatcgaactcctgtccatcacccctgctacatgcagctctacacccatagctgattaatttaaaattcgccgcgatgtcgcgccagtcagcgaggctaacacaaggcggctaacctactagtctcttgttgatgcctcaggtggcagcatcaaccgtagctcaatgatttgagacccagacccgacccttgagcgaagtcggaaggatcacgctagctggttattaagcagctaaagcgtaagaattttcgttctttgcagttatattaactgttccgttgatgacggagccgagcctccgaggtgcaccgcatgcgcgaaaagcaatgtcgagaccattacacccccgacaaggtgcaaatgatatcttaccacggtataattaaacttgtcaaaatgtttgcacttggtactatactgacgcaaacttaggttttaagctaattttatggaggcatgtctatgatcttacttgttgctggatgcatgcaattactaatgggcatccttctggtactttttcgaccgcgacatcaaaccaatttctggggctacacatcctatctcgccagtgtcaatgccgatagttttcgtctagcgcaacggtggttttgccaggcattgattgttaccggggctctcgaaggcgctgccggttggatcattcaccggctttcgtgggataattttttcatcatttggctttttgtggctgtactgttattcttaccgggattcgtttataccgaaagccggctaagacagtatcttgaagcccatcaccagcttccttacgattatgtcgcaccggatgacgttccgaaacctaaacgccgtaaaggttttaaagatttgtgaaatgaggggtttatcagtgaaactattaatgattgaagacaatacaagcgtggcagaaatgatggccatgttttttcaaaaagaaaagtgggaagtcgtgaacgcttatgatggcgaagaagggcttgctaagtttaaagaagcacccgatagttttgacatcatcaccctggatctgaatcttcctaaaatggacgggatgcaggtggccaaggaaatccgccagatcagtgaaaccgtcccgttgattatgttgacggcccgcgatactgaaagtgaccaggtgctgggacttgaacttggggcggatgactatgtaaccaaaccattttcgccgattacgctgattgcgcgcattaaagcattgcatcgccgtgctgaagttggtgctgaagtcggtgcggagcaggccgcgcccgaggaaaagaaggatggctttgacgttgaaaccgatcatttcaagctcagtaccaagacgcgtgaagcttatttgaatggcaaacaaatcgagggtctgacacccaaagagttcgatttgttgcatacgttatccaagagccccaagcaggtcttttcccgcgaacaattgcttcagctggtgtgggattatgaatactatggtgacgaacgcacagtcgatgcgcatattaaaaagctgcgtcaaaagatcgaaaaggtcggtccgcaaatcattcaaaccgtttggggcgtcgggtacaagtttgatgattcggggcttgatcaatgaaaatgctctatcaacagttaatcggcttttttgcagttatcatggtgaccttggtaattgtgtcgattctgttcattcgttcgacaaccaatacagtttgggaaaatgggtttaagcagcttgaacagtacactgacgttttaaaaaacaacgctgtcgatgaaaatacttacgtgatcaatgcacgctttatccaaaatgccgaggagattcttagcgatcaacacgtgcattttgttatttatgatgcgaacaacgtggctaagtatccggtttcacaaaaaagcccgatggcagcgattaaatcgagttactggaaaaagttaaaacaaggttcagccgttgccgtaccggagctgatgaccaatcctgtgagcggccgatcccaaaatatgacaatctattaccagccggttttcctgagtgaaaaactactatttgtcattgcggcatttgcaccggtcgagcaaattcaaagctcgattaacaagaccgagcacaacttactcatcgctttcgtcttatcgactttggcggcctttattatcagttacttcattgtgtcgtatcaggttcgccgcattaatcaactgcgccaggcgacgcatcaggtggcggaaggcaactacgatgtgaccgttaaaatgaaaagccgcagccatgatgaagtggcagaactagcggatgattttcgtgacatggtgacgtctttgaaagccagccagcaggaaattcagcggcaagaagatcggcgccggcagtttatggcggatgcagctcacgaaatgcggacaccgctgacgacgattaacggcttgctggaaggcttggcttacgatgcaattcccgaagaaagcaaggggaagagcattgaactcatgcgtaacgagaccaatcgtttaattcgcttggtcaacgagaaccttgattatgaaaagattcgcacgaatcagattcttttgagcaaacataccttcaacgcccgcaaggatcttgataatattgccgaacaactggcacaaaaagccgaagaagctggcgacaagattacgattgaagcaccggaaaagctgccaacttatgccgaccacgaccggtttgttcagatcatgttcaacattgtccaaaatgcggttcagtttacgcaaaatggacaaattacgattaatgggaaattaggctaccaccaaaccgagtttagggtgagtgataccggcatcggtatgtccaaagatcagatgaagaacatctgggagcgatattataaagctgatccttcgcggaaaaatacgaaatacggcgaatccggtctaggtatggccattgtccatcaactgatgggcctgcatggcggcaccattgatgttgactctgaattaggatcaggtaccacgtttactttgatcttccctgatgaagagacggcacctaagcaaaagaagcaaatcggttcaaagccatcaggcgattcagctgcgaccaagccagactcgacagccaacaccaccagtggctcagatcagcagactaagccaaataaataacgcatcctcaaaaatggcagtgacatcgaaacagcacgtcaccgaaacgttaaaacgtgtataataaaaattattataacaaaagggagacaattatgaccattcgacgaatacagcaaaacgactttgccgaggtagacgccttattgcaaaccgcatttagcggcagcaagcgcggctatcacggagaagcagcgttagtcgctgagttacgacgcaccgctgattatgatgcagcgctggaagtggtggcgaccatcgacggtcatttagtcggttacggattgatgactgcagtcaccattacgcctgatgcccatatgcaaggtgtggccttggcccccttggccgtagcacctgattatcaaggcagtgggttagggatggcgattgtttcggagctcgatatgcgggccacagatctacgtcgcgattttgtcagcgtcatcggcgatcggcagttcttcggccgcatcggctttcgcaaggccgcaaactatcgactcgagccaccgtttccgatcgtggccgaagaccatctcattaaggagctggtccccggcgttttggctagcgtgcgcggaaaagtcaattacgcccatccttttttagctgaaacattggagtaacatcaggtgttaacagtgatgagctgcggttaaaaccgcagctcattttgtctggcaagaggtgttactttttcttgtgacttttggacgtgtcggtgacgtggtgcgccatatgtaatgcaccgatacaaagtccaccactgatgagcccgctgcccattaacgcgtcatcactcaggtgcggccagtattcgacaaacgctataaacgcgatgatgattgccactgtcagtaattgccaagataaatgatacggttgccgcatcttcattcagaagccccctcatgcttttcccttcaaagacaccatcagcctactgcaaaatagcagacgtttaaaggttcattgatgaaataggtgcagctatcgagctataacggagattacctaaagtggaattgacagcgcttggcgaagtgttataagtaaagagagcttattttcctgaaaacatgtcaaatcttttacaatttgacgattgcttttcagaagtggcaatgactgttacaatatgaacatattcgaacggatgtctgtcggtgagaagcgcatactggcagtcggttcattttggggggattcgcgtgaagcagttttatattgttgacagttcgattcttccggacgtggtcggcaaagtgattgccgcgcgggcattgctccaaaatggcgaagttaaacaggtgagcgaagcggttaaacgagttggcatttcccgcggcacttattacaaatacaaggactatgtgtttttaccagatcatgaaatggcatcgcgtaaggcggtcatttcattgatgcttcatcacgatcgcggcattttgtcggaagttttgactgtgatgtcacaagctcaagccagcatcgtgaccattaaccagaatattccgatccacaactgggcaagtgtcgttatatcatttgatatttcggcgcttcaaggaacccttgatgatctcgctactaaacttggcggcattcgcggtgtcagtgatgtgcacctgatttccattgaataaacagcatgtttttggaggctttatgaaaatagcaattaaattgttgctctgggttttagtcgctggcgttgctttatttccagcgttgttactgattttgtttgtgatcggcctaagcgtcgtgatttccggcgccatggcagttagtgctgttggttttgttttgggtatcatttttgtcgcgctagtgggcttgagcattatgattccaagtgttttactcattattcgcttcatgacttttcggacggttaatgcgcgtttccggcatggcaatcaacgcgttgtcttgccagtgagcgtccggttaacgggtcgttccatttaccacgcaatttatgagaactttaaggccggacggcgccaaggtaaacatttggtgcaggcgtggagttttgggtttgaaacctacttccatgaagatctccaggcttatctagcggatcagattcttgctcagcatggccccgagatggctgaggcctttgtgcttgatgaacgccactcttatacgattgcctattaatttgatcaatcgtctgatgggggcatcgatcaattagtgctaatcatgatgaaaagtcagtcttgttgtctgaggctggcttttttattggagtcaatattcagcttttagctatattaggcacgcaatcggactaccgagcagggcatcattcatcaagacgggcacggcgttgaataactcggttggtttgcggccagcgcatgtcttcaaaaccgacaaattcaatggttaattgcgtttgtttgcgtaacaaaccaaggaaagcctctaactgggcaagatcatagccgtgcagactgtgcaacgggatcgagcgctgccgttgatccttgggttgaatgttaaaaaagaagttgaacgctggcgtgtaggtctgattcaccagtgagatccaataccgtgtgtttcgtttgcgcttaaatagtggcgttaaccgttccatgatgattttaaggtctttagtcatagctattgccgccattgtgtcctcctaccagtgatgcacgttgaatggctgtaccaccatgcatcgcgcttttggcgtacaccaacgccttgaaaccaaagcgactgcgaatcgtatcgagtgttcgttccagatcggtggccttgatttggcgatcaactggttcaaaaaagttaagctgttcgccggtgtcaggtgccagacgggatgtgaagacggcaacgttacggatgacttcaccatgccagttctttcgaaaaatctcgcgcaacgctgcaacaatgtcggtgttgcgattggttggcagaatccgctttgcttgcgtaaagccggaccgaccgtcttgctggctttctgcatatgaaaatccgatacccagtgaaagctcaccggcacgtttatgatgatggcgtaagcgggctgcgacctgttcaccgatttctttgatgacaatttcgatttcgaattgattgctatagtcgcgcggaagcacttgggaattaccgatacttggctggcgggtcacgatgcgcttgctgattttggtgcgatcaacgccccaagcggttgcaaacagctgagtgccgataatacccatttcctgttttaaggcataaggattcgcatgggcgagttcgtacatgttcgtaatgcccatgcgcgctagatgcgctgccgtgcggtgaccgatactccagacatcggtcatctcgttaattttccagatggtgttcggaaccgtcgcatacttaatttcgccaagtaaatcaggactgtgcttggcataaacatcaagggcaattttggcttgaaccgggttttcaccgatcccgaccgtggtccgcagacctagctgctgttgaacagtcgattgaatgagcttggcaactgcctctggtgtttttccaaacagtcgccaagtatgggtcatatcaaggatggattcatcgattgagtaggcccataaatcttcatcggcgacaaattgacggaaaatgtcgttaatagccagatttttctgaatgtagaggttcatgcgcggcggaacgacaattagatgcggctcattgggcaaatcgcgctggcggctgacattatttttgagaccgtacatttttttggccataggcgaagtcgctaaaatgagtccgccgttggtgttctcctgttcagacatcacaactaggatggttttgagcggatcaagtccacgctcaatgctttcgactgaggcgtaaaaggacttattgtcaatcaaaaaaatgacccgatgcggttcgtgtggataatcataggccatgaagatcacctctgcctatcattatacgaacacatgtttgcttaggcaagctatttattttggggggatgctataacgcgctccccgacttctaagcgcgccggctcacgctcagcaccacataaaaacccctgctgtgcatatgcacaaacaggggcatcaatgaagcctatcaaaatgcaaacatctagcgcatgcaaccgcccatgtgccaggacgaaatgctgcgcatcatgctgccgtgggcaattcccatgccaccgccattgttgaagacttccaagataaacaaggcggcaaagatggcggcaatgacgattaacgtgaccactaatggccgccacttatctgatgtcatacgatccgcctcctaacgaattaaattcggatactaccattagtataacaccatggcatcaatgacaaaggggatacggacaaatcagtcatcgcgttcccatttaattttgagattggtttcgatcaagtcgtcatcatcaaggacgaagggttcaaccgtgctgccgccatcagacttggtgaacttgatattgaagacattgccgtcacgataaacgacttcccacttaccgttacttggcgtgccgttattggttgccgtataagtgccatcactattaaaagtgaacgttgcctggtcgcctgattcccagcggcccacaatgccactggtggaatgattgtcgttgcgttttgacgggtcggaaggatactggcgtgttgttttcgtgacgccattgtcatcataatcgtcatcgctatcatcgtcgtgggtattgctatccggatgtgaattttgcgatgatgcggaactggaagatgtggcgctggaagaggaagccgttgctgcatctaaagttaaatccgatgcttgaccttttagcgggatcaccacttcccgtgtgaaatctttggttgtgccgtcatgcgtgccgctgagtttaagcgtgtagacgcccggcagttgaccggtgatgatatattgcccgtcatgcgctttggcttgcgctggcgtgccgttcaaagtgagtgtggcatttttaaggttggttttgacgacggcatcggctgtccctaatttgactttatattttggaaaaataagcagctcatggcctgccttgacaatctgaactgtgccgctggtcgacttagccataatcatgctatgcagaagactgcgatcgctgcggtttttgatgagttgcgcaaggggcttcaaatcgtcctcgtgcaacgccgtcccatcgctggctaccgcgacttccgccatatcatcggcatctccactggtcatttcttcggccagctcggttacttgccgatcctgactgtaataagtcgcaccagcaaaataagcgattcccagtattaagatcacggcaatcccggttatgagcagccaacgccgtggtgaccgtggtgggcggcgacgttcggcagtagccgttgtggaagaagcggtggacgaaggagtggcaggtgacgattgtgaattggctgcttctttttgatttgtgctttgcgcctgttgtcgcgcagcacgcaaatcaaagccgcagtttggacaaaagtcatcatcagggccaatcggttgaccgcagttgggacaaaattttaaagatgcttgcatggatcattcctccaaagttttgatgagtagggcagcgatttgatcatgccccttttgattaggatgaaacgtgtcgcgcgggccattagccgcaaagtcgggaatggcggtgccagccgggccggttacatcatcatggccttgccagatcgtcgctaagtcagccactggcacgtggtaagagcgaccgatctctttgacaacagcgtcaaattttaaatccgcggcggcatacggcccgttgttcggcgaccaggttgtcatgaggatcagttgggcggtggtcttttcctgaagcgtcgtcacaatggttgtgagggcttggcggtaagcagcaagggcagatggtgttgcaccacccacagcgtcattggtgccaaactcgatcgtcactacgtccggctgctgcgccactaagcttgacaacgccgggacgccgagattggtggcagttttaccgacttcagcaatgcctgcctcagtaacggttttgccggttaattgccccaactgctgagcaaaaagcgaagtgaagcgactggcttttttatctgcaaaaagcccgacagaaaggctgtcgccaaaaggtgcataaaccaatgtatcttttgagcgatccttcaatttagctaacggcgtctgtggtaccgatgatgccttctgtgaagcacttacttggcgcgaacttgcggatgtcgatgcgcgactggatttagctgcatgccgttgaacaccgcaaccggcagccaacagtaataataaaagtcccaaccccacccaaacttttttcatagaaccaccttttttgagtcactgtttctctgactgctttctttaagtgtatcagagtgacctgtcaacgcaatgaatatgcaataacaacgaatgacggaaatttcgggacaagcgagaatctaaagtaagcattaaataccgcctgttttggctgatatcgtatcttgccggcactcacgcttaggcccaaagtttggtacaataggtcaaggaatttttcacttggtttttctgaaaggacgattcgttaaatggtaatggatgccgcattaaagggtatgaacgataagcagactgaggcggtactggccaccgaaggaccggttttaattatggcaggtgccggctccggcaagacccgggtgttaacgcaccggattgcttatttggtagaagaaaaaaacgttaatccatggaacatccttgccatcaccttcacgaataaagcagctcgtgagatgcgtgaacgggtagggaagctcgttgatcctgaaattgctcgggatatctgggtctcgaccttccatgcactttgcgtccgaattttacggcgagatatcgacaaacttggctataatcgcgcctttacaattgccgatccagctgaacagctgacgttggttaaacacattctggcggatttcaatttggatcccaaacgctacgaccccaagtcaatcctgggggccatttcgaatgccaaaaatgatttaatcgatccgcagacttatgcagatgaacaggctaatagtccctttaccaaaattgtcgcggaagtttatgcggagtatcaaaaacggctccgtagcgatcaggcgttggattttgacgatctgatcatgcaaaccatcgtgttatttgaaaaggacaaagagacactggcgttttatcaacgtaagttccgttatattcacgttgatgagtatcaggacacaaacgaggcccagtatcgcctcgtgcacatgttggcggaaggttatcacaatctttgtgtagtcggggatgcggatcagagcatttatggctggcgcggtgccaacatgcagaacattctggatttcaaaaaggatttccctaaggctcgcgtgattttgcttgagcagaattatcgctccacgaagaccattttaagtgcggccaatgacgtgattaagaacaacctgaatcgtcaggtgaagacgttgtggaccgaaaatagcaaaggtgacaaaatcacgtattatcgcgcccaaagtgaaactgacgaagcaatttttgtcatccgacgcatcgaagaagaaatggccgaacatcatcgccactatggtgattttgcgattttgtatcgaacgaacgcacagtcacgggcgattgaagaggcgttcgtcaagtccaatattccttacaaaatggtgggcggtcacaagttctacgatcgtaaggaaattcgggatgcgcttgcgtattttcgtttagtcgtcaatcctgaagacgatatgagtttcacacggattgtgaacgaaccaaagcgtggcattggtaataccagtgtcgaaaagctggaagcatttgccagccagcatgggtggtcgttgttggaagcagcaggcaatgccgaactcagtcccatttctggcaaagcgcgcggtaatctggcgaagtttggcaaaatgattcaggaactcggcacccgccgcaaagatttgaatgttacggacatgatgcaggctattctggatgaaagtggctatctggatgcgttgcgggcagcacacacgctggaagccgatactcggattgaaaaccttgaagaactgctatcggtgacgcaaggatttgacgaacgctatcagccggaaaatgaggacagcgatattttcgtcgactttctggctgagttggcgctgctgtcggatcaggacgaagtagaagaagatgcccaggaagttaccttaatgacgttgcatgcggctaaaggactggaatttccggttgtctttttggttggcatggaagaaggactcttcccgctgagtcgggcggctatggacgaaggcgagcttgaggaagagcggcgtctcgcgtacgtcggcatcacgcgcgccaagcaaaagctatatctgtccaatgcctatgcccgaatgctatacggccagcgacaaaataatccggctagtcgttttattgaagaaatcgatccggacttgcttgaagtcgttggtggcaatcagccgaaaagcgatattccgtttattaaccggaccgatcgggcatttagttcgccgtatagccgccatgccgagaccgccgcaacgccggtgacggttaaaccagtaccgacaaccggcgctggcaagaccagttgggaagctggcgacaaggtgacgcatcgtaagtggggaacgggtaccgtcgtcaaggtaaccggaacgggtgatgatcaggaattggacattgcctttaaagcgatggggatcaagcggttgctagccgcgtttgccccgatcaagaaaattgaatcttgatgatgggttcgtgaggatgaagtatggtgttcaaggaggctcgccgtgttaacaaaaccagctgctcaatttacgcttgaagaagccgaggcggaagtcgccaagctgcgcaagcaattaaatcaatggcgtctggagtattacaccaaagacgcaccgaccgtaacggataacgtttatgatgatcattatcgtgacttgcaggcgttagaagcggcatttcctaaattggtcacccctgattcgccgacgcaacaggttggcgatgtgatcaactcggactttgccaaagttcagcatccgatccctatgttgtcgatgggcgatgtcttttcatttgaagaacttagcgaatgggatgcgcgcatgcaggctaatgttgggcatccggttaattacaatgtggagttaaaaattgacggacttgccttatcgcttatttatgaagatggcaaattggtccaaggctcgacgcgcggcgatggtaacattggcgaagacgtcaccaagaatgtgttgaccattgattcggtaccgaaaaccttgaagaagccgttgtcactcgaagtgcgcggtgaatgctatatgcctaaagcggcgtttgctaaattgaatgcccgacaggaaactgaaggcaatccgccattcgccaatccgcgtaatgcggccgcgggctccttgcgtcagctgaatccgcgcgtcacggccggtcgggaactggacacgtttatttacacgttgattgatcctgatcggtttaacgtgaaaacgcaacatgaagcgattgcgttcatgcatgatttgggctttaccaccaatcccagttcagaagttgccagtgatatgcaggcgattgatgcgtacattactaagtacacaagtgatcgcgatgcgttgccgtatggaattgatgggatcgttttaaaagtcaatgatttggcgctgcaagcccagttaggtaacacggttaaagtgccgcggtgggaaattgcctataagtttccgcctgaagaagccgagacagtgatccatgaaattgtctggacagtggggcgaaccggggttgtcacgccgaccgcggtgatggatccggttcagctggcggggacgacggtttcgcgggcaaccctgcacaatgcggacatgattcatgataaagatatccgaattggcgatacggtcatgctgcataaagcaggcgacattatcccggaagtttcgcgggtgctggttgccaagcgcccggcgaatacgccaccgacaccgattccggaaaaatgtccgtcgtgcggtcagagactagtgcacctcgatgatgaggtggcgttgcggtgcattaatccgatgtgtccggcacaaatgcaggagcagctgacgcattttgcttcgcgtaacgccatgaacattgacgggttgggtcctaaaatcattgcgcagctgcaggccaaacacctggtgcgggatgtcgccgatctctaccgcctgactgcaaccgatctggctcagctggacaaattcaaagaaaaatcaattaataatttattaagtgcgattcataacagtcggcaaaattccgtggaacgcctaatctttggattggggattcgtcacgttggcgggaaagccgcgcgaattcttgcggaacattttggcgacttggatcacctgatggctgccagtcaggaagacattgcggagattcctaatattgggccgactattgccgaagccgttgtgacctatttcaagactgatacggtacgaaagctgatcgatcaattgcgttctgcaggggtcaacctacgttataccggtccgacgcagtccgcggtaaaagatagctttgtttccgggaaaaccgtggtcatcacaggtaaatttgccgagttttcccgcccggatctgacgaaacagcttgaaaaattaggcgccaaagttaccggatcggtttcaaagaaaacggatttggtgattgtcggtgaagcagctggcagtaagctgacgaaagcccagaaattaaatgttccgacgatggatgaaacagaattgttggcgaacttgaagaattgaggaacttcatcaatgaagaaatttttgacgttaaccttactgaccggtgcgattatgctgttagcagcgtgtggcaagttgaatctagacagtaatagcagcagtacaggcggcactaaaacaggaagctaccagacaacggggacagttgataacagtatgtatcaaggggttatcaagaacggccgttatcagacgagcagtgcacgtggtttgacgctgcagcaaaatgaccaaggcgacaacaccttcaatatcaagagtatggaaagtggcttgcagacgttagccaagaaccagttcccgactgataagtattcttttgaagaagggcagctcttgagcaccgccactgccagaagctggctgaaacgtgaatcaaaatccaatgctgaaggcctaaatccgcctgataatgggaaaaaagatcctgatacccgtaacccgatttatttgcaacaaattcttgaacaggatttcatgctgcaagatggcaatagcatgaagttaggcgggattgcgattgcgttaggcatgaacaaggtcgactattataccaagacggaatatggcgcccaatatcagacagaaatctccgatgaaaccatcaaaaagcaaggcgaagcgattgcggcaaaagtcgtcgcccgtttacgcaaaatggaaaaagtgccggatgatattccaattgtggtcggcatttataaaaatgcggaacaggatagtctggtcggtggtgtttatgtcgaacatgccaccagtaaaaacggcaccgatatcggttcatggaagaaactgaatcagcaaaatgaggttttgccggtagtcggcgatcacaaggcgattaacagtaccgtttcaaatgatttttccagttttacgaatcaggtaaaagggttcttcccgacattggctgggattaccgctcaggcacattatgaagatggcaacctagctggcctgaatatcaccgttaatacccagttctatgggttgaccgaaattcagagctttacccagtatatttcaactgctgccagcaaataccttccttcaggcgttccgattgaaattaccattcaaagtacgcaaggcatccaggcgtttgtttcgcgcagttccggtgacaaaggcttttatactcatgtatttgggagttattgaggcaatcttatggtaaactacgaatgaaaaagaaaatgaaagcggggattgcatgatttctaaagacagtgttgcgcatgtggccggtctggctaagctgcaattttctgaagctgatttggagaagtacaccgatcagcttgcggagattctggatatggtcgaacagttggagcaggtttcgaccaaagatgtaccggtcaccacgcaaagtattcatctggagaacgtaatgcgtccggatgttgccaagccagcggaaccggttgccgaattgctcaagaatgttccgaccaagaagggtaccttgatccaagtgccggcgattattgataaggaggacgattaacgcgtggattactttaagaccagtctcgatcagcttcatgaacagttgcgtactggtaagttaaccagtcagcaattagttgacgagacattagccggcattgacaaaatcgacccggatgttgcggcttttcttgccatcaatgcagacggagccaaaaagcaggcagctgctgtggatgctgccgggattgatgcaggccaaccgttatccggggtcccgattgccatcaaagacaacatcgtgaccaagggtgtggtgacaactgcagcctccaagattctggctaactttaatccgatttataatgcaaccgttgtcgagaaactcgcagcagcaggtgcgatcaatgttggaaaaaccaatctggacgagtttgcgatgggctcttcaaccgaaaactcggcttttaagacaaccaaaaatgcgtgggattatacgcgcgttccaggtggttcttcaggcggttctgcggctgctgttgctgctggtgaagtggtcgctgctttgggtagtgataccggtggttcgattcgtcaaccggccgcttttaacgggattgtcgggttcaagccgacatacggccgggtttcccggtgggggcttattgccttcagctcaagccttgatcaaattgggacgctgactcgtaacgttaaagacgcggcgcaggttctgaatgtgattgccggccacgacgaacgggatagtacgaccgctgacacgccggttcctgactataccgaaaagattggccaggcgatcaaaggtatgaagattgcactgcctaaggaatacttaggtaaaggggtcgatccggcagttgctgacaagatcaaagcggcggccaaacagcttgaagacttgggcgccacggtgacggaagtttcactgccgcacacccaatacgctgtcccagcttattacatcatcgccagttctgaagctagttcgaacttgcagcgatttgacgggattcgttatgggttccgcgccaaggacgtccacaatatcgaagacgtttatgttcgttcccgttccgaaggctttggaccagaagttaaacggcggattatgctgggcacctttagtctgtctgcaggcttttacgatgcctacttcaaaaaagccggtcaggtacgaaccttgatcacacgcgactttgaaaaagtcttcaacgattatgatttaatcattgggccaacgacgccaacggttgcctttaagattggcgaaaaagttaccgatccggtcacgatgtacatgaatgatattttgacaatcccggttaatttagccgggttaccggcggcctccgtaccggcaggctttgttgatgggatgccggttgggttgcaactcattggcaagccttttgccgaaagcacgatcttccaagttgccgcagcttttgaagcgcaaaacgactacttagcacagatcccgggaggcaaataagatgaattttgaaacgacaatcgggcttgaagtccacgttgaattaaaaactaagtcaaaaatgttctcgccagcaccggtgacttatggtcaggaacctaataccgaaaccaatgtcattgattggggcttcccaggcgtcttgccgagtattaaccgcggcgcttaccaacttggcattatggtcgccttagcattgcacgcggatgtgacccgcgagactcattttgatcgaaagaactatttttatccggataacccaaaagcatatcagattacccaaagtgagaaaccgcttgggacaaacggttgggttgagattgaggtcaacggcaagaagaaaaaagtcggcattgcggaactgcacgttgaagaagatgccggtaaaaaccagcacgaagatgacggctattcctatgttgacttgaaccggcaaggcacaccactggtcgaaatcgtctctaagccggatatcaccagtccggaagaagcgtatgcctatcttgaaacgcttcgccagattgtgcagtttaccggtgcatccgatgttaaaatggaagaaggctccatgcgtgtcgacaccaacctttccattcggccaatcgggcaaaaacatcttggcactaaaaccgaaatcaagaacctgaactcctttgttcatgttcgcgatgggctggcatttgaagaaaagcgccagcagtcggtgttgcttagtggtggtgaagtgcgtcaggaaacccggcgttgggatccggatgcaaaagagaccattttgatgcgggtcaaagaaggcgccgatgattatcggtactttccggaaccggatttaccacctgtcacggtatcacaacagtggattgacgaggttcaggcatcgttgccgcaaccaccggcagaacgacgtgagcattacatccaagactggggcattccagcatatgatgccggcgttttgactcagaccaaggaaatgtcagacttctttgaagccaccgtggcgcaaggcgctgatgccaagcaggcgtccaactggctgatgggcgaagtttctggctacttgaacgccaagcacatggaattaggccaagttgcgctgactccggagcatttggcagggatgatcaagttaatcggtgacggtacgatttccagcaagatggctaagaaagtcttcaaagaaattatccaacatgataccgatcctgatcattgggttcgcgaaaaaggcttgattcaactgtctgatccggctaaactaaccccgattatcacagcagtgttagatgataaccagcaaagtattgatgactttaaagctggtaaggaccgggcaattggctttcttgtgggtcagatcatgaaacaaacgcatggtcaggccaatcctaaagtcgtcaaccaaattctgatggcagagatcaagaagcgctaattcgtttccgtacttgtgaaccattagcaagtaagcatacaattggtaaagattgacggcggtccggagtgaatcacggggccgccgtttttccggtttaggctaagctaaaattttctgtcgctatcagatttggacatgcaccaaccgaataaagagaacccacaagttcgcagcattgcgcgttaacttgtgcactgaaggagagtcaataagccatgagaaaacgagcgcgtttgatttacaaccctacctccggcaacgaagggctaaagcgtttcgttcctgacattttagatatcatggagcaagcaggttatgaaagctcgacgttccagacaacgccgaagcctttttctgctcgcgaagaagcaaaacgcgccacggaagccggttttgaactaattgtcgcggctggtggcgatggcaccatcaatgaagttgtcaatggcatcgccccggccaagaagcgaccgaagatggcgatcattcccgctggcaccaccaatgactatgcgcgggcactgcggatttcccgggataatccggttgaagcggcacgggtgattttaaaagggcagacgctggcgatggacattggtcaggcaaaccatcactacttcatgaacatcgcggcaggcggcttattaagtgagcttacctactcagtgccgtctgaagttaaatcgatttttggctactttgcttacgtgatcaaaggagcggaaatgctgccggctgttcggacgatgccgatgaagctggagtatgatggcggcgtttacgaaggcccggctagcatgttctttcttggtttgaccaattcggttggcggctttgaacagattgtgcctgacgctgctttgggtgacggtaaattttccctgattatcgtcaaaacggcgaatatggcgaatttactgaagctgatggcgttggtgtttaacggcgggcggcatgtcgacgacccgaacattgtttataccaagaccagaaaactgaaagtcaaaaccggtggtaatgagacgcttaaaatcaacttagatggtgaatatggcggcgatgcaccgatgacatttgttaatttgaagcaacatattgcgatgtatgctaatctggatgaaatcccgaccaagaatcttgggacggatgcgcagaagcaaaaggattacatggcagaagtcgaatcgatctcgcatcgtgatattgatggtgatggtcaaatcggctcacaagatgaataggatgactaatttggcccaaccagctgttaccaagaatcaggatctggaagttaccattcaggatctcacttatgaaggcatgggcgtcgcaaaagtcgctggctttccactgtttatcgaggatgctttgcctggcgaaaaaatgcaggtgcacgtgctgaaagttcaaaaacaatacggctttgccaaggtggtcaaacgtttaaccgattcgcctgatcgagtcgcgggcgcagacggtgcttatattcgcacagggattgcgccgctgtcgattttggcttatccggcgcaactgaagttcaaacagcgccaaatcgaagaactttataaaaaagcccacttagcgattgatgttttgcccaccattggcatgaagcatccgctcggttatcgcaacaaagcgcaggtgccggtccgcatggccaacgatgaattgcaaaccggtttttataaaaaacacagccatgatctggtgccaattgaagattttctgattcaggatcctaaaattgaccacgccattgtggttgttcgggatcttttacgaaaatacaaggtgccagcatatgatgagcggaccaaccgcggcgttattcggaacatcatggttcgccgcggtcacgccacgcaccagatgatgatcgtcttggtatcgcgcacatggcaggtgccacacctgaaagatattgtcgaagaaattacgttggcgttgccggaagtcacaagcgttgtggtgaatttaaacgataaacggaataatgtcatccttggccgcaagtcaaaaacgatttatggtcaggattatcttttggataaactattaggcagcgaatttcagatttcgccggttagtttttaccaagtgaatccggttcaaaccgaagtcctttatacccaagcaattgaagcggcgggattgactggcaaagaaaccgtcattgatgcttattccggtatcggcaccatttcgctcaccatggcgcgtcatgccaaacacgtttatggcgttgaagtggttgaatcagcggtgcgcgatgctcaggcaaatgccgcgcgaaaccatattaaaaatgtgacgtttgaagttggcaaggccgaagatgtgattcagaaatggaaagacgctgacttgccggtagacgtcctgatggttgacccgccgcgtaaaggtttggacaagagcttcattgatgcggtgggttacatgaagccgccgaagatcgtttacgtttcttgcaatcccgcaacattagcacgcgacttgcaattgttggcagaattcggctacaccgccaagcagacacaaccggtggacatgtttccccagacgcagcatattgaaagtattacggctttgacgctcgattaattttggacgtaaggttttttataaagtatttaacgcataagtattcagaaaagccaatcttagtgacgaaaatcgtcaatctgagattggcttttttaatagtgattgccttatcttatcattaaaaattaaatggttctaaatcaattattgcttgacaccatcagcaatggcgcatacgcttacactgtcgttaatggctgggacttgcaaattaaatgggaggggat

SEQ ID NO: 308 - DNA, 2662 bp, Lactobacillus casei
attattgcttgacaccatcagcaatggcgcatacgcttacactgtcgttaatggctgggacttgcaaattaaatgggaggggataacaaaatattaataacgtttcaactttcggtataggaatagaaacgactaggaattgctagtttccgaaaagaatgagcctgtgcttaatgattctctagacaaccggatttagtgcactgtcaagtctaccagttattagcgcttggcagtcatctcacctgataaagaatatgatgttaagtatttgttgggagatttgtggaaggagaaggactttcatgaagaagtttggcaaacgggtggcgtccatacttggatgtggcgtcttacttttaggatcaattggtctatcttcaagtgcttcagtcgctcatgctgctggtgaccaaccgattagcgacgcggaactgaaccagtacatttccaagatgtcgcttgatgagaaaatcgggcagatgtttgtttcacggacaccgcaagacacagcacaggcacgtgccgatgtggcaaagtatcatcttggcggcttaatcgtttacggtgctgatttcacgagcgtggaaggatcaacaccggaggcggcacaaacagcctttaagaacaaactgcagagctttcaggatagtgctaagttaccgttactgattggcgtggaccaggaaggcggcagtgtttcccgattgagtcagaacccgttgattgcaaatgggcgcgcttttccgtcaccgcaagctttattcgctgaaggcggcatggcaaaagtgacccaggaagcgcagcaggttggtacgatacttaagaatttaggcattaactggaattatgcaccggtcgctgacagcacggccgataccgatagtttcatttatccacgcacgatcggtcaggattatacggcaacagcagattatatttcacaggttgttcctgcatggcaaaataccggcattgcagcgaccgttaagcattttccgggttatggttcggcagttgacacccatactgattttgctgttgtgacgaaatcggaagaagcatttgaaaaagaggatcttctgccctttaaagcaggcattgatgctggcgttgattcaattatgattgcccatattgtgatgcaatccgttgatccggtttatccggcatcactttccaagagcgttgttactgaccttctgcgtgataaactcggttacaaagggttgatcattacggatgcgttggggatgggcgcgattactaaatttgcggccagccataacaacgttccggttgacgttctggcggtagcagccggcaatgactgcattatgaacgatgattatgcgacggccattccgcagattcaccaagccgtcaccagtggtcagctctcggaacaggcgatcgatcagcatgttttccggatcttgtcattgaagcgcaagttgggacttttaactgccgtacaactcgaaaccaaacaggtgcgggtcgacaacgtggcttatgaccaagcgaaaaagaccgcaactgtgtcgggcaccgttgtggatagtaactggcaaaccggcgagccgctgacggttaaagacgatcagggacatgtcgttgccacggctgatgttggagcgggcggtaaattcaacttcacgattccgttaacagcaaaggcgcagcaactgaccctgacgaccggattgccggggattgaagatgctcaggtgacaattgaaccgctacaagccgcgaaagtcgataaaaccgcgcttcagtcacttgtgaacctgggcgccgcctatgccgccaatgattacaccagcgattcgtggggcaaataccaagttgcgttgactgcggccaatcaggttttgacggaccaggaggcgacccaagctgcggttgatcatgcagcgcaaacattgcagaaagccattaccgagcttgttaaagctaatgtcaaaatcaataaagatgctttacagcaattggttgaccaagtcctggcatacgatgctaagcgatacaccaccagttcctggacaaaactggaagcggcattagctgcggccaaacaggttcttgctgataaaaatgcaacacaacctgtcattgatcatgcggtccaagtgctaaaaacggccgcaaccggattggaaacacaagttagtggtgccgggcagcaaaagacagtggcctttaccgataaaaagtcgcctaacaaagttcgcggagacaataacgtgatgccacgtgcaggcgaaaaagtggttaacggacttgtgatactcggtgtcgtgctcattttgaccacggcgggtatgatttggtggcgtaaagcacgcgactaaaatgatcagatagtacgattgcttctggcaagttgtttggaagatatgttaacaaacaagaggctggttcataaagccttgtcacaataaaaaaggtgaacatactctgcaatgatgagagtatattcaccttttatttccctgaggtagtatgatggcgttatttaagatatgagtgccaaggcggagcaatcgtaggccagatggggctcagtggtgaaatagactaacttagttgatagatattgatcaggccagatcaatatctatcactttttttgttagagtgagcgtgaagccaacgc

SEQ ID NO: 309 - DNA, 31074 bp, Lactobacillus casei
cgttatcgatacgccacaagaaaaccgcaagaacactgaaaaacctaatgaatgagacttgacttctggtagaaaattgtactagccgggcgatcttcccggcgtagtacaaggccgagcttagagactctgccggttttgcagaggctctaagtcgtgcccacccctctagcttcgcggtcgccagccctcatctggccggagattgcggagtttggcacggccgggaacttattgtctaagatttttgggcaaaccatgataaccccctaaatatttgctcattcgtgttgccattttccgctcgtttccattatcatcagtagcagtgacatgaaatgggggagtattgtgcaacataagaccttggccatgaagtggttgtttttgggatcactgattaccaatacgggtattagcctgatttggccgttaacaacgatttacatgcatgaatatttgggtgagtcgctgactgtggctggcatcgttttgtttttgaactcgatgtttatggttgtgggcaatagtctcggcggctggttatttgatcattggcaaccttatggcaccattttggccgggatcggcttgaatcttggcgcaaccgctttgctgatattctttcacgggtggccggcctatccattgctgttagtcatctccggtttaggcagcggggtgacagccacagccatcaattcttatgcgacgcgcattcgggacaagcgcccgagtgttgtgtttaacgtactctattttacgtcaaatcttggccttgtcatcggcaccctgattgtcggctttgttttaccttatggcattgccatggtctttgcgttggcggccggtttatttgccatctttttggtagtcgcactgtggcactatcgcattgaaaaggtgaccatcacggcgtctgccaagcaagtgacccaagaaggccggaatccggcgcgaccacgtctggtgatgttaatggtgacgttatttgtaacatggttgatgtacgaacagtggcagagtaacatttctgcctttatgctaagtgaagggctcacgattaaggattacagtttcttatggaccatcaacgcgttattgattgtgttgttccaaccgattttgacagcatttgatcgatggttgttgaaacacattcggttacgcttggtcgttggctttatcttgtttgccggatcgtttttgattttattgaacggatccggtgcctatctgacgttcattattgcgatgatcgttttgacggtaggagaagttctggctttgccggcggtttcgacttatgtgacgttgtttacgccgcttgtgcaacaaggccgttatcaagggctgattcaaggatttgcctccgcgggccgggctttgggaccgttgttgggcgcgatgattattgaaggaaccagcagttatcgcctgctcttcgtcagtgcgacggggttgattcttttggcagcattaggctttgccctcacggttcgggagagcattcctgcgctgaatgatccgttacatccagcggcgcatagcagatagtgcttgacaaggtcagttgccgcttgaagtgatgagggtgcgatgtttccggttgcctttttgaaaatgtccgattcatcctgatcgggaagggagattttttcttgcgctatcgtttgattttgagtgatattgatggcacgttgctgaattcgcaacatcaactgacggcgggggttaagcaggcaattcaggcttatgttgctgcaggtgggattttcgtcttggcgtcggcacgccctccgttggcgatgactgcgctggcccgccaaatgggattggcagtgccgctggtcagtctgaacggtgctttgattggccggccagaaggtgagcaatttcggatattagcggcaacctcatggccggaaggagttggcccccgcgtctatcacgccttatcgacgcttcctttaagcttgaatgtattcagtggcacgcactggtatgttgctgcttttgacaaatggaccgatcaggaagccgcaatcactgatataatgccaacaaccgcaccgatacgggacatgttgcgtgataacttgtcggtgcagaaaatgctatgcatgggcgatccgtctatggtggatcgtgccgagaaaatcattttggcacatccggaatggcagctggttgccagccggtcgaaggcaacttatctggaaattgtgcggcaaggggtttcgaaaaaatcggcgttgcaaaccctgagctcattgtataacgttccgatacaggagacgatggcactgggcgatggtgaaaatgatctacccatgttgcaggccgctggactaggcgtaaccttagccaatgccttgccacaagtgtcagctgtcattaaaacagttgtacctgataatgatcacgatggcgccgccgttgcgattcaacggtacgccatgggtgaaacataataaaaacccctcaacttcggaagtcatgaagttgaagggctttatttaaaacagtttcaaataaaatgaatctaatctcttaaatcagccacggcctgaaccagcccctgcttttgcgcttccgagatgaccggatacttgagtggcaaggcggtcacttcgcgattgataatctgcgaaaccgccaagcgtgagtaccatttgtcatcagacggaataatgtaccatggatttttcttggtggcagtgtgttgaatggcttcttggtaagccttttgatagtcatcccaatagcgccgttcgcgaatatcagccagtgagaacttccagtttttctccggaatttcgatgcgtttgaggaagcggtctttttgctcggctttggaaatgtgtaggaaaaactttaaaagtaggatgccgttgcgacgggcgtacgattcaagtgccttaatgtcattgaatcgttctgtccacaattcatcgtgcacatcagaaactgaatcgatgccggggagattttctttcagtagtagttctgggtgaactcgatcgacgagcacctcttcatattgcgatcgattgaaaaccgttaactcgccgccagccgggaaggcgttatgaatgcgccacaaaaagtcatggcttaattccaattcagtaggcaccttgaacgacacaaccgttgttccttggggattaattccggacatcacgtgctcaatcatgctgtctttcccggctgcatccatcccttgaaaaataatgagaacgctgtattgcttctgcgcggctagatgttcttgcaccttcgacagtgtcttgatgttatgctcgatatcttccttgattttgtcctttttgttcttaaattcatctggtggtgccgtggcgaatgccttaatgtcaaacgtgccagttccgtcgaaacggtatttttctaatgtcatttaatcaccctcactatttgcttattttcaacatagtggttccaagcgtgatgtgcaagtgattgacgctccttgtgtttaaacctatgctaaacttacgatcaagaaacgaggggatttcaatggctttaccacggattcaggatgatttgtacatggcgattaacggcgcgtggcaagagaaaacgcagattccaccagataagagcgttgttagtgcggatagtgatttatcggacgaaattcgcacgaagctggtggccgatttaagaaagatggcattgacaggaagtgacaccgtgtcaccgttacggtatgccgcccggttattcgcaaaggctgatgacaaagccaagcggcagcagttggggattgatcctgtgcgcacgcgcgtccagacactggtaaagcttaaaaccttagatcagtttcgggcagcgatgccgacgctgatagctgcgcaatacgtgttgccggtgacgtcgtatgtcgatgccgatatgcatgatgctgagcacaatattttaaatctgagtggtccggatacaattttgcctgatgctgcgatgtatcgtaatggtgatgcggaaaacgccgctgatctagcagcctggtcgaaaatggcgacggccatgttggcagctgcaggtttcagtgaaagtgaccaaaaagattatgttgaagcggctaagcggtttgaccgacgcttggcagcggatgtgccggataatgttgatttggccgtggatagtacctttgacaatccgatgacgtggcaagcatttgaggaagctgccggatttttgggcatcccccaagcttttgcggatttaatgccgcaaacgccgaccaaggttaatgccgtggtcccgaattacgtgccgaacctaccaacacttatcacggccgacaattatcccgagtggcatgcgtggatggtgatcaacgaattgctgtcttgcgcgacatacctaagtgatgatctacggcagctcgccggacaatacgaccgtttcttggcggggcagccggagccgtcatcatggaccaagcatgcttttggcattgccaacgaatattttgacgatgtgattggccaatattacggtcaaacttattttggggcagatgcaaaggcggatatcaccgcgatagtcgagcagattcttgcgcagtaccgcgttcagctcgagaacaatacctggttgagttcgatgaccaagcaaaaagcgatccgcaagttggcaaccatgaaggtgaagatgggataccctgatcagctcttttcgctgtatgaccacttgacggtagatgccgatgacgatttactgacagccattcttaaattgagcagccaaacgcagcaattttggtttaagcaagtaggccagccggtagatcgcaatgagtggaacatgccgggccacttggtgaatgccagttatgacccattgaaaaatgacatcacatttccggccgggattttgcagccaccttattacgcgcttaattggacaaaggcacagaatcttggcggtactggcgtgaccattggccatgagatttcacattcatttgataataatggggcgctgtatgatgaacacgggaatctgcacaactggtggaccacggccgataaaaaggccttcgatcagctggttgaagcgatggtggcacaatttgatggccgggcgtatgaaggtgttaaggttaatggcaagctgacagtgagtgaaaacatggcggataacgcagggatggatgtcgcgttggctttgcttggcgaacatcctgacgccaaggatctgcaggcatttttcacgacctatgcccgttcatgggctaccaaaatgcggccagagcgagttaaaacgctgttacgtcaggatgtccacgcaccggccgcgttacgcgtgaatgtgccagtccagaactttccggcatggtaccaggcttttcaggtacaaccgcaagatgggatgtatcggcagccacggaagcgattgaccatttggcatcggtagtgtgcaagtgaaagtgttttaaatgaaatagattaaattcaaaaaaactggctcccatcactgatgacaagagccagtttttttctatgcgtcatgaatcacatgatgataatgcagccacccggtttcccgttcgccaatctggtcgtacaaatgctgggcgcctagattactggtgcgggtctgccagttggcacttgcaaagccctcatcggctgccagctcaaatgctgcggccatgagttgccgcgccagtccgcggcgccgaaacttgggtgcaacatagacgtcgttgatgatgagcaccggttttaacgttcgcgtatcaaagctgcgatataaaatggcaaaaccagccaactgctcattgtgttctgcgactaacaaataaccaagcccagggtcgttacgcaaacgttcgagatgtgcggccattgctggtgaatcgatcgttagcggtactgggctgtcgtgataatagccttggataagcggtaatagatgcgggatatcttttggcattgcgcgtcgtgtcgccataacagggcatcctcctcgtttaaaaattatcagatttcttattgatgaaattgctaaagaggtattgtggcatttttttcttaaacacaagcatatgtgacggttgcggttaccgataattactgccgatcttccgttgccatcgagaaaaccgcgacacagccgaatccagtgtggctggcaattgtcggcccgatgttgccgatttgcagtggggtttgcggcgaggcttcatgaagccgatctttaataaagttagctgcctcccgatcaccggaagtggaaatgatgacgcggtgttgcggattttcctgaacggcttttaaggtttcgttggccaagtcgatgagtgaacgtttgcgggcgcgaacttttcgaacgacgcgtagctttccttcagtgtcaacatccatcaccggcttgatattcaacatagtgcccagcgccgctgacgttcgggaaacccggccgccatggtaaagaaaatcaagcttgtcaacggtgaaccacatccgatagtcaagtcggtggtcgtttagccattttgctaattcatcgatcggcatgccggcatcgcgtttatcaatggcatcaaggacaaactggccttcaccggcacacgcggccaaagtgtcaaccaagtaaatctgggcgtccggatacttttccagcaacatagcgcgagcttgggtggccgagttgaaagttccgctcaggccgctggaaaagccaatgtagagaatgggcgttttcgccttgacgtaaggcgtgaaaaagtcaacaaattggccgacgttaacctgcgtcgtggtcggcatgacattctgcttgagctgctgataaaaggcgttgatatcataatgatcctcaccaagatcgtcttcgtattccacaccatcaatcgtaaagtgcatcgaaacgaaatcgacgtgatgatcatgcaatgtctgataaggaagatcacaacaagaatcggttaagagttgatacatggactcacctcaaaatacccgacaaataacgggtttatttaaatcaatactacgctgtttgacctggttccgaaagtgaaggggctgttaccaacataacgtaggtcaaagtggttaaaaattcggggtgctctgatggcgttaaatttacccagaactaaaaagtcgaagggcaacttgtgcgattcgacttaaaagacttaattttctttcgtatctttcgcatcagacgtttggttaaacaacttgcctaacgccggcaaagtgcctaatgaatcaatagccgtgcttggcaaaacaaccgtgttggccgtgcctttagccaaagcttcgatggcttcaacatttttatacttcaaatataagtcgccattgtcgatcaacccggcattgattgagttgatttgatccttaacggcagccgcgattaaccgttgactttccgcgtggccctgcgcttggagaatctgggtttgcttattggcttcagcttccaaaatggctgcctgtttttcaccttcagctttggcaatcgctgcttgcttgtggccttctgcttccatgatgttggcttccttttcccgtgaagcccggagtagtttgttcatggaatcctgaatcgtggcatctacctgaatggaatcaatgttgacccggtcgacattcaagccatagccggcagttgtttcggcaatttgctggaacaaggtttggttaatggtctcggtgccattcaaaacatcgttcagatccatattaccgataatcccacgcaaattagcccgggtatcctgaaccattgaaaggacggaatctttgttttgataaacataggcgttgacgtcggtaatgtgatacttaagcgtttcagaaatccgcacgacaacgttatcttttgtgatgacttcctgctcgtcaacttttaacggaatctgcttcatgttgacaatttcggtgatgcgatagataaacggcggtaccacatgaaaaccaggctgcagcgttgccacatacttaccaagtcgctcgacgatgccaacttcaccagtatggataatggcaacgctggtgaaaagcacagcgatgacaatgactaaaacaatcactgcgattgaaataagaacaacattcatatacaagaccccccatgagtcaaaactgctctaaggcttaatattttaagcgatgttccggtttaacgacgccgaggaacaaaggtgaaaccgcattcacaacaaccaaatcgccagccgcagcatcatcattgacgcgataatgataatgaatcccatacagcgttatctcgccttgtcgcgccgaggttggcaaaataaaggtggttcctaaaagccgatcatcaagcattggcgtcgctcctttccaaatgtatccagattaataatggtggctgaccataaccattatcatcacaagctaattctaaagcacggttagtggaaagacaatcaggacggctcagcgacagtaagctttatggtgaggattgttgcggtattgataaagcgctgaatcggggttttagcatgcgccgtaaaatgccggattaccgtagtaaaaattgcattttgtatgttcatgggcaagaattttctaaccctattatccgaaaaacgtttgactttgttacaataggatcaatcaacgcgaccgtttgcctttaaaaagggatgcggcgataagggaggatttttttgcggagtcggcgagtcatttatgcagatacttatcgccatcggtggcaccggtggttattcgtcgccggtggcatactggttgtcttattgctggtaggatggtggttgcagcgcaatccgcgaccggatccatcaacataccccattttgggcgtgcggttggaccagacagacggtgttcaggattttgatcgtttacgcgccagtaaagtcagctttgtttatctcaaagcgacggaaggcagcagctattttgatgacaatttcaatacgaattttaaccaggcggccggcagtcggttaagcattggtgtctatcacgttttcagttttgaaaccacgccacaagcacaggcgcttcaattcgagcgaaaagtcggatcaaatattggcgatcttcccatcggcatttatttaagttattacagggagcaaaagccaagtgctgcatggctgactcagcatttgaatgcgtttataacgaccattcaacagcaatatcatcggccggtactattgatggggagccctgatattttggcaaaagttaaaacggttgtgcctcaagcaccacggtggttcgtgagcgacaaacagccggcgcaaaagggcaacttttggcaatatactgcaggtgcccgtatccccaacggaccgcaagcaacttatcgcgctgccgtatttatgggaaagcgaagcagctttttgcgactggcgcaataggcgctcaattgcgcaatcatcctgaccattcgcaaaacacgctgatctaacaaaactgttcgttaaatgttcgccgaaactatcctcgattgtggcatattgggccatactaatagcgaggtgaacaggatgaaaaaagtactgatcggcctggtcgtgctggttgtactcgtttttggcggtttaaagatttttgaaatcaccaattatggcggcaccacgtactacacaaaaattaccaacactggtcagcgggtcaccaatcgtgataatgaaggtaacaagcacacgatttatgcttacgatctgcctggctttgatgagcgaggcggcttacaacagttgaagtttaatgcgaatcgagatcgtccgttaagaaaaaatgcgtttctgaaagtcacctataatgataaaaaaggcgtcaccagttgggaaagcatctcacgttcacaggttcccaaagcagctttggccaagcttgagtaggccatcataaaaagacagcaaaaagtgccggtccgcaatggatcggcacttttttggctattagcgtaagtcggcttctgcactgatgaatagctgatgcttgtcacgcacttggaataataatggcataggtggcgtcttcggcttcgtcataaatggtctgtgggccattgtcgtctgctgtgatgaccagtttgtacccataatgatcaagaaatgtcagctcgttaatggtaatcccaaccacttgccctggcaggattttattgtcgattgcgatctgcagctgcggcgagatcgctagcgagtgggtcttgttggtctgttcatcaagaaaagcaaagcttcccgtgaagttctttgccaatgccattgccggattcggtgctttgcccttatccttgtgatgatgaccgcggtgcgcgagtgcatatttcaacccgcgtaaaaaactcgccatgttttcgacctcccatttttatctatgtttagtctaccatgagatttttatttagtggttacagtggtgctgtttttctgttactgggctgttacaataatcatgaacggttctaatggcctttaatttaggccatggtggaatcaaaaaagaacgtgcacagttgcggatgaatgcagctgtgatcatgtttgaaggaggacttgccatgttgaaactcggcgtgatcggaacaggatggatcaccaagcaattcgtggctgcagcaaaggccaccaatgcctttgagctgacggcagtttattcgcgacacgaagaaagtgctcagtcattcatcgaccagacggcacctgcaacggcgtatacgaagatggacgattttctgggcagcgatgtggacgtggtgtatattgccagtcctaatagtctgcacgcctcgcaagcgttggcggcactggatgccgataagcacgtgattgttgaaaagccattggtcgcaacagccatggaatttgagaaactagatgaagcgttgcgcaaaaagccacaattgtatctttttgaagctgcgcgccacgtctatgagcataacttccaggttgtcaacgacttcacccaccgccagcaaatcgatggcgcgaccctcacgtatatgaagtattcgtccaaatatgatgcttttttggctggcaaattaccgaatgttttcaaccccgagttcgcaggcggtgccttaatggatctgggcatttatctggtttacgatgccgttgcgtggttcggggttcctgacaatgccgtttacctgccgcattttcttaaaagcggcgttgatggcgatggtgtagcgcggttggattatggtgacttttctgttacattaatcaccggcaaaacgaccaacagttcgctgccatcggagatttattccggcaggcagaccctgacgatggataatgcagcggaacttgagacgattaaacttgacgatcaggttttaagcaccgaaaagctggacaacccaatggaagcggaggctgcttactttgccaaggcaattaccggtcaggatcggaatgcctttgataaagcttggcaactcgccaaggaagtacaccaagtcatgtcgattctgcggacttccgctaatctggacttttagtgaggacgatcattttgacaattgcaaccccgtttcaaaaacggtggcaggctgatggctttactgaacaaacgccgattcaggccgctgtttatcagccgctaaaaaccgatgaagatgtgattggtttggcaccaaccggatcgggcaaaacgctggcatttggcttaccgttattagaaaaaatcgtgccgggtgatggccttcagctacttattttggcaccttcacaagagttggctatccagacgcgcaacgtgttaacgccttacgcgcaagatatccatgtcaacgttcaaggcattatcggttcggcgaacgtgaagcggcagttgacgcggcttaaagaaaaaccggaagtgattgtggcaaccgctgggcgtttgttggaattaattcaatcacgtaagttaaaactggctggtttgcaaacgctggtcgttgacgaagccgatgaaatgttgcgggatcccggctttgcgcaggttcgagaaatcactgcggcagctccggccgaaacgcagctggcatttttctccgccacaccaagcccttatttcaaggaaatgtctaagtggtttggcaaaacgcctaaattgattgatgtccgtgccatcgacaagacgcaaggaacggttcggcaccttttcttgcaaaccgatcgcgcgcatcaaatcgattggttgcgcacgctggcccacaccgatggcttcaaggcactggttttcttcaatcaaaatgcttcgttagaacgggctgccggcattttgcgccatcaagccgtacgctttgccgtattatcgcgggaaggccgccaaaccagccgacaaaaggccttaaccgattttcggcatggtcgcgtgactttgttgttagtgaccgatatggcaggccgtgggttggatattcccaagctaccggccgtggtgaactttgatccgccaaagcgagccgaagtgtatattcatcgcgccggacgcaccggccgcatgggcgagtcaggaatggtcgtgaccttgggggatgatcatgatcgccgtgacttggccaagctggtaccgcaatatgggattcaccgggcgtatatggtcgatggcaagttagtcgacacgccaccaacaccatcggcagacacgccaaaagacagcgccaccgttgattcagcagctcaagtacctaagcaaaaaccagcacgaaaaatgcctaagaaagagcagtcagctaaagcagttgatccgggcgagaagccgcatcgcaagcataaaaaaaatcgcgtgcgggatcggcggaataaaggtaagcataagaaacagccatgagacgaaatcagcggtatgataaggacggagggcagtcatggaaagtatgaaggcggaacaaatggctgctatgatgacgctgatgagtgcagccggtgatgcgcaaaaagcgacgatggcagcgattgatgcagccaaagccgatcaaatcgaacgcagccgcaaacttttgaaacacgcggatgcgaagctgaagcaagctcatcaagctcagacccaaatgctgacgtacgaggcacgaggtcaaaaagttgacgtcaccttattaatggtgcacagtcaggatcatcttatgagtgccatgacaatccgtcgccttgccgatgagattattgatctttaccagcaagtccatgcccaaaagtaaaacgggtggctgtggcaggtatcagcataaccatcgtcatcataacgcgcttgccggcgcaggggtctgcgtgtaaggaccttggtcgcaatggcctaagcccgggccatcacgcccaaggccacttacactccgacccctaagcgcgccggctcacgctcacaagcaagagaggtaatccccatgaaaattgaaaagacattacagacaccggcagcatttttatatagtaaaatcgtagcgccggtccaagccgatattatcgcagcaggccatcagccagttgatatggctaagcttggtggttttacctaccgcaagcagtttcctgatggtgaatgggcacaggtgaaagtcacccaaaatgtgatcaatcgcgaatttgcgatgctgacaatgacgcgtttctcacggttcaaagtccgttatttgatcacaccgttgagtgccgcggctagtcgcgttcaggtgagtgaaaccgttcagccgattaactgggttgcacaactcaaacagatggttacggaacttctggttggccataaacgccgccgcaacgttgggcgaatgctcgactcgattgaacggtcgtatcgaactgcttaacaagtaagctacgcgttgaaccattgttactagcaatgaaagttaatgacaacaaaagtcttctgctcgctggtgcaagtggaagactttttctattctctatttttcggatatattacatgctggcttatatttccgagttcctatttttaaaaatacttgattttttaaaattaaggtcgataattaaggaacaatcagcaatgtttatggaatttaaagaatgaaggtggcgacgcatgagctatttaccattaagcaaatttaagtacaacaataatggcacgggcagaaagagccctcaggaaattgatgctgaatatcgactcagactttcagggccgtcaacggttacaactacgctctttcctgtacttgaaaacccggctctgttggatctcgcggccgcagaaaataaagcgatttctgtcgcgaaataccctatattttttgtcgagacacatgatatcaatctccttgtgagtcgtattcagagtcattcggcgacgattgtcaatttagccaatcatcagcaatttcctcctgttgcgattagaagttatttaaagaagcttttgagtaacgagattatttttacgaacgaaatcgaaggcgttcagacaaatcctaaggaaattggaaccatcattggtaatttacagcagaagcctggtagagtcgagaaacggttggagtctaccattcggaagtatcatgattcggccactggtagaatgaggcagattaacgggttgaaggattaccgtgacatttatgatgagttgctaaaaggagaaataccagacgcaaagttgcccgatggtaaattatttaggaataaatttgcatttattggtacagatgctcacgctgttcatataccgcctgttaccgaaaacgaaattgaagtggccttggaacaattaatcatatttatgaacagtgatgatttgcttacccttgagaaagcggttatcacgcacttcatgttcgagaatacgcatccatttttggatggaaatggccgtaccggacgatatttgctgtcatcgtatctttcaagtaagctcgatccatttacgggtttatctgtttcaaccgctatccacaacaatctttcgacctattatcggctctttcaagaagctgataatattgaaaacagggcagagctaacattctttctaaaagggatgttaaagattatcgaaagtggtcaaacagacgttataaatgagctggagtcgtctaaggaacagctgcaatcaactagcaaaaagttgtatgcgaagttcactgatctggatgacgtgatgaaggaggtcctgtacgttcttcttcaatcgtatttatttaccgaaagcatcacttatggtatacaagatcgtgatattgttgaagttcttaagcgaacccctaactcgattccgaggacacggactaaacgtgctattgatatgctggaaagtaagaaaatgattacaagcgtttcaaaaaatccacttcagcacgtcataagcaaagaagtgttagccgaaatactgccatcaaaatgattgcagactaacaaaggtactgaaccgtttgagatttattactatttttattggttttttaccgtgtaagcaaaaggccttcccgaaaaacacagacggaaggctttttgtggattttatgttagttgattttggtatgctataatgatgcggcaggagagaatcgaactctcaacctacggcttaggaggccggcgctctatccgattgagctactaccgcggaacattcacaagtttaaactaaacctgcgtttagggcaaattaatcagagagcgtgaactggcgcggttagaagtcggagtgtaagcggcctcaggcgtgatgggcccggtcttggccattgcgcctgaggtccttacacgtagacttctgcgccagtgagcgcgttttcgcggcagtatcggtacggggcgggttttgaccgttacgcccaaggcccttacacgcagatttcggggctgacaaacggtttatggaagcgaaatgaatggcaaaaaaggcgccaagcagcctgtcattcttatgctgtcaatgatcagtgaataacctcgtctccttcagcaacacgttaactgatccaaaatccacccataccaaaggaggatgcccacatgcaagctttcatgaatgtttatgtccccggatggttgatcttcattggtggcatcctgctcattagcgtggttaatggtgcgacggttcaagccatggtaaaccatgccggccgatcgaacacgcaaatatggtacatgaagccgggcatttttgttcatgagttgttgcatgccgctattgcgcgagtatttggcttgcaggtgacgaatttttcgttgcgagccgatccgttgcaaggcagcgctgcacatgtcagtttgcgttatgatcggcatgatccgcttgcccagctggggctgtttttatccagcagcgcaccggtttggggcatcagcattgtcttgttggtccttggtcggtgggcgtttttcccggcaggcaatcaggtgtggcaagtacttgcggcttcatcgagcctcagtgaaaaatgggtcatgatgcgcggcatggtggcgattaactggcagtggttggctatttttctagtcgtgaccctgattttgacgccgggtgtcgctttatcgcatcgcgacctgcagaatatgtggcaaagtgcgccggtggcgtttttaggcaccatggtcattttctatctcttcctcacgttctggccagccggcttttcgtggtggactttgttgaatttgaatttattgttactggatttaatggtgttaggctttagtctggttatttggtttgtagtcaatttgctttaaatacggcaatttgtggtagtaagatggcgtcacatttcgaagttaatacttttgaaaagggcatctgccatagttatcaaaatctataattgaggcaagcaaaaaccggttagggggagaagtatggttgtcacgcaaccaacaacgattttaaaagaaaaattcggttacgatcattttcgaaccggccaaaaacaggcaattgatcgcgtgatggcgggagaaagtaccttagtcgtgatgccgaccggtggtggtaagtcgttgtgctaccaggtgccggctatgttactgccgggattgacattggtggtgtcgcctttgattgccttgatgaaggatcaggttgacgcgttaaatgacaacgatattccagcaacgtttatcaacagcacgcttgattttcagacaattaacgagcgactgaatcaggcaaaatcggggcagattaagttgttgtatgtggctccggaacgatttgacaacgactggtttgtgcagcaacttgccgcgacgcatgtggcgctttttgcgattgatgaagcccattgtatttcacagtggggccatgatttccggccaagttatctgaatctagcccaggtcgctgcccagttgcctgaacatccgcctgtgattgccttgactgcaaccgctacgccgcgggtcagtcaggatatttgtcaacggctgatgattccggatgatggggtcattaataccggatttgaacgcgataaccttagctttaaagtggttcgtgatcaggacgaagatcgttatctgctggattatcttaaactcaacgtcgatcaatccggcattatttacgcgagcactcgcaaagaggtagatcgcctctatacgttcttagaacataaaaagttaccagtggcaaagtatcacgccggtatgactgaaaagcaacgggcagccaatcaagaagattttctgtttgatcgcaagccgattatgattgcaacgaatgcatttggcatgggcatcgataaaagcaacgttcgttttgtcattcatgcccaaattcccaaggatttggagtcttattatcaggaagccgggcgtgccggacgggatggcttgccaagtgaagccattttgttattcaagccgcaagatttacaggtacaacggttcttcattgaccaatccgaaggtgacgaggcgcacaaacagcggcaatacgacaaactaaaaacaatggaacgttatgccaataccgaccagtgtctacaacagttcattctggattattttgggcaaacaggaactaagccatgcggccgctgctctaattgtcttgatgatcgcgaatcggttgacgtgaccatcgatgcccagaaggtgttgtcatgtgtcgtacggctccatgaacggtttggcaaaggcgttgttgcccaagtacttgcaggggcgcacaatcagcgtgtcttgtcgtttcacttggatcagctgtctacatacggcttgatgcaaaatcgccgtcagcgtgatatcacaacgtttatcgactttttgacggctggtgggtatcttgagacccgcggcggccagtatccgacacttgggcttaccgccaaaggagccgaggttttacgcggccgggcaactgttttccagaaaaccgcgcagaaagcgaagcaaacactggaagtcgatgacacagtcttccaggaattacgcagtactcggcgtcagttggcagaacaacagcatttgccgccttacatgatcttttcggacaaaacgctaaaggcgatcggcagcgcgatgccgcaaacgatggacgagtttttggctgtcaaaggggtcggccaagccaaactcgacaaatacggtcaaatctttttggatgtcttgaaggcgatccaaccggaaaaagcgcaaagctaagtcgaccggcacatcaatcaaaaaccgaaccaaggcatttttgcagttgttgcaaaatgctttgattcggttttttacgctgttatggtgtagaacactacgcccagtcaccgttgcggaaaatgggaactacagtgccgtcgggtttaataccatcaatgtccatgctggcggagcccatcatgaagtcaacatgggtaggactttgatttaagccggttgtccttcgttgttcggcgttcattgccacgccgtctttgactgaaaatgggtaggcttggccgagtgccatgtggtctgacgcgttttcgtcataaagggtattgaagaaaatgagcccggattgggagatgggggatggatccggaaccagcgatacttcgcctagtgaacgggcgccaggcgttttgagcaggttttgcaagacatcattcccacgatcggcatgggccttcacgacttgtccgtttttaaacgtaaattgcatgccttccaggatctggccgctgtagctaaggggcttggtcgaaacaaccgtgccgtcgattcgccggaaatccggagccgtgaagacttcttccgttggcatgttggccatgaattcttcgccacgcggattgaaggcgccaccgcccttccaaatgtgattcttcggcaatccaacgaccaaatccgtccccggcgccatgtaatgcagttgatcaaattgctcagcggtcagccatttcgcctttgcgctcaatttctgatcgtgcgctttccaagcggcttctggatcaggctggtcaatgcgggtagttttgaaaatcgcttcccacaaccggtcagttgcttcttgcggcgttttggcgtcagggaagactttctgcgcccatgccggactagcggcaccgataatcgtccagctaatgctcattgagctgatggcgttcatcaggcgttggtaggctttcgtgaaagctttctgatatttggcaattcttgtcggatcaatggcggccaaattgtccggatcactcgagatgacggtgatccgttttgcttggtgatcgacccagtaatcaaattggcctttaacaaaaggcggaatattaaaaaggcggtcctcggccatatgtgccatgtccagacgtttgagtgtatcgtcagaccactgaacctgaacttccgccgcaccacgttgataagcggcggcaacaatcaggcgggcaagctgggcctgatccacggcaatctgcaggtagacggtatcgccgggtttgacggcaacaccgatgtctaccgccagatcggcatattgtttaagcttttcgttaaagttggctaatggcataatggggttcctccaagtagtttggcaacagtttaccatagtcaaaccgctgactggcgtaagatgcctcgaattagcatcaaaaaatgtcaaaataaattaagaaaaactgaaatttctttatgaattcggttcctttctgctttcatctctggtaaaataacagcaaggcacggggcatatcttttggagtggagatgttgccccaagtgtctaaaatttagttgtgtgcaagttagttttaaataacttttaaagaaagtaaggggaacaatatggcacgaaagaaaactatcacgcatgatcagattctcaacgcagcatatgacctggttgtggaacaaggctttaagagttttaccgcacggaatattgcgaagaaaatgaattgctcgacccagccgatttatttagaattcaagaatatggctgaattaaagcaagcggtcatggatcgtatcaaagaactgttggcattgaagatggctaagcattatacgaatgatccggttgttgacttggggttagcttatatttactttgcattagagaatcgtccgctttaccgcgcggtttttgttgaagatcattttggggttgacgagatgcgcgaatatgcgatgagcacggccatgcgcgtctttgatgcttatgaacctgctaagaacttaagcgaagcgcaattgcgtaacacgatttgcggggtatggattgtcgcaacagggattgctaatttaatggcacctggcttcatcgatatcacccgcgatcagatggtcgacattttaaccgccgtaacgcaagactttattgtcaatggccggttttcagacgacccgcgaatctcatggtttgaaaaagctcaaatcgcacaaggctattaaacgataaactggggaacatcgttttgccgtgcgccttgttgtcgataaaactaatgtgaataaaacctgcttgccaattgaccggtgtaaggtcgcgtgcaagcaggttttttgttgctccagcgctcacagtactggaaaaccgctcaacaatgcgctatttttgacttaccaagtgttatcctaacaaaatgaaacggacagcacctaaaaccaagaaggagtcagttatgggaagttcatccgaccttaaagaattattacgcgagcgagtcgcagctaagtatacgattgatgatttgaaggagacggggaaaaagattcgagagaccgccccgattgagagcctcgctgccgttagtaaaattgatcgtgatccggttcagtttattaatagtgtggaacagaatttgacggaatcgctattgccaatgcgtcaccagcgaatgggtgcatcgcaggcggcctttttccgtggcactgccgaactgatggcgtatgatttgcgccaaggtgagaaatcggggatcaatctgttaatcgatggcgatgcgcacttacaaaacttcggcttttacgcctcgccggaacgaaatttacttttcgacctcaatgactttgacgaagctcagattaatagcttcgaatttgatatcaaacgtctactaaccagtgtttatctgcttggtgatcagcaggggtttgcggcagataagttagatgagctggtgcaaaccgatgccagcatttatcgcaaaaccttacgggatctcttcaagcttggtgctttggatcgcttctatcaatccactgaggtcaatcatcttatgcaggaaattcccggcgcagaagactcgcaattgttggcgaaattcgttaagaaagcgacaaaacgcaataatgattctgtcgttaaaaaatataccctgacaactgatgatggccacatgcggttcaaagacgatccgccgagttccgtgcggcttgaccaagcaacttaccaggcgatttatgatgggtttacccagtatcgcaagaccgcgcgttcggatattctggttttgttaagccagtatcgaattacggatattattcaccacagcgttggtattggtagtttcgggacgaactgctacttagttttgctcagcggcttaggcggcagtcatttagtcctgcaggtcaaggaagcattaccgccacggccagaattattaccgcacaccgaacgcatcacgttgcagcaggaagttagccaaggacagcgaatcattgccgcgcagatgatacttcaaaaagcctctgatccctttttaggttggtttaacgtcggcgataaaagtttttacgtccgccagtttcgagatatgaaaggttcggtggatctggaggaacttagctttactgaatttcagtattatacccagatgacggcgtatcttttggccatggcacacgcccaaacaccccaagcagcagtcgtcactggttatttggacaagcatttcgacagtgcggttcagcggtggagtaagtggtatgtgaaccaggttaaagccgattatgccgcttttctgcgcgcagttgactcacatcttctggcataaacggcaatgcaccatttcgagtgccgttattattcgattgattgatgaatcaaaataagttttgcttgtttttactggattgactctggcaaaattaaagagagctttaatcgttagtaggagggagggtaaagcatggcacggaaaaagcatcgccaaaagcgaccgttgctttcagcggaacaacaggacatgattcgttcaggccagatggcgttagcagagatgaagttgccgcgccggaccaagttttgggtctttgtccgcttggcaatgaatcgtgtggctgaatccaacatcggccaaagcgcggcggctatcgcctactatgcgttattatcgctctttcctttgatcttatttgttgccaacgccttgccatacctggggctgacttacagtagtttagcaacttatttgacacaggcggtgccttcgaatgtgatgaagtggctcgatccggtgattgccaatttattaaacacaagtagtggcgggttattgggaatcggtgctgtcgccacattgtgggctgctagcctaggtgtgaatggcctgaagatgggctttaatcaggtttatggcgtagatgccacgcagaatttcattattcaacggttgttgtcgatgctgatgacttttatgctgattattgtgatgggcacgattttaattgcttttgcatttggccgccaatttctcgagtggttgattcctttgctacgcttgaacgatgattggctaaaaacatttaataccttacgttggccggtgacggttacggcattattcatcatcattatgtttcttgattattttttaccgaatgtcaaaatcaagatatggacggtgctgccaggcactgcattcacagtgattggctggcttctgattgcccaagccttttcgttgtatatgcattatttcggcacccgttacctgtcgtatggcactatcggtacgttcattgccattatgttgtggctgaatttttcgtcattggttttattgtggggtgcggtgatcaatgcgctgacggcagagtatttcatcggtcggcttcatcgcagtaagggaaaagtccacgactttgtgaagcggcgggtgaaaacgccgcggccaaaagagaaatcataatgaattcaatttgccttcagcggcacaataaaaggctcgcgcgacaatctgcgcgagccttttgggttcagtttattttattgcatagatttgaatttttcgactaactgtttggtgaaggcttccagatgcttgatgtcttcttcttcaggagaaagatcgattttaacattctcggctcccttggttgcgccggttttggcgaacgccttgtcgaaatcatcgacagacgtggcgaagtcgtcatagaaccggtcgccgctgccgcaacagccatacactttaccagtcaggtcgagatcctgaagctcttcataaaaatcaactgcttcatccggtaactcgccgtcaccaacatccgaataggtgtaagttgccgtcacacaaatatcaacatcttcaaaatcgctagccaaggcttgtgagacttccgtggtcgtgacatcgacattcaaatcttcaaaagcctcttcaacaatactggcgatgtcttcattgttaccggttaggctggcatatacaattctcgcgcttgccattattctagtcatcctcctaaaaaacagctctcgattttccgatgacggcgaggctgttgtgcttgttcattcgcctgattatagcatagggtgacagcttctgggcgattcattcatcacaatggctgcactcgcgctcttttccaattaatgctacactaattgcgagttaaaatcgtattggaaagcaggcaagaagtttgattaccatcaaatcagcacgtgaaataaaaggtatggccaagtcaggcgctattttagcagcgatgcatgttggcttgcgcgatattattaaaccgggaatctcaagctgggaaatcgaaaagttcgccaaagagttttttgagtctcatggcgctaaagcagaacaagttggttttgaaggctacaagtatgtgacctgcgtcagcattaatgatgaagttgctcatgccgttccgcgtaagggattgaaattaaaagacggcgatgttgtgagtgtcgatacagtgatcagttggcatggctattttagcgattcctgctggacatatggtgtcggtaaggtctcggaagctgaccagaagctgatggatgtgaccaagaagtcattatatctggggattgatgaagcggtcgtcggtaatcgaatcggtgatattggcgcggcgattcagacctatacagaagacgacaacggttatggggatgttcgtgagcttgtgggtcatggcattcagccgacgatgcatgaaagtccgaatgtgccgcattatggcgttcctggtcacggcttgcggctcaaggcaggcatgaccattacgatcgaaccgatgatcacggaaggtacctggaagattaagggcaaacaggtgccaggcgatacatgggaatactatgttacggctgatggcagtaaatgtgcccagtacgagcatacccttgtgattacggataacggtccgaagattctgacctcacaaggtgatccgattgacgccaagtatcagttgaccgaagacgatctcaagacgcttccggaataatgggattcgccgttagccagaccaaggcatgacgaacggttaatcagaaccagccatcacggaacctgtaagcaggaagcagccatttgtttcctgcttttgttgttttatttggccaagtatatcgcttttagataccgtgctggcggataatagacattgcaagtacaagagaaaagagggacgatatggcagctcaggaagcattgatctcggtcatcatgccggtctataatgccgaaaagtatctggctcaggcactggatagtttgctggcgcaggattattcgaattttgagatcatttgcgtggacgacgggtcagtggataccagtaagattattttagcagcctatgcccgccagaatgcgcgaattcatgttgttcgggttaaaaatggtggccaggcccgcgcgcggcaggttggcattgaacacgccaagggctcgttcctcgctttcatggacagcgatgatctggttcacccccagtggttatcaactatggcagaagggatgcaaacgccgcgggtcgatatgacggtggtcaattactataactatattggcggcactaaaattaaagcccggtcgtttcacgcgcctgtatttacaatcgaaggtgatgacaagtatcggtattggcttgaggaccatgatctgcgtggctatttatggaataaaatgtttcgcgccgatttgttcaaggagccagtgccggttgccaactttaatttacttgaagatgcttatttcatcggccaactcttgccacgcattgatcaaattcattttgtcgatcaaccgcgatattactaccgatttaacgcgaccagtagcgttcatgctaaatttcaaaagcgcgatctggaagccattcaccaactgggtgccgttttcctgacgcttgcgcggaaaaaaccggaactgacttcgttggcagtacgccggtatgcggcgttgagtttgtttgtgttatcgaaaatgtcgccgcggcagttagtggctaactggggctacgcgcagcagttaggaatggttttagcgcagtatgcccgcgaatttcaaggcattatttcggccggggatgccaatgcattggcggcagacaagccggggaaagcaagccttttaggtaagttgcgcgcctggtcgcatttgctgggattaccaacatttgatgacttgaataagttggccggtcgtgaaagcgatgaggctaagaaggagtcgtgataggtcgttcatgttgtgggagaatttgttgttttgttggcaaatgtgaaatcgaatttccgctttctataacgcgctcaccataatgcgtttcccggcgcaggagcctgcgtgtaaggactttggtcgcaatggcaaaggacgcgccatcacacccaaggccgcttacactccggctcctaaccgcaccggctcacgctcaccaaaaaagcagccatcgccctcaaaagaaggcaatggctgcttcatatcgattatcatggaaaatggggtgccgtgttggggaaggtcagttttgaccctttactttacgcgggctttttttcggtggtgaagaggtcggtgctgttggtttcggtcactttagcactgaccggtgtggcatacagattcatgccttcctttttgaaagcctgtgcctgggcaacggcgtcggcgaattgctgcgcctggtcggccgtgatctcagcgtcgtatttgttgatccgaatgcttgtggctttaccagcttcggacttgaaactaaaaatcagtgttttcattaataatccctccggttaacttaggcgacgacagcagcttgttgttgcaagacggtgctggtcagtgttgcgtttggataaagcttcgcaaacgcttgaccgattgccagcaattcttcgtctttggcattagggtcaacgttgttcatccgccgtacctgcttgaatgcttcgttctccgggtcggtcagggtataaacaatcgtttggctcgtgatattgcggctcatggtgattcctccttatagtgaatgactggtttgttaacgactcggccgatgtcgtttaacagtggcttggtttgtaaggcggttgttttgccttacactgatataaattgctaaggaggatgatttgacaacgcggtgagggaaaattttaacgtacagcagcactgaaggtttgcaatctgtgacatgacaattatcagaggagatagaatgataaatcgagcagtcgtcttttgtgtaaaaggtttacatattatgctgacagctacggcgataacatctttaatcaagcactataaatcagccaatccgatgaaaatactggtgataatggagggtgggtatcaagaagatatcgacttcattcgccagatgccccagttgtttggcaaagaacaagtatcgattgacttttggacgccgccttacgatatgatggaaaaagtctcggatcattttgaaacaggcacaaaattgccgaaaatggtcctttggcggctgttgctgccttattatttccaggcgtatgatcagttggcttatttggacaatgatgtgctggtcacaaccgatgtaaatgaactgtttgatcagctaacaccggaggacatccttggtggggttttagattacgaagatgccacacacccgaatcataatcgggcaaaggaatttttcctgcctagtacggaccaatacatcaatgcgggagtatttgtggctaatgcccgcgcttatcgggcttttgcgccgtttgacaagatgatggccgctatcaatcggcgtaattacccgtatggtgaccaaaatattatcaacattgtcttttatcagcacattcatctgttgccgtggcggtttaatctgcaatacgatgatcggttactgaataagtatgaacatttggcaccgcaacgggtcaatgaaataagaagccagttggaccggccggggatcattcattttgcctcgaatggctattttcccatgccgtgggataaatttacgccaaccacgcgttgggaaagaatgtggtggcagacgtttgccgagattaaggagaaacagttagcgtttttggatcctggacagcaaaaatgataagcggcttatttctccatttctaagtgctcctgctcccgctcttgcagaaagtctaatgtctgctaaaataattaaggtatttctttaaaaagggtaaggtttttgctgactaacatttttgtcacttaaggtcggctatacttacagtcggattccttctggggtccttgattaatgaaaattgaagggttctgattgtgtgataacagcgcaggcgccaggcaaactttatgttgccggtgaatacgcggtggtcgaaaccggcttcccggcaatcattgtggcattggatcaatttgtcactgtgacggtcgaagccgcgaagcatttcggcagtatcgtgtctgaacagtatcaagaaaactcgttatactggcaacgccaaggcgacgaaatggtttttgataaccgggataatccatttcattacattctctcggcgattaaattaacagagcagtatgcgcgtgaattaaataaaccgcttgctttatacaagctttatattgattcgcaactggatgccaaagacggaaagaagtatggtttggggagttccgcggcggtaacggttgcaacgatcaaagcgctcgccaagttttatgatttgaagatgtccaaagaccagatttataagcttgcggccattgcccacctcgatgttcagggtaatggctctttaggtgacattgctgcgtcggtttacggcgggtggatcgcttaccgctcgtttgacaaagcatggttggcggctgccagaaatcagatgtcactggcagatttgatcaacgctgactggccggacttgtcgattgagttgttaacggcgccagcagatatgcaactactggttggctggaccggttcgccagcatcgacatcacaattagtcgataaaatcaccttggctaaagccaaaaagccacaactttatcaacagtttttgacggcaagtcgcgagacacttgagaaactcattaccggctttagggaacattcgctcagtcatattcaggctggcattcgccgtaaccgtgagttgttggacgagttggcacacttttcgggggttgcgattcaaacgccggctttgcggcaattagtgacgctggctgaagaagcaggtggtgcggctaaatcttcaggagcaggcggtggtgactgtggaatcgttttgattgattcccatcaggccattcagccgttgctggcggcttggcgaaagcaccatattgaaccgctgaagttcaaagtccatgaaattaatgattaacaaaaatcccggtcattttgacaataaccgagatttttttatttttttgcgatgaagtcatgaattctttcttagaattagcggaatcgtgtactcttcgcaagcggtttctagtatagtagagtaggtagttaaattagtagagaagggacttgtatgcgtgtgaaagttcgtaaagcagtcattccggcagccgggcttgggacccgttttttgccggcaacaaaagctttagctaaggaaatgttgccaattgttgacaaaccgacgattcaattcatcgttgaagaagctaaagccagtggtattgaagatattctgattgttgagggtaaacaaaaacgttccatcgaggatcacttcgattctgctcctgaattggaacaaaatctaaaagaaaaacataaagatgccttgttgcagcttgttcattcaaccaccgatatcggggttaacttgttcttcgtgcgccagccatatccgcgtggccttggggatgccgttcggttagctaagtcgtttgtaggcgacgagccattcgttgtgatgcttggcgatgatttgatgaacgacaaggttccgttaaccaaacaactcatcaatgagtacgataagacccatgcctcgattcttgccgttaagaaagttccacatgatgaggtatcggcttacggcgtcattgatcctgaaaaagaagtctccaaaggcctcttcaacgtgaagaagttcgttgaaaagccagcagtcgctgatgcaccaagcgacttggcaattatcggccgttacttattgacaccggagattttcgacattcttgaaaaccaaaagccgggtaaaggaaacgaaatccagctgaccgatgccattgacacactgaatcaaacgcaacgggtcttcgcccatgagtttaccggcgatcgatatgatgtcggcaacaaattcggttatgtcaaaaccaatatcgaatatggcttaacccatccagaagttaaggatgagctgcgggcttatattcttgatttagccgcgaaattgcagtcaggcaaatctgttggcaaaccggcaaataaaaagtaatttgatgtaaatgaatgtcgatgacacatgaggagcaaaagggacaaggcaaggctattcgtcttacgatgaagtgtccttcctcatggttatgtcagcggcagcttaaatttagttttctatattagcttcatttcagtcaggaacaagtggctgaaatgaagctttttttgtgggcgattccagctgccattggtgttaagtcatagtggatacaaaaccggttaataagctgattgggtatattaaataacttttgaattatgaatacggcttgtgtcaaatcattcttgcaagcattttcagttgccctttttaatttaactataagttattgaaaacgttgaaatgacggaacttataaatgattaaactgaaaattgacttaaaaaataaaccgaggtaataactgttaaaaattaaaactgtcagatataatataacataagtttggttaatccaaaca

SEQ ID NO: 310 - DNA, 184009 bp, Lactobacillus casei
attaaataacttttgaattatgaatacggcttgtgtcaaatcattcttgcaagcattttcagttgcccttttttattttactataagtttttgtaaacgttgaaatgacggaacttataaatgattaaattgaaaattgacttaaaaaataaaacgaggtaataactgttaaaaattaaaactgtcagatataatataacataagtttggttaatccaaacatcgaggagggagatggtaccggaagtcactgaaatttgtgttcgttaatggccgtctaatccagtggaagcgttgcaggaggattttacaagtatgaatttcttcataaacgcatcaatgcccaaacaaaagtcgggaattgaacatgcggaactggctcgctttagactctttaatgcccatcacgttgagtcgcgtatcgtgattcgtgactgggatccacaactccacgttcatgccaaagaggctgggattgcggatcgacagctgattggcatgtttgactattttcaggaagcgttggatgtcccttccaaaaagattgttacgtcagagcttgattttggggtcatgaatacacacgtgcaacatgaggagaggcgggatctggtcttcacggcacgcgagcagctggttgcacgggttaatttgaataacaataggacagttcagtcggttgaactctttgacggtttcaacaatctttttcgggtcgatcactatgacagtcgcggttttgtatcactaagccaatggtatacaccagacaacaaaatcggcacggaaacttggcaaacgcctgccgggaagacggtcttggaaacttttaataaggatgacgcggttggcaagcgccaaaagtcaggctggcgattgattgatcgggatggaactgttcgtcaatttgatacgattgagcgtctgaccaaacatttttttgatttacttaacgagactttttggtcagaaacgacaccgaatatttttgtgcttgatcgctcacatttaggggattggggcttgctccatttgaaaaggccagcttatacagttttttatttgcacaactcacatgctagcgactcacaagatccgatgaatgctattttgaacaacttttatgagtttggcatgcacgccatgaacggttacgatgccgtggtttcagcgactcaccggcaaactcgagacgtcgaggcacggttttcgccgcagacaaaactgtttaccattcctgtgggcattattcctgatcgacagctagccgaaccacgaattcctgtagcaaagcggcagtttggcaaaatggtcgtttttgcccgtatcgcttgggaaaagcgacttgatgatctggtgcgggctattggtattgtgcatcgcgcgatacctgctgtcagcttagatttatacgggtatgcggatccttcagaaaacttcaaggcgcggcgagcgattgaagcggtgatcaaggaggaccacctggaagaggttgtgaagtttaaaggttacaccactgatgttgcagaagttgaaaatcacgccatgatgtatggcctcacgtcgcggatggaaggatttaacttaggtatcatggaggccatttcacacgggttgatcgggttcacgtacgatgttaactatggacccaatgaaattattgaagacggaattaacggtcgaattgtggctaatggcgattacaaggcgttggcagccgccatacttgatgtactgcgcgatccggaactggcacaacaatattcgacaggtgcttatgattcggcaaagcggtattcagaaaccaatgtatggcaagcttggcaagcgctgctaaaggatgctcagtcacaatggcctagcaagttgcaggccatgccagcattagtacacaaccaatgaggaaaaaagcatgaattattttatcggcaacgatattttcgtcatgaactccggtaccgagttttcccaagcgcaacgggttcaccttttcaaagatatgggccttcgcgcgcagtatgtgacacgcaactacaatccgttgttagcccataatcgccttgatttagggctacaagcagaagatgtgctcaatatgtacgattttttccaaggaacagtggatgtgcagcggcgcgaacaaaatttacgccttctgtcgcagattcctctggatgaatatcatttgattgcacatggcccaaacgaaacgatgattaacgaggctggtcgggaaattgccaagattcaagtcatgccggggactgtcggcttggttcatagcatcacgtatttggatcgctttaacaatccagcggttagggaaaactttgattggcgcggcttcaagtcgtcagtcgactatttccatccggatggccagcttgctgtccagaaatttttaaatctggcaggtaaaacggttctcgaagtaacgcatatgaatatcgagggcaacgttcagccaacgatgtggaaacttttggattataaagggcgtaactttcggtttaatctcgaagaccaactgtttttatttttcctgaatgaactgacggctgcgcatccgcatagcctgttgatttctgatcggcgcgatttggactatgtcgtggcaagtgtccaacaagctggtagtaagtgggcatacctgcatgacgtgccgttgcggcggtcgggcaaacgtgctgactggctgccggcttatcaaccgttacttgaagagcaccgcgcagattttgacgggctcatcgttgccactgtggcggaacaaaaagatttgcgcgcacgtttgccggatctgccagtgatcgttgcgccagatacctatgttccgcgcggcctaaaaccaatcaacgaagcaaaacgcgatccgcatctgattttgtttgtaggacgactctcgccagaaaaacgtcctgatcaggcgatccgcgttttagccaaagttcacgaaacgcttcccgatgccaagcttgagtttcggggttatgcgattgatcaagactatctcgagaagctcaaggacttagcaaaaaaagaaggcgtacgcgagcaggtggcctttgctgattatgtcactggcgatcagttagcaagcgtctatgaaaaaggaagcgtcatcttgcagacttcccgaaatgagggctttgggatgaacttgctagaggcaatgagttacggtgttccaatcgttgcttacgatactccctatggtgcaagcgcattagttgcggatggcgtcaatggctatcttgctaaaaacggcgccataacggatatggcagcaaaagtgacaaagattttgtcggatcggaaactatgggaacaaatgcacactgccgcattggaaaaacgaggagatttctcgcaggcaaatgccgaaacggcttggcaaaaggcgatgaaagacatccgggaaacggtgggttctgatcgttcggcatcgctgacgtccaaggcgttaggggggaattagcacatggctttcattaatttaaagcgaaataaaaatgtaaaagaaacgaattttaagatgtataaagatgggaagcattgggtttttgcttccatgttcgttcttgctttggggtttggcagtgcacaagtgagtcagtcgcagcaggttttggctgatgacagcgttgccaccagcagtcaggtcgccgcaccaaatacaaaggacgctaccgtatcggcggccagtcaaaatacaagttcaaccgctagctcggcagctgaatcatccgcagcaacgccatctcagccaacggcaactgtgccaacaagtacggcatcggtggcaacttcaagcgaggcgccaagcaccgttgatccggaactagttaaatcggtttccgctgagttagcaaccgtatcttcctatgctgctatagctgagagttatgctagtcgggcagctggcaatgccaatgccagtgccgcggcaaccaaggcaacccaagcttataacagtgcacttgatgtccagaagctcgtcaatcactatgcaacgctggcatcgatgtatgctgaacaaaagaacaacgcagcagcatcaaccgccacaacaaatgcaaaaagtgccgcctcgttaattggcaactatgccgggctggcttcaacggccgctcatgatgcagctgtagcagccatgccgagtattttagccgcgcaaagcagtgcggcagcggcgacagcatcagttgccgacagagctaggggacaagccagtgcggccacacaaaaagtgacatccgcctatactgcgacccagtatgctgcgggtaacaacgatgtgaaggcggcttatttggctgcttcttcggctgcagttagtgctagtcaggcagcaaccgcagccgcacaagcagcagcatctgcagccacacaatatcaggcagcaagttcggcagccgctagtggcaacttcgatgctgttgtggcaggggatgctattttagcccagtttaaaacgcaggcagatactgctgatgtgcaggctatcactcagtacaatgcagcttcttcaagtgctgaggtggccaactctttggcgattgctgattttcgggctaaaacgacttcatccgcaagccttgctgccagcactgcggatagtgcagtaagccttgcttcatcaaccgcatctgctgccaaaacagttcaggcaactagttatgccggacagtcaacgagcttagccaaccaagcttccagcgcagcggccgtggccagcagcaatgccgccattcaacctgctagcgttcaagtggcgaactcgttagctggcgtcaatagcagtgtcgccgcagcagcgctttcctatgcggccgcagcgcaaaaggcagccagtttggcggcacagtttaacaaggatatttccggaacgcagtcagctgaaaaatcagataccccggaagcgacgttatccttagtaacgtcgacgaatgcattaacgttaggcggtaccgcaaatttaagtacaacaattggcaacttaggaccgaacaacaaggttcaaggtaccccaacctataattggtacgagtcaactgacggtaagaattggcagaagattagcaattcagatgcttcactggcgtttaaaccagactttgctggcacttacttcttccaagtagtcgcaagtggaacaagaagtgagtggggggttttcacgaaaaccttcagtgctgcctctaacaccatcacgattctcgttagtgaccctaaaggttcttacactgagcaagcccaagcggccaatagcaaagctgccaattatgcatcagccgcgaacactgcggagcaatcagctagccaagccattacggatctgaaaaacaacgctgatacaagtggccaagcggcggcttatttcgccagtctggcaaattcctatgctgctatagcaagtgctgcggccaccaccgcaaatagtctagctaaagcaacgagtgaagccgctgtgagtgcgtcaacggcagaaagcagtggtcagtacgcatctgctgcttcatacgcggcattggcttcttcagccgcggttgctctcagttcggcagcagctgaaacaagcagtgctgctgctaaaaccgaagaatcagtcaattctgcaatgggtgcggctgcaggtgatccgtcaagtgttgaacacgataaaaccgctgagtacctgacatctagttatgccactaaggcaagtgctgctgcttcagcggctagtcaggccgcctctctggcaagttccgagtatgcggccctcgctaatgcgttcgcaacgcttgatcctgcgctgacttcaaatgcccagacgtatctttcccaagccagtcaggcgctttcgttggcgactagttcggcaaatgatgcctcaagccaagcagcattggctaagtcagctgggagtgattttaccaaggcatctttggctgctttaacagcaaacacaacgatgagccaagcgtatcagcaagcatcagcagctactagcgtccgcagtgaaggtattgcgaagatttttgctaaccaatctaaggtttatgtcgaccagataaccgcagctaccagtgccgcaacagctgccgagtcaacagctaattcggtcgccgcggtcgcgagttccgcaagcgcacttaagaacacatcgctagcctatgcttatgcgagtgctgcttcgagttttgcccaacaagttgatctcaatcgcggctcagagttaattgccgcgacgcaagcggtgaatcagttgagtttggcatccagcgctgtggcggctaacgatttgcttgcggcgagttcctatgcaacggcagcaagttctgctgcggtccaagcatcaacctttgcctctatggccacaagcaatgcagctacagcgtcgtcactggccgaacgggtcaagaactattcgcttgataccacttcgaccaaaggagcggtttccagcgatgcctgggttccacttggtattgtcgtagcacaagggaaaggtgtatctccgcaaaatgtctccacagtgactggtggtaaaacggtaacgttggcggcaagttactatataggcttcagacctttcgacaccacttgggccgtcacttggtatgtgtttgttcaaggaaaatggatatctgttgcggatgcgagccaatatattaaagactttcatgtaacgaatgcagtggttaatggtaaagacagctggtttaatcgtaatgctttaagtacattgacttttaaaacgactgactatgctggatctctacgttttcaggcatcttttcaggcagctagtggatttaacgacacggggtacagcggcgtcggccaagtcgatgtctatgaaaatgacattcatgcaaacagaataacgattgttaacggtgatgattatgttcttgaaggtcagaaagggtcgtatacgtacgcaacggacccggacaacgctacagggactgtcacttggagtagtagtgatcagtctgttgccacaattgatagtactggtaatttaacggctcgtaagaccggacaaacgacgattactgttacgattacaaacagtgatgggtcgacccattcagattctaagacagtcacgattggcaatggccttaccgatcaaacggccaacgtcggcacggatattacgtttatcccgcagacgacgctggattctggtgatattaaatatcaatggtataaagctaattcagccaacgattcaggaagtgccatttccggtgcaacaagcaatagcttgacgctgaataatgttgagttaacagatggtgcttattattatttggtcgtaagttatacgtccaataaaaaaacccagacaattaagcttggtccggcaaaactgacggttaacagtatctatgcaacagctgcttcaagtgcggcagcggcagcttcatcaagtgctcaagaggtaacggactttgctaatgttgcatcgtcctatgccgaggttgctaattcgtacgcctcaaacagcagtctgcaatccactgcagcaagttatgccgccagtgctgcttcggttgccctttcagcaagttctgaggccaatagttatgctacccttgcctcaagtgccgcggctcttgcatcaagtgctgaagtagctggttcaacggcgacagcttcttctgcggcagctacagcgcttttagctgccagcaatgctgcggttgccaagaagaacgcgatcgatgcagcagcgactgctgaggaatacgccaagagagcaacggctgaatatgcaaaaattgcttccgaatcagctattgatgcggaaacggcagcgaaaaatgcatcaattgccgcagatgcagcagccaaggctgcagctagttggccagatgatgctgctatcagttcggctgctcaatctgcaagcacagcagcatcaaatgcggcaagttacgcggtccaagcttcaagtgctgcggtagttgcaacttcagctagcatagaaggaaacaactctgcagcaagtagcgctgccgacgaggcatcaactgcagccagtctagcttcaagcgaggcagcactggcttccgaggcaaacagcaaagcgcaagcaacggctgcagcgaacactgctgcgaataatcatggcagcggcaacacgggttcgaacaactccggagacgacaacactggtaacggtaatactggttcgaacaataccggtgacaataacaccggtaacagcaattcgggttcggacaatgccggtgacaataacaccggcaacagtaactcgggtaacaacaataccggagacaagaataccggtaacagtaatgctggttcgaataatactggcgacaacaacaccggtaacagcaattcgggctcaaacaataccggagacaataacacgggcaacagtaactctggtaacaacaatacaggcgacgacaacactggtaacggtaataagggctcgaataatactggcgacaacaacaccggtaacagtaactcgggctcgaacaataccggggacaacaactccggagacaagaataccggtaacagtaatgctggttccaacaactcgggtaacaacaataccggggatgacaacactggtaatggaaataagggctcgaataattctggtgacgataacagtggtaacagcaattcgggctcgaacaataccggagacaacaacactggcaacagtaactcgggcaacaacaataccggggacgacaacactggtaatagtaattcgggttcgaacaactccggagacaataacactggcaacagtaataagggatcgaacaactcaggcaacaataactctggcgacggaaacaccggtaacagcaactcaggctcgaacaatactggagacaacaataccggcaacgacaacactggcaatggaaataagggctctaataactctggcgacagcaacagcggtaacagcaactcgggatcgaacaatactggagacaacaataccggagacaataacactggcaacagtaataagggatcaaacaacaccggtgacagcaacagcggcaacaacaacgctggttcgaacaactcgggtaacaataataccggggacgataacactggtaatggaaataagggttcgaataacactggcgacagcaacaccggaaacagtaacgctggttcaaacaacactggcgacaacaacaccggtaacagcaattcgggctcgaacaataccggggacgacaacagtggtaatggcaataagggctcgaacaataccggggacgataacactggtaatggtaataagggctcgaataattccggtgacagcaacagcggcaacaataacgctggttcaaacaacactggcgacaacaatatcggtaacagcaattcgggctcgaacaataccggggacgacaacagtggtaatggcaataagggctcgaacaacactggagacagcaacaccggtaacagcaactcaggttcaaacaactcgggcaacagcaataccggggacgacaacactggtaatggtaatacgggttcgaataattccggtgacagcaacagcggcaacaacaacgctggttcgaacaacacgggtaacaataataccggcgatgacaacagtggtaatggcaataagggctcgaacaatactggtgatagcaacactggtaatggcaataagggctcgaataatactggcgaaaacaacaccggtaatagtaactcgggtaacaacaactccggagacaagaataccggtaacagtaatgctggttccaacaactcgggtaacaacaataccggggatgacaacactggtaatggaaatgagggctcgaataattccggtgacaacaataccgggaataacaacgctggttctaacaactccggagatagcaacactggcaacggtaataaaggctcgaacaactcaggcaacaataataccggggacgacaacagtggtaatggcaataagggctcgaacaacactggcgacagcaacaccggtaacggcaactcaggttcaaacaactcgggtgacaacaataccggcgacgataacactggtaatggtaataagggctcgaacaattctggtgacagcaacagcggcaacggcaatacgggttcgaacaatactgggaataacaatgctggttccaacaactcgggcaacaacaataccggggacgataacagtggtaatggaaataagggctcgaataattctggcgacaacaacaccggtaatagcaactctggttcggacaatactggtgacaacaataccggcaacagtaactcgggttccaacaatactggtgacaacaataccggaaacagcaattcgggcttgaacaatgccggtgacaacaataccggaaacagcaattcgggtaacaacaactccggcgacaataataccggagacgacaacactggtaatggaaataagggttcgaataattctggcgacaacaacaccggtaacggtaataaaggttcaagcaactcaggtgatcaaaacaccggtaataacaactcgggttccaataattttggcgacggcaacactggtaacaataatgccggctcggacaacaccggcgacaacaacaccggcaatagtaactcgggttcaaacaatactggggacgccaacactggcaacggtaataaaggctcgaacaattctggtaacaacaataccggcgatggtaacaccggcaatagtaactcaggttcgaacaataccggcgacgccaacactggcgatggtaataagggctcgaataattccggtgacaacaacaccggaaatagcaatgctggttcaaacaacactggcgataacaacaccggcaacaacaattcgggcctgaataattccggtgacaacaataccgggaataacaacgctggttctaacaactccggagatagcaacactggcaacggtaataaaggctcgaacaactcaggcaacaataactctggcgacggaaacatcggaaatagcaatacaggctcgaataacactggtaatagtaataagggctcgaacaatactggagacaacaacaccggcaacagtaacgctggctccaacaactctggcaacagcaataccggtgacaacaatactgggaataataatgctggttccaacaactcgggcgacaacaacactggaaatagcaatttgggatcaaacaattctggcgacggcaacactggcaatgctaataagggctcgaataattctggtgacggcaacaccggcaacagcaattcgggttcggacaataccggtgacaacaataccgggaacagtaactcgggtaacaagaataccggagacgacaacactggtaatggaaataagggctcgaataattctggtgacaacaataccggcaacagtaacgctggttcgaataactttggcgacaacaacactggaaatagcaactcgggttcaaacaacgccggtgacaacaacaccggcaacaataatgctggctcgaataattctggtgacaataacactggtaatggtaatgagggctcgaataattcaggcgacaacaataccggtatcagtaacatcggttcgaacaattcgggtgacaacaatactggtaacgataataccggatcgaacaattccggcgatagcaacactggcaacagtaatgctggcgcgaacaattacggcgacaacaatactggcaacagtaatgccggtttaaacaactcaggcgacaacaacactggtaacagcaacgtgggctcgaataactcaggtgacaacaacaccggcaacagcaatgctggttccgacaacttcggtgaccaaaacattggccatagtaatgtgggatccaataatactggtaataacaatcacggcaacaacaataccggtaacggtaacatcggttctaacaacaacggtaacagcaaccaaggcaacaataatcaagggagtgataatgtcggctcgaacaatgtcggaaatggcaatatcgggtcaaataaccaaggcaacaataattcaggcaacaacctgatcggtgataacttgcggagtccggtcgtggtgattcatgacattaacattaacaacgatgctgccatcactgcagacaccattaagagtatgatcacgagcatcacggacatttacggtcattcgcttgatccagcttcactcaagtacgttttagtttctgcattcacgaaagcacagaaccaaacagcgagtgatagcattccagccaatacgatcgaattcatcctgaccaagttggcggatcaatcgggttataaggttgagattgcgtttggcacaagatttgtcaacggtcatgatagcggaagtggcgcggttacctacgcaactgctcaattaatgtttaacggcaaaaccagtcagcacgagttaccaggtactggtggtggcgagtctgacgaaaagcctagcgatcatgtgacgaagccgagtgatacggccaaaaagcctgaaccaaacgatcacagggttggcaatacgtctaatagtgataagaatcgggttgacaccaacactcattctggaaataagactattaatggcaatgctcgtaatggcaatgctcgccgtcagttaccacaaactggcgatgagcaggctacaagtctctcgatttggggattgctgctggcaggcttctcactgctccttggcggcctaaagaaacgcaagcgttccgacgattgagcatgaaaattgcctatcagacaagcgtttctgacacttgaaccataacgcgttcgccagcccagaaacctgcgtgtaaggacctcggacgcgatggcaaagcccagccatcacgcccgaggccacttacactccggtttctaagcgggatggctcacgctctccaaaaaagcatcttgtttgatgaacgagtcaaattgtacattcaaacgggatgcttttttattgaaaacagagccattacgaattaaaaaaacgtatatctgtgctaaaattatggatgtaatgaattgttcagattcgatttttatgcataatcttcattggcttttacgagaaggagctgcttatgttttacttcttaacatcggcaattgattataataactcaggcatcgagaatgctcagatgaagcgcttgatcctgtttcaaaagcacaatgttccggctaaaatcgcaacgttcacttatgcgcggtatcagtatttgtatttaacgcgcgaatcattaatgcccgacgatgttgttaatctgtatgatttttttcaaagtcgcttattttatcatggtcctcgagaaaatatcgcgaattttaaagttgtgaatgctgacgcagaagacaatggaatgaacgtcatatatcgtcgcaaaggccaaaaagtgatgcaggtctggacgttcacggattatactttttatgaaaagggccagatcgaacgggttgagtattatggcacaaatggcaaactgcaacgtaaggatttgtatgatgtccggggctttttgtcgagttctatttattacgctgcttcaggagggcatgaccgccaagtgttttatgatgccgtgggcgtgccggtcattgtcaagcaattccagaacgtaaaaggggatcaggctgaacgaatctggttgcgttattatgcgcgatcctattattttgattcagatgacgagctgacagggttcttttatgatcagttagtcaagcaagatgcggaagggatgatcgctgaccgttcgtatgcggtggatccgggtatctatcatatgcagcaacatgtctatacgatttcattttggcataacgtgcatactgcggctgatgccccattaaccggtgcgctgagtgagacgcttggcgcagaaataaaggaggcgtcgcggttccaggggctgtttacttcaacgcataagcagtcttcgatgattgcaaagcgagttaaaagctttccgattaaaacggtcccggctggatttgttactgatcaaacgttggcagaaaaacacgttcccttcgacaagcggcaatcgcatcatattatcagtgtctccaggattcatgaacaaaagcgactcgaggacacgatcagcgcctttgttcagataagacaggctgttccagatgcaacgttaagcattcatggctacatcaatgatcaaaaattaatggatcagttgcaaaagcaagtcaatgatgcacacttgcacgatgcggttacgtttgttgcctacacgccggatttaaccagtgtctataacaacgcgcaattgatgctgatttccagccgctatgaagggtttggtttagcgctgctagaggcgcagtcgcacggtgttcccgcgatcagttacgatgttaattatggccccagtgacatcattatagatgggaaaagtggttatatcgttaagaatggcgatattcatgcattggcagaaaaggcgattgcattgttcaaggatgatcagctgcttcgccaattgagtgatggggcttatacgagtgcggcgcggttcagcgagaacaaagtgtggcaggcatggcaggatcaatttattcaaccagcaagggagcagaataaatgatttatttaatgacagatgtgatccgttatgaattctccggcattgattatgccattcgccaacgttatcgcctttttaaagaaatgggtgtgccggttaaaatcatatccaccatctataatcggttcagtgatttgaatcgcttcagagccggcattgtggcggaagattgcatcaatatgaatgacttttttcagcaagccgttctttatcatggcccgcggcggacgctggctgatcttgattttggtaatttagtcacgccggttcgccaagcgcgacaggtgcattactacaaagggcgttatcgggtcgtgacggtgactttagctaagccggactcagggtatccgtctgcacccgatcagattgataaaattgatttcttcgggcaccgcgatcaattactgcagacagactattatgatgtgcgtgggtttttatcgatgcggcatatctttgatgaagatggctatctgacgacagaacagatgatgcgtccagatggcaaggtaggttatgaaaacacctaccaaaaagacgatgccgggcatagtgtgttgcaggaaactacccttcaaacggatgatggtctcagtatcttcacgacgcggcaggagctgataaccgccttcttatcgcgtttgcaggcgatcggccagcctgcctatttctttgctgactggccggaaatgggggacgcgccgttgtttgcccttcccacgcatccaaaagtcattgcggttcggcactccgcccacacccaagaccctaatgatccgatgaaaagtccatacgtggatcgcgtccagcaggaaatcgatcatccggaaagcgtcatcggctttgtgaccgccaccaaaagccaagcagctgatttacaccaacgttccggcgtcaaaacctgggccattccaccatcgtataacgagtctacgcttttagaaaaatcgcctgtaccgctaaaccaccggaaaaagcacacaatcatcagcgttgcccgcattcacccggaaaagcaactcgatcaactcattgaggcggtccggtcaatccaacagcgggtcccggacgttcaactggaaatttatggctacgtcaactaccaatcgtattatcataagttgcaaaaacaggttgctgaagcgcacctgcaagatcatgtgcggtttatgggctatgtgcctgacttaagtaaaccgtttgaccaaggaacggttttagccttaaccggttattatgaaggctttaacctcgccttgatgcaaagcctggctcacggcatgcctgctgtggcttacgatgtgcattacggcatcaacgagcaaatcaaagatggccaaaatggcttcttagtgccactcagtgatcggacaactttggccaaccgtctgacccaggttttgaccgatgcggacttgtggcaggcgcagagtgtggcggctaagaaactggcgcaggtttattcaaaagctcatgttgtagcaaagtggcgggcatttttggatgatcttcaggtgccggttgatggcaaaatccaaaataaataaaacaaagaggttcaatcgtcaacggctactgatgactgaacctctttgttttctggaaactagtcttgactgggacggcttacccgactagcttttttgactttttcaagcagacgccaaaattccagatcccattcatcgctgacctgaacgtgctcgtaaggtaatgctaaaaatccgctgccggcaaagtggcgaatcacaatccgcgcatagtcgtcaatgatcttttgcaccaactgcggatcccagtgataatcgggattgtgtaagtaggtgagatcgtgttgataattgaagcgccacggcaaaagctgcacgtggccttccagaagaatattgagaattgtctggtcggctaaatgccagtgggtcgtgttgatggttgtaatcagcttgtcgaccggaatcatttggttgaactgagcggtgttaataatcatcatgccattattgaagtagtgccgcatggatttcatgccgtagagttcttcggccggatactgatcctcgtagtagtttttggaagccgcaaacaaaaaatcgggaacggctgccagaacatggtgctcgtccaacaagtcaaacaaacggctgacatcggttttgacaatcacgtcattatctaagtaaagcagcttctgatagttggcaaaataattaggggtaaacagccgccaaattgccatgggcgggaccggcacaccttcgccaattgtaaagtccggcgatatttgatcgacttcgctgggtttactccaaaagtcgacggtgacttgcggtaaaccaaacttttggggcagggttttaatatagtcgatatccggttgctggacatcctcacagacaaccagaatctgtaatggttgggtattttgataattttccaaaatcgaagtgatcgccacagcggttaattgaagatgaagtcgggtgacgcagaaaacaacggcattttcactcattcagaagcctccagaatctttgctgaaatatcataattgactggcctttgatgccagcagcctgacttgatgcagggcctgccaaaaagctgcttcccactcgtcatggagcgcgacatgctggtagggtgccgaaaccggaccttcaccggcgaagtgacgaatggcaatgtgtgggtaagccgccagcattggttggatgcgctcgggatcccagtgataaggatcggtgaaatattttttgctatgttgataattataacgataaggcaatagcaacgtgctttcttgaaacatgagattcatcagcgtctgatctgccaggttccatgacgtggtttgaatgagcttaaggatgtctccgggttgataactggcattataacgcgccacgttcatgacaatgaccccgccattaaaataatgctgcatatcggccatgccatataaatacatggtatcaaccttggacggcaactcataatctttggaagctgcgaataaaaagtcagggacggccgcaagcgtgtgctggtcatctaactgttcgaacaacttggaaacatccgtattgacaatgatgtcattatccaagtaaagcagtttttgatagttcgaaaagtaagccggcaaaaacattcgccagaaagccatcggtggcgtcgagccggtacgtccgcgcatttgataaggcttcagatccttagcccaagccggtggcgcccaaaaatcaatcgacgcagccgggcggttcaattgttgcgggaatgaccgaatcaaatcaatatctgcctggaggacatgatcgcagacgactaaaatttttaagggtgtttgttgatgataatgttgtaacaatgtcgtgatggccacggccgtgagttgaatatgcgggccagtaacgcagaagacaaccgcctgctgctccaaaagaaaaacctcctgaacgtgagccgacgcggttagaagtcggcgaacgcgttaatatgctgttacgctgctggaaatcaaaaacaaggctacttgatttctggttgaatcgtatgaatcggactgatattaaaactcagccgcttaacattgatcaagacgcgtaagaattcttcttcccattcatcggcgagacgaacatgttggtacggacaggtgagccgaccggtaccggcaaaatggcgaatcagaatgtgcggatactcatctgtcaccgttttgacaagttgcggatcccaatcaaccttgggattatcaaagaatgccaatgagtgttggaaattgtaacgatatggcaagtatttaacgtggccagcagccagaatattaataatggtctgatcagctaaataccagttcgatgtgttgataacgtgcagcaaacgggttaccggaattaaccgattgaatttcgccacatcaatcaacatgacgccattattaaagtaatgcctcatggaatcgataccataagcttctttggcgttaaagttggcgggaccgtaaccaacatcggtcgcaaacaaaaagtcctttacggccgccagaacatagggctcattcagttgggcaaagatattgctgacatcggtttcgatcatcgtgtcgttgtctaagtaaagcatgcgatcgtaatcattgaagtaattaggcataaacaatcgccagatggccatcggcggcaccggtacgccactgccaatggtgaaatccggtctgattttggaaatctcttgcgggatggaccaaaaatcgaccgtcaccatgggtttgccatagatcgccggcaattgtttgataaaagcgatgtctggttgacgaacaccgctgcaaacaatattgatttgtaagtctcgtttggcttgatagtgttcaaggatcgtggcgatggacacggcggtaagttgcaagtgggtccctgtgacgcaataaacgatgacgtttttgctcatgaagactttagacctccatctgtttcaaattaacgcgctttctgagaaattatgtaccaagtgttatagtatctttatgacaaaaggcacatcaaaggaccgcttattgaaagatcgaaataagcgggtaaatgacaccagccacggcaataatggcaatgacaacggcgatgactttttgtaaagtttggccggggtcttttttaacaggaggatcaaccagctgttttttttcagccttgaaccggtcgtgtatttcttgatccagcgtatgtttttttggttttgacatgataggctatattatattataaaatgactaatattaataggtggttctagaaagccagaacatgcttagctgaaaaggagtttgctttttgaaactaagagagcatttggcattacataaatatgttaaactggcgaaacaagttatcgcaaaacgggatatttatcgcgcgatgtcggataaggaactgaaggcgcagaccctgcattttcgtgaagccttgaaatccggaaaatcgttggccagcattatggtgccggcctttgcggttgtccgcgaggcagatcggcgggtgctggggatggagcccttttatgaacaagtcttaggcgcactcgctatgcaatttggcaatgtggcagaaatgaaaacgggggaaggtaagacgctgacggcgacgatgccgatgtacctcaacggcttggcgggtccggggacttttttgattacggccaatgcttatttggcaaatcgtgatgctgaagatatgggccgcgtctatcggtggctcggtgtttcagtaacggccggcgtttccaaagaaggccaggaagatgaagatcgggatgtcgatgatatttatcagcacgacattgtgtacaccaccaacagtacgctgggctttgattatttattagacaacctgtccggccctgaaaagccgaagtatttaacgcattttcgctttgcgttacttgatgaaattgatgcggtcttgctggatatggcccaaacgccgctggtgatttccggcgcgccacgcgttcagtcgaattatttcctgttggcggccgaagtgatcccattgttacaagctgaccgtgactatgtgctcagtgacgataagaaaaaggtttggtttactgaggccggcatcgcgttgctggaagtttattttggcgttgaccatttgttgtcggctaaatggcgggatttataccgacacttggtgttagctttgaaagcccagtttttattcattcgtaatcgcgattatgtggttgttgatcatgaggtaaaattgctggatatcaccaacgggcgcgagttgcaggggatgcgcctggaagccggccagcatcaggcgatcgaggctaaagagcacctgccgatttcggaccagacccgctcaatggcgtcaatcacgtaccagaatctgtttcgcatgtttacccatttgtgtggcatgacaggaacagcaaaaacagacgcggccgagtttcgtgagtcgtaccatttggacgtggtcattattcccacgcataaaccgaatattcgccaagacaagccggatcgtcttttcctcgatacggaacataaaatttatgcctctgttgacatggtgaaacaggcttatgcggagaaacgccctgtgctgatcgaaaccggttccgtgaccatgtcgaatctatactcgcgggtattgctaaaagccggcattccgcacaacttgttaaacgcgcgcagtgcttcaaaagaagccatgattgtcaaagaagctggccaaccgggaacgatcaccgtggcgacatcgatggccgggcgcgggaccgatattcatttaggtaaaggcgtggtcgaaaaaggcggcttactcgtcattggcaccgagcgtatggacaatgctcggattgacaatcaactgcggggccgcgctgggcggcaaggcgcgccgggcgaaacggtgttctttgcctcgctggaagaccggatcttgcttgaacatggcccgaattggctgaaaaagtttcggcgaaaataccgcggtcatgctgaaaagctgccgcaacctttaacaggacatcggtttcgtcggctcattaatcatgcacaagcggcttcggaacggtcaggacgggattcacgctttcaaacgttggagttttccgaagtcatgcggattcaacgggagacaatttatcggacgcgtgacgaaatacaggctagtcagaacttagaggcggcagttgacaaactgttgaatcgaacaatcgatgaatttttggcggatcatcatcaactaaatgaagatcaaatgatggactttattttgaatgtcatcagcgcccaactcattacggatagcatgaccattcccgctgtcgagggattgcgaccgcggcagactaaaaaaacggtcaagccctttttgcgtcagctaatggatcaacagttacaggcccaacaccaattgttgccatcgcaggatcagtttgattatttcgaaaaggtgtcactgcttaaggcacttgatacggcgtggatcgagcaggtcgatactttgcagcagttgcgatccacggctaattcgcgcgcatcggcgcaacataatcctttctttgaatatcaaaaagacgcgcgggatgcgtttcaccgcatgactggcgattttgcccagcgtgcggttaaaaacctgatgttatcgaccattcacaagaatcccaatggcagtgttcaagtcggtttcccggaagcttaagggaagttgacagcacgattgccgtgagtagacaggttgtcagtgtgattgccgttttgcagtccgtgaacccgtggttgaggaggcattttttagtgagtaataagcacgacatgttgatccgctcattatggacagcattaattttaggtatcgtggctttgggtcagctggttttattgccaggcacggacattgcttcagctagcgaacaacttaaatcagtgccgtttttgcaactggttgccggtgcgaccggtagtcagttgcagaatgccaccattctatctttaggcatgcggccatatatgaccggcatgattgtgtggcaggccattcaaatgctgtttgatgagcaggtgcagcgctggacgctgcgaaaatccgggattgcccaacggttcatcacgttgttctttgcctttattcaaggttttgaaatggtttatgtgatgcgcagtgccattaagccgatctatctgcccgggttcagttttaattttggtttggtgctggtttggatcattttgattgggggcgcgatgtttaccacctggctggctgatttgaatatggccaaaggggtgggtagctcagtggcgttgattattccttcgctggtattttcactgcctaatgttttaaacagtggtttttatcaacgccgccatccgatttcggaacaggagtacatcattgcgggcatcgttgtgttggtgttcattgtggtgatgacgatcatcaacgaagctgaattacatattccgattgagcggcctttattggaaaacgagttagccaagtcgtatttgccgattcggttattggtggccgggtccatgccgtttatgttttcttcgtctttgttcacgttgccgacttattttgtaaaccaaaccgtcggacccaccagtgagtggcaacgacaaattattaagtggttttcgtataacacgccacaagggatcttttcgtatgcgatggtcatgattttcttgggctacgcatttgggtacatgaacatgcagccgagtaagttggcgaaaaatctcaaggaaagcggcgactacattattgaccaggtgccgggcgaaatgaccaaccgcttcttgctacgccatttttcactcatgtcggtttggggcaattcgattcttgtggtgattgcgattaccccgttgattattgggctcaaatacccacctgtagcgaattattcagtgatgttggggcagattttgatcttagtcaccatcatggacacggtggattcacaaatgcgcgccctttggtataagaatcgttaccaggttatctgacagggaggaaactatgctttatttgctgccgaattggcctcaaacgccaaagctgctggaggaagagtcgatggttaacttggcacacttgtttagtgcccatgatcaaccgtttgaattgctctttttgcggcctgaaccttggctgcgccgaactttaaaagaaaatgatcttctgtctgaacggtggtggtcagtctttgatgcgattcaggacgtaccatttcaagcgggccaaccggttgatctggaagatttgggcatgccggcagatgttgagcggatcttttcgcaaagtcaggtgacgctcaatcggcaggatgagttgtatgctgtgatcaagacatttaagaccggttttattctgagcgttgaatttcctgaagggaaaatcggtaaagaagagcgagtttatgatgatcgcggtttttggagctatagtcggttttttgatgctcaaggcaaggtcattcggcgcgtttggtatgacttaaccgggagcattgtgatgaccgaagaagcatccggtcaagtcacgattggcacacaagcagcacgccgattcaagcagcaccaatatgcgaacctggatcaggttattttggaaaaactgaaccagcatttagccatggcagccgatccgcatatcgttgccatggcagggatggcgcaacccatgttaaaagccattatggcaggttatccagtgaccatgttggtggaagaacatctagccaggcaggaacggcaatctgtccgggcggtggcggaacaggcaacggagattatttcgccgaccgatcactatgccgaacaattaaagaaacaactcggcaccggtgctgaccaaaagattcaggtcatcccgccttacgctaccacgctggctttaggggtcagcaatgaaaccgatcaaacgaacgtgatgtggtatgtcaatcagctcaatgccgaacgtttggcagtcgttttcccgcagttattggctatgttgagccaggagaatcggcggcgattggttgtggttgctgacaatgatgatcaagtggcgcatctgcaacaactggccattaactttttcgcgaatctccaaggcattagtcctgactcaggcatatttgctgaaattaccaaggcgatccaaaagtggcaggacgaccaagcgcatgctggcgacaatgtgacggttgaaaatgcccaaatgccgctgccaccggcgcaaaccgattcggaagcggatcgagctgctaatcaaaaaaccctcaagattcagcaaacggcttttcaggttttccaaatgttgacgcatcttcattacgcagtcgatccggaagtcggtcagttgaagcaatggctgcatagcagtcggttattagttgatttaggcgatcaacctaatttgttgctgcagattggcgccatcagtgtggcaattccgcagattaatcggcatgagaccggttatgtccaagatggcgttaacggccgcatcatcgatcaggatcgcgcgttggctgacgcactatctggttatttggatcaattgtccgcttggaatcgcacagtggtggcgaatgtcaaattgatcgatcagcatgatgatgaccagttgatgcgcttatggaagaaggttttgactcatggcagataatgcttatcccgttttacagctagggacgcaggcaataccattgcaggaacatctcacgaaggactttgcttttgagtttatttcaaacgctgcctttaatactgcgccgaccccgccagcgactcagccggacaaaagcgattcggaaggtgaaccagaggaaaaaaccgaccagctacccatttcgttgtggcagaatgcagacatgacacggttacgtcgcgaatatgcgacagcgttgttcatcattacagaaggcgcagccgtgttaaagcaacccgaccaactgatcggcctgcctgccaataccattatgtatgatgaaacgttatcgttaacaccggaaatcattcacattttggatttaaaacaagctcacccaatttcgttagatcatttagaccaattaggcgaacagatcgttttattcttttatccggcgcagtggggcattcgggtaccttttggccgtatcgaaattgccgatggcttttccggaagtgttatgcagcaaggcagtgtcggggtgacgttaaaaggcgattttggccgcgacttgcaaccggctgtttattggcgcggctcactagggattgggcaaatggaagccattgccatttcaattgaatgtgagaccgttggggatgtcgaagtctgggccaaactgcaaatggtgaacccgcaaaactttcagatcgcccaaaagaaactcattccactatcggcatttcgtgatgatacgatcttagacacgaaagccgggttccggtttgtcaacatcaccttgatggccaaaggcagtggaacggtcaaaatcaggcaggttcacttacggcgcagtcgcggcagttatggcacgatgtttatcggtggcaaacggttgaaagctgttaagccattggatggtgagctgttgagttactttgacgccggtgatttgaagccgccactgtcggtttacttttccggttatcggtcggctgaagggtttgaaggtaacttcatgatgaaagcgatgcgtaatcccttcttgctgttcagcgatgcgcggttggaagggggagccttttatcttggtgatccgcagcttgagaatcaggttgttgaaatgattcaggcgaccttgaagcgtttgggttttcgaccggatcagttgattctgtccgggttgtcgatgggcacgcttggggcgttatattatggcgccaagttagatccacgggcgattctggttggtaaaccgctgattaatctagggacaattgccgagaatggccgggtgcggcgcagcgccgattttgcgactgcttttgatatgctaatgatgtttaatggcagcgctactcatgaaagcgccaaaaaaattaaccaacgcatttggcaaacgatttctggcggtaagtttgatcacacgctttttgcgattgcccatatgctggatgacgattacgaacatcatgcgtttgatgaaatcgttaagtggctgaatcgccgccagcagcataatcgagtgttgcatatcgggctgcacggccggcataacgacaataccaacgaggtgaatgcctggttcctgcggcaatatcatatgattttaacgcaggaatttggacgctcattctagggaaaagaggcaacaatggagactgcttatttgtttttctggcgccggatgctggatacgacctttaactatggtgcgcaggtgacatacatggcagatggtaccgtccaattcgaagcacccatgatgccaccgggtaaaaccattcacgcgtggacgactactaaagactttgaacataatctgcaactggcagaattgccggttttaacgcctggagaaacttatgcgctggctctcaactgggaagtgaaggaggacagtgtcttttgccagattgtctttaccgacgcttccgggttggaagtcggatcggaagtgttggaggatggcaaaggtacttttacttttccacttacagcgtatgcatatgaaattcgcttaaaaaatatgcgccatgaacaggtcgtttttcattatggtatgattatcccagtatctgtttataaccattttgatatagcggtgaatttaaaccatgcgttggtgacttttcgtgcgcgtaagcaaaccgatgaaccgcaagttttggggataacagagcgcagcagcctgaccaagccgttatggttgccgcaagcagcgcgaacgatttttgtggtagctgccaatgctaaacaattgcttgatccgcagtggtgccaggagacggctgcatttttaaaagctgaattcgatccggcatttggttcgttaaccgttgcataccaggttggccgccatctcggtcacttgcgacaggcattacgagcggcattttccaaaaaaattgaaaagtgaaggggtaaaggtaaatgatttttttcatgaatcgggccatgggcattggcaattccggtgtcgagcatgccgaattttatcgtgccaagttatttgaccggttaggcatcgactaccggtttgtcatgttggacgtggtgcgcgaactacgcgaggcaatggcaaaatggcagattaaaaatcgcaaaatgattaatatttgggaatattttacatttggcgacgattatctgcgtcatggcattgaagatttgatcaccccaaaggatcatactttgatcgatgggacgaatacatatcggattcaggagtacatcacgagtggtggcctacggatcgtcaatcacttggttaagtatcccgacaaacacaaaaagagtaatgtcctgctcgtcagtaccgggcgcaccgaaatcttcaaccagcgcactggcgaaaaacgggtgatgttctcttacgttgacgatcagcatcgcgggatgttgatgaaagacatccatctctataaccaaaacggtcagcatcttttcttcgccaatgaagtgttgatgattcgttatttcatgaataagcttaacgacttctttgggcataacagcaccttcatcattgatcgtggtgaaggggtcgagatggcgatcgactatcaccgcccagttggcagtcacattgtcaatatcgttcacgctgatcatctgtctgatcgggatgatccggagaatccattgtggaacaaccactacgaatacctgttaacccggctgaatcgggtcgatcgcgtggtcgtcgcaaccaaactacaacgggaggatctcatccatgattttcctcagtatgcgaaaaagtttgtcgcgattccggttggcggtgtgcgtgatcagaagacagcaccggttaaaacagccttgggtgatccgattcgcttaattacggcttctcgacttgcctctgaaaaacatattgacttgattatccgagcagttgcggctctgaacaaagacggtgttcactacacgcttgatatttatggcggtggtggtgaagagatgaagctgaatcagttgattgataaactacatgccggtgattatgtcaagatgaaaggccagaccaatcaattggataagctttatcctaaatacgatgcattcgtgtcggcctcgttctctgaagggtttggtttaacatacattgaatcgctgaatgccggcctgcccgtcgtgacttacaaggcgcgttttggcgccatggaattaatcaaggacaatgtcaacggctttttgcaggacttcaagcgggatgatacccagtacaatgtcaatcaaatggtgacgggtctgaagcgcttgaaagcagcagattaccagaaactgtgcggtcagacgtttagctcggtcgcagcctttcaggatcaccgaattgcaggggaatggaggaagatgctcgatgaactatgaaattgtcaatcagctggaagccggccaacctggctgggatgcccacaaggcagtacttaagcaaaccaatacccagttgctagtcttgggcccgctgcccggtttctatgggttcttaaaagatgaacacctccaaggcgtggatttaattgacacgattacccaacgacgttacatcgatcacaagtatatgttttttgacaaagcaccggttcctgagggcacggcggtttacatgaacgaagatggtaccatttcgcttatcagtgaaggcgaaacgattggctcgatggtgacctatgccggtacgcgccgggcagttaaagagttgcgctaccagtacttagatggtactaaggacttgattgaggaatattcgtttgatggcaatcattacagcaatcttttttactataatgacgatattcaggagattcagtttttaaatcgcgatggaaaagtcgtgattcgggaatttttctatgaaggtgcgatcaaccttattaccgttgaggatcctttgagtgggcatgaactgcgtcgttatgacgacattgaggcttttcgtgaaggcgaaatcgcgcgctttctgaaaccggaggacacggccataacccgttacatgggattggaaatgacggcactgcgacatgcaaagtcgcataacgttttacgactgtcggaatcgccttttgacgagaattccgaagtgcgtggcaatttaatggctattttgaccaacgatattgcttatattcacgaggtacaaatggatcaggcaagttacaatgcattagcactgagagatgtgccgctagacaaggccaaagtggtcacggaagcgcggtaacattgtcaaaaaataatctgtgagaccgatcaatttacaacccaggcgctcagatcaaaaaagcgatctaagcgtctttttgttgtgtaaaatattatcgtgagctattgctgaggattaaaaacagctccttatcacgaatgcgtagaagcgaagaagcaggattgtctgacatttgttaacccctttaacaacgaaagtatagctaaaaggaatcttgagtacgattttaaggcttaaaaatgccgtttcaagaaagcggttacaattttttaaaatttgaagttcataaataccgccatctctaaggtgttggtagatcagtggttgtgactgatatcgacaattttgaataacggcgaatcgattaaaatattgatattaatttaaataaaaatcgttattttgaaaaattatatgttacactacaaacgtatgctgaaatcatgaaggaataacctaagaatgatgaatcaggagggaatgggcgattaatgagtagattaaatcctcaaagacagaagcggctttttgaaacgaacagtaaaagccgttttagaatgtataaagccggcaagcaatggttggttgccggtatcgccacattaagcggcttatttggtatgggggccgtcgccagttcgccggtgcacgcaagtacatcgaacacggctggtgtcggcaaagaagccgggaaacaggatgtgctggcgactcaaaatcaagcgaccattcctgcgagttccaacacaacatcgcaatcaacttcggaaagtacttctaccagtgcgtccgagagcgtctcggcatcgcagtcggttagtgctagcgattcaaagagcacttctgactcaaccaaaaacagccagagcacctcgaccagcagctctattagtgcggccagcgcgtcagtaagtgaatccatctccaagtctgaaagcgcagcgaagagtggctccaccactgaatcgcaaagcaataagaccacacaatcagaaagccagaagaagtcagagagtacctcgaatcagccagcttcgaaggaaacatcggttagtgtatctgaaagcacttcgacgagcacgaacccatcaaagcaggcttcgacaagctcatctgaaagcacaacaggcaagcagagcaccagtacctctgaaagccaatctttgagtacttctcagagcacgtcacttagcatttccgagcaatcgttaagcgacttagctgccaagactggtgagctagcaacaactgatattaacaagctcaccgctatgatggcgcaggccaagacggcagctgctgatagtgaattcaccatcacggatcaaaaagactttaagagtggtgagtctgctgccgagtctgatcttaagtccattatcaagaatattgacctcaaagggtttggggttgcctttaacattggcaatgttaaggctgccgttaatcaactggctgctttgatcgatgactatattaagaatccaacgctttataccaacacgacgattactgatagtaaaactggcaccaatgcttatgacccaatttggaaaccggataaccgcaatggcagtgactggccggctgcagacaattggttagatctttccacttatggtcacggttataaagtcaacagttcattaccttcatttaacgctggttatgtaacctaccttcgttcatacgcaaaaggcattttggatgatttaactgctgtcaagaaccaatcaacgaacccggacgcagccaattctttaatcaacaacactacttatcgttcaggggacttaagtggttcttcactgggcggcgttattgcaaatggactaagctttatctggaattcattctggaataactataacgttccaaaagtgctgcaagtatatactgattcaagtgttgcggcatcaaatgtcaatacaactgttggatacctcaataacttagttggcctggttgccccttatatcatcaacggaatcgctcatcaggctttgtctgatattcgatcaattggcaatgccaaaatgggagcagatggcaagattgactatgctcctgataagtttaccgatgccgttgctctgaatggcaatattaagagttttctcggactggttggcctggatggggttattagtagtaccctcatgcagcgtatttatgattcaattaaaaccgttgctcaacaagccatcatgaacaactgggcaactggtgagtataaagccctgcagaacctgatgaacaatggtatctatgatgacggctcaaatacgtataaggccactggctatgacgttaataatccagccgctgtcaccaatagtaatcaggccaatttaagtgacacgacccaagctgctgcttatgcatgggcgatgaaagtcttcacgcctttgcttcaaaaagcagcttccgatgcttggagcggcagtccagctgacaatattgatgaactgattgattcattgagtgtctccgacgctgacaaggctctactgaagaccgataatgcacaaaacacggcgtccggccttaagaattatgctcgtagcgctgaaggcgcccgcgagatgatccagcagatctactccaaagaatatcaggcggttgctaaagcactgtatgactttagaaccgatccaacatatacggacgctcagctagcacaacggcaaaaagatgcggatcttaattttgaaccagtgggtgatcctgcactcaatggtggcggcggtacagcgacgacgctcgaagcgaatgattacaccaggacttatcagttcttacgtgacgccatgtatcaaggccaagccaacgctgatatcaagtctcattcacaaaaagacggtaaagttgatcctctcaagccagatccaactgagtttacagcacagaagagcattttaagctcgaccttgacaccgttggtcgatgatttgaccaactttgctcggccttactattcttacgcttatcaagtagaagcaattcgcgccaataatgcgtttgctgctgggttggcaaaagcacatgaggaaattgctgcgaacccagcgatgcctgtgccagatgcaggcgatgccggaaagatcacggttgatggccaggattacagtgctaaagacgatactactgcatcgatctataccacggtagcaagtgctgttaataaaaacgcaccggctgcaggccaagccttcactgatggttatcagtcaattttgaccgaagttaccgtcacactgcaggcaaaatcaggtgaaactggttttcctgatgccaagacttatacggtttgggcaccaactgaccaattaaccaacattggagcaccaactgtcaaaggttggattcctgaaccagtaaatgctgccaacacctttacaggtaaaactgggcaaattacgtttacctatcacaagggtgccagcattgataacatcagcattaccaacccaactgattcgcgtcagtacaacggtgaacttttaaattatcctgatattgatccaactatcacgattacttggaatgatgggacgaccacgacaacccagtcactcaaattctcctctatttctggatttgctggggatatgcacgaatactttaactttgcctataccagtgatgaaggcaaatggactattcaactcaatcaaaatggtgcagatgcagtcttaagctggattaaaaatcagcttaaatatgacggcacttcatttgaggtacctgattccgcccttgatttattaccacagcaattcacttatagcatcaccaagcaagttgctgttaccagcaagaagaatgtcaactatattattggtaatgacctcccgacagctaaagacctttatgattatgtcgttgtcaatggtgttaagtacgacgccagccaggttaagtggaatgctgacggtagcaagggcacgattgatggcgtcggtaccatcactctgaactggaataagaccaaagatgatttgcaaaccgctggaacgtataccgatgccgctgatcttcagctgacattgcaggatggcacagttgctaaagatgctgtgaacgtcatcagctcgtcagcgaaacacgatgtgactgttaacaataatcgtacgattgtttatgttattggtggcgacaaacctactgctaaagaggctatgaatggatccggcgcctacattgaagttgacggcacgaagtatacgaccgatgacatcaagtggagtagcgatggtaacaccggtaccattaccactaaggatggcaagaccatcaccgttaccttggaatggtctaagggtaccgaagatgctattgaaaccgctggattgcattcaaatgcggctaatgttgaggtaacgctatccgataaatacacagcagcaggtgcgttaaacgtctattcgaccactaatgcgtccacagatgcgcaagtcgatagtaaaaagaatatcggctacaccattgggcatgaccttccgactgcaaaggacgcctttgatgccgttgttgttaatggcgttgtttacacggctgatcaggttacctggaataatgacggcaccgggacgattgacggcgttggtaccttcacgattgattggtccgatgacgctcagaagacccttcaaacagaaggcatgcataaaaatgccggcacgttagtcttcacccgtcagtcagacaagaaacaatttactgacagcttcaacgtttattcagcaccggactattctaaacagtcaacgagtgcttctgaatctacatcaatgtctgactctgaacggacttcgacttctgcctctgcaagcacctcgacaagtacgtctgcttcattgtccgccagcgagtcagcaaccgaatcgaattcaatttcacaaagtacatctaagatccaatcagaatccgtttctgcatcagattcaaagagacagtcggagtctgcccaatcgagccaatcaaccagtgagtcaacttcagtctcaatgagtgaatcgagccgggcagatacctcaaactcggcaagcacttcaacaagtctgtcagcttcgacatctgcgaaggaatccacgacaaagagtacgtccaaagatgtttctgagtcggattcagcaagtcattcgacaagcatgtcaacttccacctcgtcaagtgagtcgagtcgggcatctcagtccgaatcggccagtttgtcgggcagtgtttctgcttctgagtcggcaagtacctctgacaaagattcaaccagtgcttcaacaagcgaatcacaatatgaaagcacatcgtcgattgcaagcggttctgatcgtaagtcggcttcaacatcggccagcgtttcgacatcggcttcagcttctggttccacgagtgaatcggatgttaagtcagagtctaactctgctagtgagagtctctcagcttcagaaagtgactcgcgcaatggcaacaacagcggtgcaagcatttcgcagtcggcaagcacgtcagcaagtacgtcagtttcagtttcgacgagtgaatccacacgcagttctgaatctgtttcaaagagcgattctcagcgtgatgccacctctaagtctgcagataactcaaagacagcttccgaaagcggctcagttagcgcttcaacttcggcatctaagagtttgtcagagcgtcgtgacgagtctaagtctgcatcaacatcaacatcactttccgcatcgacttcaactcgtgaatcaaattctgcttcggcaagtaattcggccagtcaatctgcttcgacatctacgaaggcttcgaccagtgagtcgcagtctagttcgacgagtaattctaaacaaaattcaacatccacatcggcatcggcatctgaagagcaatcgacttctgacaacaagaatgcatcagtcagcgagtcgaactcaacttcgaccagtgagtccgaacaggcgtccacttcggcctcagcttcaacctcgacaagtaagtcaaaggcagattcgacgagtgaatcaaccagtcggtcaaaagaaggctctggcagcaccaacaaagatacttccgcatccacttcggcaagcctgtcaactagcacgtcggattcagcttccaccagtgcttcaggccatgcttcgacatccacgtcattgagtgtttccgaaagtacttcggcatcacagtcggcgagtgcttccaagcgtgattcacagagtacttcgaccagtgcttcgacacagacgtcacagtcagcttcaaccagtgactctgaccgtgattcaacttccacatcggctaatgattccacgagtgcatcgaagtcagagtctacaagccagtctgatcgggcatctaagtccgattcagccagcgattcgacctcgacttccgagagcaagggtgccggcagtgaaagcaccgctagtcagtcaacttcggtaagcacttcgaccagcgactctgcttctaaatcagacagtgaatctaaaaaggcgtccaactcagcttcgatgagtgaatcgaaacaagcttcgacgtctagttcaacgagcacttcgaaatcggattccacatcaacttctaagcgcgaatcgaccagtgcttccacatccacagcagatagcacgtcagcgcggcaatctgaatcgaattcggtaagcacatcacaatcggattctgcctcgaagtcgaccagcgagtccaagcagacatctacaagtcaatctgactcaacctcaaccagttactctgaatcgacatcgaagtccaagtcagaaatccattcaagttccgattcggcaagcaattcgacaagtcaatcagcttcaacgtcaacgaaggcttcgaccagtgagtcgcagtctagttcaacgagcgattctgaacaaaattcgacatccgcttcggcttcgacatctgaaaaacagtcgacttctgacaataagaatgcttcggtcagtgagtcgaattcaacgtcgactagtgagtccgaacaggcgtcaacttcggcatcgacttcaacatcgacaagtaagtcgcagtcacagtcgacgagtgaatcaaccagtcgatcaaaagaaggctctggcagcaccagcaaggatacttccgaatccacttcggcgagtctatcgacgagcacctctgattcagcttccacgagtgcttcagaccatgcttcgacatccacgtcgctgagtgtttcagaaagtacttcggcatcgcagtcggcaagtgcttccaagcgtgactctcaaagtgcttcctccagtgaatcagcacggacatcacaatcagcttcaaccagtgactctgaccgcgattctgcttccacatcgactaacgattccacgagtgcatcgaagtcagcatcaacgagtcagtcagatcaggcatccaagtctgattcagcaagcgactcaacctcaacttctgagagcaagggcgctggcagtgaaagcacggctagtcaatccacgtcggtaagtacctcaaccagtcaatctgcttcaacttcagacagtgaagagaacaagaactctaaatcgacatccactagcgaatcgaggcaggcgtcaacgtcagcttccacaagcacctcgaagtcggattccacatcaacttctaagcgcgagtcgaccagcgcttcagcatctgaagcagatagcacatcaacgcgtcactctgaatcgaattcagtaagcacatcacaatccgattcagcttcgaaatcaacaagcgaatcgaaacagacttctaagcatcaatcagaatcaacttcatcgagctactctaactctacttccaagtcccagtcagcaatccattcaaactctgattcggcaagcaagtcggccagtcaatcagcttcgacttctaccaaggcttcgaccagcgagtcgcagtctagttcgacgagcaattcagagcaaaactcgacatccacttcggcgtccgtatctgaagaacaatcgacttccgacaataagaacgcatcggtcagtgaatcgaattcaacctcgaccagcgagtctgaacaggcttcaacttctgcatcggcttcgacatcaacgagtaagtcaaaggcagattcgacgagtgaatcaaccagtcggtcaaaagaaggctctggcagcaccaacaaagatacttccgcatccacttcggcaagcctgtcaactagcacgtcgaattcagcttccacgagtgcttcagaccatgcttcggcatccacatcaatgagcatttcggagagcacttcagcttcgaactcagccagtgcttctaagcatggttcacagagtgcttcgaccagtgaatcagcgcggacctcacagtcagcctcgaccagtgactctgaccacaattctgcctctacatcggctaatgcttctaacagtgcatcgaagtcagcctcgaccagccagtctgatcaggcttctaagtccgattcggctagtgactcgacgtctacttccgagagcaagggtgctggcagcgaaagcactgctagtcaatctacatcggtaagcacctcgactagtcaatcagcttcaacttcagacagtgaagctgacaagaactctaaatcaacgtcaactagcgaatcgaagcaggcttctgagtcagtttcgacgagtgagtcgaagtctgattcaaagtcaacgtctaatcgtgaatcaacaagtgcttccgtatctgaagcagacagtacatcgacacgtcattctgaatcagattcagcaagtgcatcgcaatcggattcgacctcgaagtcatacagtgagtcgaaacggacgtctaccagtcagtcagactcgacttcgacgagctattctgagtcaacttcaaagtccaagtcagaaattcattcaagttctgactcggcaagcaagtcagcaagtcaatcagcttcaacgtcaactaaggcttcgaccagtgagtcgcagtctagttcgacgagcaattctgagcgaaactcagcatcggcatcagcttcaacttctgaacagaagtcgacttctgacgacaataacgcatcgatcagtgagtcgaactcaacatcgaccagtgaatccgaacaggcgtcaacgtcagcctcaacttcgacatcgacaagcaaatcgaaggcagattcgacgagtgaatcaaccagtcggtcaaaagaaggctccggcagcaccagcaaggatatttctgaatccacttcggcgagtctatcgactagcacctctaattcagcttccactagtgcttcagatcatgcttcggcatccacatcaatgagtatttcggagagtacgtcagcttcgaactcagccagtgcttccaagcatgactcacaaagtgcttctaccagtgaatcagcacggacctcacagtcagcctcgaccagtgactctgaacacaattcagcttccacatcgactaacgattccacgagtgcatcgaagtcagcatcaacgagccagtctgatcgggcttctaagtctgattcggctagcgactcaacctcgacttctgagagcaagggtgctggcagtgaaagtactgctagtcaatccacatcggtaagcacctcgaccagccaatctgcttcaacttcagacagtgaagagaacaagaactctaagtcgacatccactagcgaatcgaagcaggcgtcagcgtcagcttcaacaagtacctcgaagtcggattccacatcgacttctaagcgtgaatcaactagtgcttccgcatctgaagcagacagcacgtcaacgcgtcactctgaatcgaattcggtaagcacatcacaatccgattcagcttcgaagtctaatagtgaatccaagcagacgtctaccagtcaatcagactcaacctcaacgagccactcagactctacttcgaagtctaagtcaggaacccagtcgagttctgactcggcaagtaagtcggctagccagtcagcatcgacatctactagtcaatcaacgagtgaatcgcaatcaacctctaagcacacttcagagaacggttcagcttctgattcaacctctgaatcaacttctactagcgcatcagaacatgctagcgaatcggtaagtgcttcgacgtcggcttccaagagcacaactggcgcagcttcggcttcaacgtcggcaagcaattcgacaagcaagtcaatttcaaattcacggagcgaatcggccagtcgctcgaatcaaaactcagaaagtatctccaaggaacgctcacaatcagcttcagccagcttgtctgacagtagctcgaagtcagcttcgaccagcacgtctgatcatgctccaacttctggctccatgagtgcttcgactagctcttctgaatctcagtcggctagtgagtcaagtcaggattcgaaagcagcttccaccagtgcatccgaacgcgattcgcgttcagcttcaacgagtgattccgaacgcaattcggcatcagtatcggcaagtgattcaacgaatgcttctaagtcagcttcaacgagccagtctgatcgggcttccaagtctgattcggccagcgactcgacctcgacttccgaaagcaagggtgctggcagtgaaagcacggctagtcagtcgacttcagtaagcacctcgaccagtcagtcagcttcaacttcagatagtgaagaaaacaagaactcgaaatcaacttcaaccagcgaatcgaagcaagcttcggcgtcaacttcaacaagcgaatcgaagtctgattcaaagtcaacgtctaatcgtgaatcaacgagtgcttccgtatctgaagcagacagtacatcgacacgtcattctgagtcgaattcggtaagcacgtcacaatcagattcaacctcgaagtcgtatagcgaatctaaacagacttctaccagtcaatccgactcgacctcgaccagttactctgaatcaacttcacagagccaagcctctgaaagcaggtccgaatctgtctcaggcagtcagtcagcatcaacctcaacgtctgcatcggcaaacgagtcgaattctgaatcagcaagcaagtcagcaagtcaatcagcttcgacctctaccaaggcttcgaccagtgagtcgcagtctagttcgacgagcaattctgaacaaaattcagcatcggcatcgacttcaacttctgaaaagcagtcaacttctgatgacaataacgcctcagtcagtgaatcgaattcaacatcgactagtgagtccgaacaggcatcgacttcggcatcagcttcaacatcgacgagtaagtcgcagtcacagtcaacgagtgaatcaaccagtcggtcaaaagaaggctccggtagcaccagcaaagatagttccgagtccacttcagcaagtctatcgaccagcacctctgattcagcttccaccagtgcttcagatcatgcttcaacatccacatcactgagtgtttcggggagcacgtcaacatcacagtcggcgagtgcttccaagcatgattcacagagtgcttcgatcagtgaatcagcgcggacatcacagtcagcttcgaccagtaactctgaccgcgattcaacctcaacatcggctaatgattctactagtgcatcgaaatcagcatcaacgagtcagtctgatcaggcttccaagtctgattcggccagcacctcggcttcgaagtcaaccagtcgatcaatggaaagtggcagcgatgcaagtgcttctgaatcgaccagcacttctactagtcaatcaacctccacttcaacgagtgaatcgaagcaagcctcgacttctacttctaagagtgtttccgagcaaaattctgaatcagtttcgaccagcacttcaaagtcagattccacatcaacttctaagcgcgaatcgaccagtgcttcaacatccgaatcagatagcacgtcaacgcgtcattctgaatcgaattcggtaagcacatcgcaatctgattcaacctcgaagtcgtacagtgaatccaatcagacttcaacgagtcaatcagattcaacctcaacgagttactccgaatcgacttcgaagtccaagtcagagattcactcaagttctgattcggcaagtaagtcagacaatcaatctacttcgacttcgaccagtcagtctatcagtgaatcaaagtcgagctggaatagtaactccacacaaaactctgtatcagcttcggcatcttattctgaagagaaatcgacttctgataataagaatgcttcggtcagcgagtcgaattcaacgtctactagcgaatccgaacaggcttcaacttcagcctcggcttcaacatcgacaagtaaatcacggtcacagtcgaccagtgaatcaacgagtcggtcaaaggaaggctccggcagcaccagcaaggatacttccgaatccacttcggcgagtctatcgacgagcacctctgattcagcttccacgagtgcttcagaccatgcttcggcatccacatcaatgagtatttcggagagtacgtcagcttcgaactcagccagtgcttccaagcatgattcacagaacgcttctacaagcgcttcgacgcggacatcacagtcggcatcgacgagtgattccgaacgcaattcggcttcggtatcggcaagtgattcaacaaatgcttccaagtcagcgtcaacgagtcagtctgatcgggcatccaagtctgattcggcaagcgattcgacctcgacttccgagagcaagggtgctggcagtgaaagcaccgctagtcagtcgacttcagtaagtacctcaaccagtcaatccgcttcgacttctgacagtgaagcggatagccactcgaagtcagactcgaccagtgaatcgaaacaggcctcaacgtcagtttcaacaagcacctcgaaatcggattccacatcaacttctaagcgcgactcgaccagtgcttcaacatccgagtcggatagtacgtcaacacgtcattctgaatcgaattcggtaagcacatcgcaatctgattcaacctcgaagtcatacagtgagtccaagcagacgtctaccagtcagtccggttcaacctcaacgagccactccgaatcgacttcgaagtccaagtcagagattcactcaagttctgattcggcaagtaagtcaaacaatcaatctacttctacttcgaccagccagtctatcagtgaatccaagtcgaggtggaacagtagctccaagcaaaactcggtatcggcctcgaattcagcgtctgaggagcagtcaacttctgacaataagagcgcttcagccagcgaatcgaactcgacttcgacgagcgagtccgaacaggcgtcaacttccgcatcagcttcgacctcgacgagtaagtcacagtcagattcgaccagtgaatcaaccagtcggtcaaaggagggctctggcagcaccagcaaggatacttctgaatccacttcggcaagtctgtcaaccagcacctctgattcagcttccacgagtgcttcaaatcatgcttcggcatccacatcaatgagtatttcggagagcacttcagcttcgaactcagcaagtaatgccaagcatgactcacaaagtgcttcgaccagtgaatcagcgcggacatcacagtcggcttcgacgagtgattccgaacacaattcggcatcagtatcggcaagtgattcaacgaatgcttccaagtcagcgtcaaccagtcagtctgatcgggcatccaagtctgattcggctagcgattcgacctcgacttccgaaagcaagggcgctggcagtgaaagcacggctagtcaatccacgtcggtaagtacctcgaccagtcaatctgcttcaacttcagacagtgaagagaacaagaactccaagtcgacatccactagcgaatcgaagcaggcgtcagtgtcagcttccacaagcacctcgaagtcggattccacatcaacttctaagcgcgagtcgaccagcgcttcagcatctgaagcagatagcacatcaatgcgtcactctgaatcgaattcagtaagcacatcacaatccgattcaacctcgaagtcgtacagcgagtccaaccagacgtctacaagtcaatcgggttcaacatcgaccagtcactctgaatcgacttcgaagtcccagtcggaaattcattcaagttctgattcggcaagcaagtcggctagtcagtcagcttcaatgtccacaagtcagtctaagagtgagtcgcaatcaacttctaagcacaagtcagataatggctcggcttccgattcagtttcggagtcaatttcaacaagcgcttcggcacataccagtgaatcagtaagtgcctcgacatcggcttccaagagtacgactggcgcagattcggcttcaacgtcggcgagtgattctacaagcaagtcaatttcaaactcacagagcgaatcagcaagtcgctcgaatcaaagttcagaaagcatctctaaggaacgctcacaatcagcttcagccagcctgtctgacagcagctccaagtcagcttcaaccagcacgtctgatcatgcttcgacttcaggttccttgagtacttcaaccaacacttctgaatcacgatcagccagtgagtcaagtcaggattcaaaagcagcttccactagtgcttctgaacgcgattcgcaatcagcttcaacgagtgattccgaacgcaattcggcatcggtatcggcgagtgattcaacgaatgtttccaagtcagcatcaacgagccagtcagatcgggcatccaagtctgattcggctagcgactcggcctcgatttccgaaagcaagggtgctggcagtgaaagcaccgctagtcagtccacgtcggtaagtacctcgaccagtcaatcagcttcaacttcagacagtgaggagaacaagaactctaagtcgacatccactagcgaatcgaggcaggcgtcaacgtcagcttccacaagcacttcgaagtcggattccacatcaacttctaagcgtgagtcgaccagtgcttccacgtccgaatcagacagtacgtcaacgtgtcactctgaatcgaattcggtaagcacatcgcactctgattcaacctcgaagtcgtacagtgaatccaagcagacctccacaagccagtcagattcaacttccaagagtcaatccgaatcaacctcacaaagccaagcttctgagagtaagtctgaatccgtctccggcagtcagtctgaatcaacttcgaagtccaagtcagcgacccagtcaagttctgaatcggcaagtaattcggccaatcaatctacttcaacttctaccagtcagtcgatgagtgaatcacaatcgacttcgaacagttattccaagcaaaactcggtatcgacgtcaacttcaacttctgaaaagcagtcaacttctaacaacgcgagtgcttctgtcagtgaatcgaattcaacgtcaactagcgagtctgaacaggcttcaacttcagcctcagcttcggcgtccacgagtaagtcgcaatcgcagtcgacaagcgagtcaacgagtcggtcgaaggaaggctccggtagcaccagcaaagatagttccgagtccacttcagcaagtctatcgaccagcacctctgattcagcttccacgagtgcttcagaccatgcttcggcatccacatcaatgagtatttcggagagtacgtcagcttcgaactcagcgagtgcttccaagcatgactcacaaagtgcttcgaccagcgagtcagcgcggacatcacagtcggcttcgacaagtgactctgagcgcaattcagcttctgcctcagccaaagactcgaccagcacttccaagtcagattcaactagccgttccgatcaggcttccaagtctgattcggctagcacctcggcttcgaagtcaaccaggcggtcaatggagagtggcagtgattcgagtcaatctgaatcgaccagcacatcggctagtcaatcaacgtcgacttcaacgagtgaatcaaagcaagcttcgacatctgcttctaagagcgaatcgaagcggaattctgagtcagcttcaacaagcacttccaagtcggattccacatcaacttctaagcgcgaatcgaccagtgcttcagtatccgagtcagacagtacgtcaacacgtcactctgaatcgaattcggtaagtacatcgcaatccgattcaacctcgaagtcttacagcgagtctaatcagacttcaacgagtcaatcagattcaacctcgaccagtcactccgaatcgacttcgaagtccaagtcagagattcactcaagctctgattcggcaagcaagtcggctagtcagtcagtttcaacgtccacaagtcagtccaagagtgagtcgcaatcaacttctaagcacaagtcagataatggctcagcttccgattcagtttcggagtcaatttcaacaagtgcttcggcacataccagtgaatcggtaagtgcatcgacatctgcttccaagagcacaactggcgcagcttcggcttcaacgtcggcaagcacttcgacaagcaagtcaatttcaacttcgcaaagtgaatcgactagtcgatcaaatcaaggttcaggaagcatctctaaggaacgttcacaatcagcttcagccagcttatctgacagtggctcgaagtcagcttcaaccagcacgtctgatcatgcttcgacttctggttccatgagtacttcaaccagcacttctgaatcgcaatcagccagtgaatcaagtcaggattcgaaagcagcttccactagtgcttctgaacgtgattcacgctcggcctcaacgagtgactccgaacatgattctgcttccgcatcggctaatgattccaccagtgcatcgaagtcagcgtcaacgagccagtctgatcaggcatctaagtctgattcggctagtgactcggcctcgatttccgaaagcaagggtgctggcagcgaaagcaccgctagtcagtccacatcggtaagcacctcgactagccagtctgcttcaacttcggacagtgaagcggatagccattcgaagtcaaattcgactagtgaatcgaagcagaattccgagtcagcatcaacgagcacttcgaagtcagattccacatcaacttctaagcgcgaatcgaccagtgcttcaacatccgagtcggacagtacgtcaacgcgtcactctgaatcgaattcggtaagtacctcgcactcagattcaacctcgaaatcttacagtgaatccaagcagacatcgaccagccagtcagattcaacatcgaagagtcaatccgaatcgacctcacagagtcaatcctctgagagcaagtccgaatccgtctctggtagtcggtctgagtcaacgtcgaaatccaagtcagcgactcagtcaagctccgagtcagcaagtaaatcggatagcggttcagtttcaacatctacgagtcattcaattagcgaatctcaatccgtttctaagagtgagtcgcagcacgaatcgcaatcgaattctgcttctaaatctaagagcaactctggttcatcaattaccagcgagtcgatgagtgcttccacatctgcttcgatcagtgactctgaccgcgcatcgacatctgtttcggtaagtgtatcaacaagtcaatcggcttcgacgtcagcaagtgagtcgactccgaacagcacctctaaagatgcctctgcatcaacttctgcaagtgcatccaccagcggttctgcttctacgtcgttaagcgagtcgaatagtgcttcgaagtcggtatccactagtcaatcggagagtacgtcagcatcgtcatcagcgagtgcttccgaccacgattcaaccagtacctcaacgagtgaatcgcagcaggcatcacaatctggctcaacgagcgtttctgatcgtcagtcagcaagtgcatcggcaagcgattctaagagtacttcgatctcaacttcgactagtgaatcggttcgggcttctaagtccgattcggctagtgattcggcttccatttccacgagtaagtcaatggcaagtggtagtgattcgagtcaatctgaatcgaccagcacttctgctagtcaatctgcttcgacttcaaccagtgaatccaagcacgcctctgaatctgattcgaagagtgaatctaagcgtggttctgaatctgcatccgcaagcacatcacgatctgattcaacttcaacatctcatgaggaatcaaagagcgcgtccgcttcgacatcaagaagtgaatctaaacgcaactctggttctgaatcgataagtgcttctaagtctgattcaaccagcacgtctacgagtgaatcagcttcaacgtccacgagttcttctaagagccaatcgacgtctgattccaagcgtcaatcggcatctgattcaactcacgaatcgcagagtgcttcaatgtctggctcaaccagtcagtcactcagcacttcgaagtcagcatctgtcagtgaatccaagcagcagtccgagtctcaggatcgccacgattcagacactgcatcaacatccacttcaacaagtgaatctgagcataattctgaatcgaagtcgtcacatgattcgaacagtaatagcgcctcgcaatccaccagtgaatcgcaaagtgcttcgagttcgacttcaacaagcgaatctgctaatgggtctgcttccacttcagcgagtgaatctagacacaacagcgattcggcttcaaccagcggctcgatcagtgtttcgacttctacttcgacgagtcagtcagagaagacttctaagtctgattcaagcagcaagtcggagagtcagagcgcatcgcagtcgattagcgagtctaagcgggcatcgacatcgacatctgatcaaggttctaagactgaatctgagtcggcatcagcaagcacttctactagccagtcgaattcaacctcagcaagtgaatcgatcagtgcatcggtttcggtttcgcaaagttccaagcagtcaacgtctgactcctctaatcctagccagtcagccagtgcatcggaatccacttccacaagtgaatctcaacgtacctctgcatcaacttcagcaagcacatccgagagtatgagcgcatcaacttcaacgagcggatcaaccagcttctctgaatccgtttcgacaagtgagtcacaacatggttctgcttcggcatcagccagtgattcgactagcgtttcgacatctgattctgcaagtgcatcgaacagtgcagagaagtcgacatctaccagtgaatcgaaggaggcatctgcatctacctcagcaagtctatccattagcggttcgacatcgacttcaacgacagagtcaacgagtgcttcggcttcaacttcaacaagtgagtccgagcatgcatcagcgtctgcctccgcaagtcagtcaacaactaaatcggcttcgacttcaacgagcgaatcgcggcatgcttcacagtcaagttctaacagtgcttcaaccagtacctcaacgtcagaatctgcttcgacatcaaccagtcgttctgaatcaaaggatgacagcgcatcggtaagtgcctcgacatctgcttcgacaagtcaatctgatcagagttcgctttctcattccgattccacaagtgaatccatcagtacttcgacaagcaaatcgaagagcgcttcaacctcagcatcagccagtgtttcgaattcagattcaaccagtcgttcacaatatgaatcgacccatcaatctgaatcagaatcgacaagcagatcgcaacaggcttcaacgtctacttcgatgagtcagtcattgagtacatcggattccgcttcggcaagctcctccaagcgtcagtcagagtctggacaagcaagcatttcaacaagtgcttcgacctcagcctcgacaagcgcatcgggtcaggtttcacaatctgattcttcgaagaactcgaccagcacaagcgtgtcaacatcaacaagtgaatcgcagcatgcatcggcatccacgtcgacgagtgagtctggacgtcattcaacatccgcatctgtaagcgggtcggaaagcgacagccagtcaacctccacaagtgagtccgcgagtgcttctcagtctagttcagaggccggatcaaagactggtgcagcttctgcatcggctagtcaatcggatagtcagtcaacttcaacatcggctagtctgtccggtagcgcctcaatctcgacatcgcaaagtgagtcaacttcgaattcaggttcgacggatcctgagaagtcaaccagtgcttcaacctcgatgtcaaccagtgcttccaaacgtacgtctgaatctgtttcagcaagcacgtcgaagagcacgagtacatcacaatcggcgagtgaatcgacgagcttctcgacatctggttcgattagtgaatcacaacgagatgctacctcggcatcagcgagcgtatcgaccagcgattctgcttcggcttctgcaagtcaatcagcagaagactcagcatctgtttccatgagtgattcgcaacaggcttctgcatcgacttcggccagtgattcaacggttaagtcggcatcgacgtcgacaagtgaatccagacaggcttcacaatcgagttctgacagtgcttcaaccagcaccattaagtctgaatccgcgtcgacttcggatagccagtctggatcggccatggccagtgcttcggttagtgcttcgacatccgcatctaccagtgaatctgctcaaaatgcggcttcggcatcagcatcagaaagcctttctcagagcacttccgagagtacctcgaccagtgcttccgagagcctgtcagtcagtgcttcgacgaatgcgtcaacctctgagtcgtcgtatacgtcaaccagcacgtcggcatccacttcagcaagtgaatcaacgagtgcttctgcatcgacttctgatcaaattgcctcgcagtcatcggcatcacaatctgctagtcagtccaagcaggcatcggcatcgacttccacgagcgaatcaaagcgtgcttcaacatcagcctcgatgagtgattcaaagcgggattcacaatctgaatccagtcacgagtcaagcagcgatagcacgtcaacatccaccagtgaatcaacgagtgcatcggcatccacatcaatgagtgcttctgctcaagatgccgagtcgatttctgccagtgattcaaccagcacgagtgcttctgagtcgaccagtgcgtcagcgagtgcttcaacatccgctgcacatgatcagtcaacaaccgagtcggaatcgacatccgcaagtgaatccagcagccgttcggcaagtgaatcgaccagcagctcaaaggaggcatcgacttcaacctcaacaagcaagtctgagtctgcttcgagtctgccgaatccttccaagtcgacaagtgcttccgtatcgacctcgaccagtgaatcgcaagagcattctgcatcgacttcagcaagtgaatctgctgaaaatagtgcaacggcatcagccagtgcttcaacgagctattctgaatcgacttcgaccagtgaatcgcaagctgcttcaacttcaacatcagcaagcgtgtcaaccagcggatcaacctctgcttccgacagccgatccaagagtgcttctaattcgacaaccggcagcgaatcgcaacggacttcggcatcagtttctgcaagtacctcaacaagcacttcgcagtctgattcaaccaaggagtctactagtgcttcgcaatcaacttctaatagcaagtcggcgcatgattccaagtcaacatccgcaagtgaatcggatagtcactcagcgtcacagtcaacaagttattcgattagcgaatcggtaagtacttctacgagtgagtcgcagcagacttcggcatctgattcaacgagcagctcgacgagtcaaagtgcttcgatctcaacaagcatttcaacggcaccggcatcacgttcagcatcgacatcggaatctgtatctgcatcgcaatcggcttctgagtcaagctcgacgtcagctgagcaaagcgtctcggcatccgtcagtgaatctgagtcgcatcggcagttgccgtcaactagtggttcaacgagtgcaagcacttcgacttctgaaagtgtcagcgcaagcgagagccagagtaccagtgcttctaattccagtgcttcagcttctgcgagtgcctcgaattcaggtacttcaacttccaacagttcgagtgcaagcggaagtgagagtatgagttcaagcgccaacacatcaacctctggcagcttaagcacaagcggtagtatgagcaccagcgtttccggcgcttataacccaagcatgcataagcaattaccgcaaaccagcgatgatgcaggttcaagttcagtcgcctcaatcggcatgctgctcttgaccctcacggcattgatggcgttgaagaagaagaaacggcatgatggagcaagatagctatctgaaagacactcagacgaagacgtttgaatgaatctgaagatggctaggttttcgaactctcgttgctgttaagaaatacgggtaggtcatttgatgatctatccgtatttttttgatgctgtgaccattgcatggcggctgcatatcggcgccaaaatggtcattcgtcggctatttagacctctcacaagcaaaactagcttttgcttacgtggctagctgctgaataagtactgaatattatgatatataaaaaccacctgcagcttcaaaagcgtctacaggtggtttttggtcactttaaaattcacacaagcccattatgctgaatcacttgctgataccaataaaacgacttcttacggtacctagctaacgtcccggtgccgtcatcatgtttgtcgacatagatataaccgtaccgcttggccatttcaccggtgctggctgagatgacgtcaatcggtgcccatgacgtatagccaacgagatcaacgccatccctgatcgcagcacccatcgcttgaatgtgtgctttgagataggcgattctggcatcatcattgacggttttgacgccattttgctcaatgagttggtcgcgggtgccgaaaccgttttcgacgaccattaacggcacttggtagcggtcatagatttgattgagcgcggttctgaggccgcggggatcaatttcccaaccccattcgctgcgttccagataagggttcttgacgccgctgaagaagttgccgccggttttttcgccttcacctgtgcaggtcatggtgctggattggtaataggagaaggtgtaaaaatcaaccgtccctgcagcaagcgtggctgcatcttccggtgccatgtcgatatgaagatgatgatcgcgccagtagcggcgggcgaaataagggtagtggcctttaacttggacatcgccacaataaaaattgttgaattcagtggcgcgttgaaccatggcgatgtcatccggatggctggtgtacggatacagcattcggtacgcaagcatacaaccgacttgaagctgcggatccagctcgtgggcgaatttggtcaccaaggcgctagcgacaaactggtggtggagcgcctgcaagcgcaactgctcggagtcggtatcgggactgatgaatcggtccgagtcgtcaacgtacatgccgccagccaggtaagcacccattggtcgggtgagcatgttgatctcattaaaagtcagccagtagcgaacatcgtgatggtagcgggtgatgatggtttcagcaaaacgggtatacgcggcaatcatgtcacgcgaagcccatgcattgaaggctttggtcagaccaatcggcgactcaaaatgcgaaatcgtaactaatggttcgatatcatgtcgcttcagctcggcgatcagctgatcataaaaggctaagccggcttcgttaggttcggtttctaacccagtggggaaaatgcgggtccaggcaatcgagaatcgatagaccttgaaacccatttccgcaaacaacgcgatatcttctttaaaccgatgaaagtgatcgatcgcgtcatgacttggataaaatgctcgcggatcgacggtgcgggtgattttgcgcggcacgttgacactgccgcctaaaagtaaatcgctggtcgaaaggcctttaccatccccatcataggcgccttcaagttggttggcagctgtcgcaccgccccataggaaaccttctggaaaattagtttctgtcatatttttgctcctttttaagcctcaggcattggttgacgaagggtgagtaaagcatcttcgttagtgacggttggttggtcgtgtacgtcaatctgatgagcagctgtgttgatcagtaagacaatcacggttggatcaaacccttcttgacgaatcaaagacaaatccagctgcaccagcggttgaccggctttaacttcctgattgtgttccactaaagtcttgaagccgcggcctttgaggttgacggtgttgatgccaatgtggattaaaatttcctgaccattggcagttgttagccccatggcatgaccggttgggtaaaccatggtcactttagcatcgcatggtgccgtaatggtgtcagcctcggggtcgattgccaccccgtgacctagtgatccggaagcgaaaacctcgtcatcaagctggctaagcggaacaatccggccggcaaccacgcttttaaattgttgggtagttggtttagcggttgtggcgactgttgaatcgggtactactgcgaaaaagtacgtcgtgataaatgtcagaccaaaagcgatcgccacggtaattaaggcgttgcggaagttatccgggttggcaccaatgaaaaccggtaacgtgaaaatgcctggcgaaccaaacgaataacggacaaggccgctgatgccggcgaacagccctgccaaaccgccagacacgataacacaggctaaagcgcgtttgtacttgagcgtcacgccgtaaagtgctggttcggtaatgccggataaggcggtaaccgtagcagacaacgcaatctggcgcccacgtgctttgcgttcacggacggcaatcgccgcggaagcaccagcctgggcaatgttgctggccaacatgccagggcccatgatggtttcggaaccgaatcgaccgattgacagggtagccagtggtagcagcgatacatgcatgcctaccatgaccaataaaggtgtgaaggcaccgacgagggttggcactagccaaggaacatgtcggttcaacacggagatggcggcgtataggccatcgcccatcatgctgccgatcgggccaatgacgattaaggcaaccggtgccgtaatcaaggcgaccaacagtggcttaagcatcgttttaatcatgtccggggcgactttttccgcaaacctttcgacataactcatgaaccacacaattaaaatgatcggaatgacactgccgccgtatgacgcaaggcgaattggggcgccgaacaaagcaatgggcttgccagctgccaccattgccgtgaagttagggtgcagcaggacaccagccatcatcatggccagataagtgttggtgttgaattttttggctgcactgacagctaacatgaaggggagaaaataaaacgcagcgtctgccatgaagctcaaggtcaaataaggcacgcttttgggatcaagtccgcaaagcgccataatggcaatgacgaccttgaataaaccaccggcaattaaaacggtgatgatgggcgccatgatattgacaatggcatttaggactcgttttaggaaattcttttcggaactcgcggcagggttggaagtggtattgttttcgcgaatggcgtagtttttcatgatttcggcatagtactgggttactttggcgccaacgacgacttgggattcgtcgcctgagctgacggcacttaacacttcgggaatctgttcaagctgttgggtgttgaacttggttttatcgattaagacaaagcgcaaacgtgtcgcgcagtggctgagacttttaatgttgtcaacgccaccgaccgcctgcatgatgcgatcggtgatttttggatggttagtcattagttcctccttggtgggttgtttgagtgcgtgacgatgggttaaccgattaacacacggtggatgtgaataatgagataagccagttcctcttttgtcggcggtttattgtaaatagccatgattgttttgtcgactttgagggcaattttggctgcttcggggtacagactgtacacattgaccagtaactggccgtcatcttccagcatggtgttgctcagatagcgttcggcgaagaatttcatgtgggtgacgaaccgctcatagtgcaggctggtggtcgcaatggtgccgccagtgagcgcgcgaacggcttgcaggacgttgtcaacgagttgggtgacttccaaaacattggctttggcggtcgcagccggtgtggcattaataatatgaaaagcgatattggcggcttcttccttaggtaatgtgacttctaaggtatcgcgcacaacggttaagccgtattcgccaatggtaaaaatgtcagggtagtaggtcttcatctcccagtaaatccgattacccaatgcctgttgggcgtggtagcgctgaaccgagaaatgaagatgatccgttaaggcgtaataaatgctggggagcagggaagcctgcagtttttcttcggcataagtgacaatctgtgaggtcatgctgatgtaaaccgcgggaatgcgattaagcgactggatcatttcgcttttgcggctgtcatctagtggcatgaacttcttgaacaccgcggtatcggggatggtgacaccgactttttgatggtagccgatgcctttaccaaaagcgatatattcatctccgttttgttctgcaagcaccacgttgacgttgagaacctttttgatgcgaaacacacaactcctcctttcttgaagtttgccattaagcctaacaactgaggggctttgctggtggttaatggggtgaccaatttttgaagcgagaaaaatgcaggcaaaattaagaagatcgtttgatgtcgaaacgatgatcaaagtcttgcctgcattaccagtaacatacgcttgtttattcagttgatagttgcattttagcaatcaaatgatgaaaacgcaaccatgtaaaccaaaagttttgtatgttttttagtttgtttactacttattaatttaaaaataaatagcaacccatggattaatgaacaaaatcatgggttgctattatttttatttaaattaggtatagctagatttatcagattgaagtcgtttctagcaaggcaaaggcaaagcctctacgttgttcgataagcgaactcacgacgatcaaattcgttttgtctgcttcaagtgtcgtcgtttgctcggccaatattcgtagacggtgacaccaatagccaccagaacgccgatgatggtcagccaccagccttgggtgataccaggcgtgtgataggttaaggtgaacgtcgaacggctagtggggactttgaggccgatgaatccgcggtagttttgcaaggtgacgttcttagaattaacttgccagcctttttcgtaaggaatggtcagcatgatataaccactgttgtttgccttggttgtcagggtaactcggccattttgaatgcgttgtttcggagctttttgcttggccgtggcaatcgtttgtttaaacgcggttcgattgagcgtgtataacgcaaagtgatcgagatcaatttgattgaggccacggttaaacgtcaacgtgatcgtggttggtttggtgctgttgatcggcattgaaactgttttgctgccagtatcggggtcatttttaaccggaatgttgttgatactgatcgccatgttcttgcgcatgttttcgcccatcactagatactgctgttcgctggtggggttaaccgttaacgtaattgaagcagcgtttttcttattgactttggtcgcaacagcgttcgtcagggtcgtgagcggcttgacattgtcgacactgatgccggaaaagtcgctggttgtcagcatcgtctggttggcttgaggcgacagcgtttcaaaatacgcattttgctgcagcactgggttggcctgaacctgagttgggattttccggtaaatctgggtggctaccggcagggcatcgggattttggtaaatattgaagtagtcattgtggcccacgagcttataagccgataagtcatagcgcgggttggaaataattcgggaggcaacttgctgataagcttttgtcccggttttcttgctttgcgtgttaacgatcaatagctgtttgacgcccagcagactttccagcggccaagtgaggtcgttgtttttaacacgtccggcagaaccgatcgcgcccacattggttagggtgttgatggtgctggtgttgagtaccgaagaaaaggtactgatgccgttaaaattatattgatacgggtcatccatggagcgttggctatcggcattcattcggtaaaagctgcctgatccgagttttttagcatcgtcataaccggcttggagaaccttgctggtgacggtaaagtctgctgcaggcacgaagctaatcgcttttagactcgtgaatgcattggtgcccatgtctaaaacaagcaggaccacgatgccgctgaccagccatttttgcggtagcagccgactgcggatgctataaagcaggagtgcggcaactagcaaaaagacgccgccaagggtgaggttgagcacggtgacgtatttgtgggtggccattcttagaatcgtcgggatcagtaggcagcctgccgtcgtaatgctggccataccgaggcggaagcgggagacggatggtagatgggctaatccacgcagactcagcacaagcagccagaagattacgatgaacgaatggcggtaaagataccagactggggcccggaagccttgccagatcagcacaagcggattcagccaaatcgacagaatcagaagcaaggtcaagccgccagagatgagtcgttcgcgaaccgggatagatgccgctaaaaagtagaacaccgctcccagcagcgcgatcatgcccatgtaaagattgggtaagccgttggaaagttggtcgaaattaaaactcccggggatgaacttggaaggcagatcgagcagcgaataaagtgccttcacactaaaatcagcgccagcacttgatagccgggaagcagctaaggcaaagtaagtcggaattaacaccacagccgcaagcataccgcttagtaacgaaccgccagcaaataatccgattttgcggagcaggtgagtttgatggtggatcgcccagcgccaaccgaaatataaaaccgcaaaaattgcgatcatgaaaccaatgtaataattcgttatgaaactaagactgagtggcaagacgtacggcatgatccgatgcgtttcaaacagccgatcaatgcctaagaccactaatggcagtagaattacgccgtccatccacatgatgttaagaaagttggccactaaaaagccagacaagccgtaactgatactgaagaccaacgtgtaccaacgggcgccggcatgatgactggcatagcactgagccgtcaccgctgcagcactgtatttaagtgccgtcacaaacaacatggcaaccggcaacgcatgccgtgatacaagaacaaagatcaggttaaacggactcagtaagtagtaagtccagttagcatacataccgccgccaagactgttcgaaaaggaatacgccttgcctgcagttcctgctaacgcgtgtttgagataagtaaaaaagtcgatgtattgcactgccgaatcattggcgagaatggacgatgagccaaatggcgccatttttaaagcggcaaaaacgcagagactgatgataaaggtcagcgcaaaactcacaagcagtagcggccaggttttggcttttttgaaatgcaacatatccgggcaagactcctttgaaaagcaatcggttagtcgttaataattaatatgatagcaaaaaccgcgctgaataaaaaataagctaagtttaaatattaacttaatcataacgcgggattgcccaggtgcagcacccggggcagcatgaaaacgttttaagttgcaagtcttgatgtttctttaaaaatcacttcgcccgtcactgtcgttattgttacaatattaagagaacgtgcgcgatgatcatcgtttggagggcttttatggcgatacaaacaaaaagttcagacatcaaggaatttttaaaaacaaatgcgatctggctgctgccgatgttggcagttgctttggtgttattggtacagtggccgcagctgcatctatcctatattttccaccaagacgacacgatgccgcaattgcgccgcatggaaagttacgttaccagtgtccagcatggcgcgtattttccgaaggtttttcctgaagaagttcgccattttggctattcttttgatgccttttatccgtccttgatgctgctcccgtatgtttggctgcggttagccggactcggggttgtcagcgcctactatggttatcaaacgctgattttggtggtaacggtgctggcggcctacgccagttttctgaaaattcgccgccgtccgcttgcggcattcgttttcagcgtcgtgtatacaaccgcggtctatcggatgctggatgcctttgttcgcggggcgcttggtgaaaatcttgcctttatttttttgccgatcattacagccggaatgtacctgatctatataaagcagtcggacaactggttcttattggcctttggcgtgaccggcttgatgtacgcgcacatgttgtcgctcgtaatggtgctcgagtttctggttggcgggtttcttgtgttggtggcattaagacgcgtttcgtggcggatggtgcggtatacggcatatgcggcgatcagctccctattgatgggggtgggcagctacctgcctatgttggagatttcgcaacatttgccgcttaaacttgccgaatccgcaaccatttggctcaattacctgcaatatagcctaggcgacttgtttcaaaattcattgagtatgtatgcctccaccagcaacatgcaaaacgtgaatcagaccttccgtccggggatgggcgttttgatgctgggtatcgcgatcggattggcgctgtggtggcctaagttaagccgttctgtcaaagtagcggcaggactgggttttgtcaccattttcttaagcactaatctttttccatggtcactgtttcggaagaccgttttaggcacgattcagtttccgtggcgatacttggagctaacgactttattcctgagtctggctgtggctttgttggtggcagaaaaagtgcgtccgcaacgtttcgcatgggggatggtcttggcggcctgcgtggttgggtttagctatgccgcgacgattaatacgaccatgacgaacgccaatacttatcgggtgacagacaaaaatgctgccggctactatggcgatgcgactggcggcggatcggagtatgcgccgaaggagtttgatcccaccacctttttcaagaaagatcaagccgtggttttgccgtcacataaacttcaacgcttgaccccgttgacccagcattataacgatttacgctttggctacaccagcccgcgatcggttgtcttgcaattacctaagtttgcctatgtcggctataacgtcaccgtcgatgggaaagtcgttccgtatcgtgcccaaggtaaaaatgcccgcctgaccatcacggcgccggctggcagtcaccgggtgcgggtcgtctacactggcacgcggttgcaacatgtcactggatggctttccttggcggctgccattatatttttcctgagctggatctttgtcgcgattcgcaattttgatccagaaaaaagcaccacttccgaagatccgaagtagtgcgttatggtcaatgtaccggtgtgtcagacttttgcgcttaactagctgaaaagtcgacatgccggttttatttgattttacgagcaataaaaatcggacgctgcttggtttcgatatagattcggccgatataacgacccacaatccccaacgcgaacagttgaatgccgccgatcatgaggaaaatcgagaccatggacggccagcctgctgtcggatcgccataaagggccgcccgaatgacgataaatatcagtgccgcaaacgcgcctaagaagctgataatgccgatcatcgaaacgaaagtcagcggagcatcggaaaaatcaataatcccatcaatggcgtaacgcaaaaggctagtaaacgaccaactggtttcaccatgttgacgttcgatattctggtagggaaggtacttggttttaaagccaacccaactgaaaagcccctttgaaaaccgattacgctcggtcatatgtacaatcgcatcaaccacttggcgcgtcatgagccgaaaatcgcgggcgccgggaacaatctgggtctgggagacacgattgatgaacttatagaagagattggaaaagaatgaccgcactggcgcttcaccggaacgatctgtccgctgggcgccggccatgtcataaccttcctgaagggcagcgtacatatccggcaacatggctggcggatcttgcaggtcagcgtccatcacggcataataatcagcttttgctgtgaccaaaccggcgtacatggcagcttccttaccaaatgaccgcgataaatcaatgtagtgcacttgcgcatcgctttcttgcaggtgctggacttgagcaagcgtgtcgtcggttgagccatcgttgacataccagatttgcggctccaactgagtcaggtcggtttgaaaagttttcattaaagcttggtagatcaagggaacattttcggattcattatgacagggaataataattgccacgctttgcggcatgaagaagcctcctcggaaagtgaatgcgttatggtgatgtgtcaacatcagtcgtgcatcgttttgaccgccttagttaacttggcattctgactcgtcactgttgtcaggttagcggtcatgacatcaatttgttgattcagtgaactgtaatattgattaagttgtgagatttgggtttccaaatccgcctgcgagacgtcactaccagccgtggccgcgaaaaaatcgtcctcggcactcaacatttcccgataataactaaccagggttttgtgatcgagtttggccagcttgagactggtgagtaccttgctcaacggcgcttggggcatgtcttcagacggttggttattgagtttggtcaaggtattattggcatcagtcagcgctgtgttcgccgcttccaatgatttaaacgctgcggcgcgcttatccaacaatttcttgacggcaccatcgtcattttttagatctgccgacgggtcatcttggtatgccttctcaaaggtggacggaaaatcattcaccgtcgagccaatgacttgcaacgcttgctgttcctgctgcacttgagtttgcacagtctgcgttgtcgtcagtaattgctttttttgatttaaagtggccgaacacccaacaaaaagaaaggctagcacggctaataatggcagtaattttttcatgtcttagtcctctttttctatggtagcgtaacaacaaaagaattactagaggctacatggtgagcgggcttagaagcaatcacgctaataacaaaacaacgtatgataaactaaaggcaaatggaggaattgcttatgcatatcggtatgcgaacggttaaaacagcggtgggaacagcggttgcgatgctcattgcttatgccttacatcttgaatattggacagctgccggtatcattacgattctgtcggttcagaataccaccaaagcatcgttcaggctggttgcctaccgactgctggcaactgtgttgggctttgtcattgcgatcggggcattcttggttctggggtacaatgcgctggcgtttggcgttttccttttaatcttcatcccactaaccaacgtatttgaagtgcaaagcggcattgtgatgacggccgtgttggtcacgcattttatgatggccaaaagctgcagttggttctggattcgcaatgagcttttgttgctggcggtcggtgccggcgtcgcccttgtggcaaatttgtttatgccgagtctggaagccaaaatcacggaatttcaggcgcaggtcgaagcggaaatgcgggaaatcatcgatcatatgagtcaacagttggggccggagcatcttaaaagtgccgataactgggcgaatttatcggatttgaaaatgacgctggatgcagcagtggcttgggcaaatcggcacagtgacaatcaattgtggtcggaaaatgactattaccaagcttacttcgagatgcgagccaatcaatatgaactgttacgccaaatgcaggatagcctggatcgaatcgaaacgccggttttgcaggcggctgtgatcagcgatgccttgtcgatgacagctagtgtgttgaatgaagataatccggcgacgcaactagttacgatggttaaaaagattcagcgcaacttcgcggcttcaccgctgccgactgatcgggcgtcatttgaaagccgcgcccgtttattttattttctggaagacttctcccgcttgttacagttaaagcgcaatttcaatcacattatttcctcgcaaaattgatttctgaaagtgctgacacttgcgacgattttaccgtgatggtagactaaacatgtactttttgaatggtcgtggttgcatggtttcagaactttcttccacttgtaccaaacagaaatacacgatattatcatgcgtcaaatgacgcaaggaggaatgttctcatggaacacggcacagttaaatggttcaacgctgaaaagggttacggctttatcacacgggaagatggcagcgatgttttcgttcacttctcagctatccaaggcgacggttacaagacgctcgaagaaggccaagcggtaacgtttgaagtcgaagacagcgatcgtggcccacaagcggttaacgttaacaaagactaattaaagaaaccattgaccgactgcatttgatgcagccggtttttatttgttgagcgcgaacaggagcgcttagaaatcggagtgtaagtggccttgggcgcaggtttctgggctggcgaacgcgttatggcctgagatgattctctagcttttcgtaaaaaaacaatgtttcgtagcatcagagccattggtccatggtaaactaatctataacaaaatcatcatctttggatagggctaatggaggctggggcgcgatgttaaaatttgaagaagtggcacctgaggcaaggattcagtatttagatctcctattggtgggggatgaagatcccgccatgcttagtcgctatttaagtacagggacactttttgccgcgcttgatgatcaggtgcccgtcggcgtcgcgatggttgttccagtcgatgagcagacggttgaattgaaaaatctcgcggtcgcgtctgcgcgccgccgccaaggcattgcgtccggcttattgcggcacgtgggcttggtgtatgccactcagcagtatcaggagattttggtgggcaccggcgatgttgattttgataatctccgcttctatatgcgacgcgggtttcggttggattcgattcggaaacatttctttgaccaatacagccagcctgtctatgctgacggattgaagttacaggatatgctggttttgcggcgcaagttgttactgacacgtgaaaatgagacgaaggagtaaaggctattggcgaaaaagcgccgacgttttacattgaaaaagattccgctggctgcttggctcgttctggcgttttttgcagtcggggcaacgttggtggtcggttcatattggtcacagcgtcaagcggaagtttcacaacagcaggccagtatcgataaaaaagccgctgaaaaggcgaagaaagaggcttttatcagacgactggcaccgactgcacaggccatgcagaaacagtatggcgttttgaccagtattacgttggcacaggctattctcgaatccaactggggaacaagcacattggccaaagattatcacaatctgttcggcattaaaggaacggatcctgcgaacaccaaggtgctacgaaccaaagaatatgtcaatgataagtggattacggttgatggccggtttcgggtatacagcgatgatacggcatcaatccgtgatcacgcgctattatttgttaacggcactgactggaatccgcaacaatacgcgaccgtgcgcgcggccaaggattacaaatcggcagcatcggctctgcagacagatgggtatgcgaccgatcctgattatccgcaaaagttgattcatctgattgaaacttggaatctgacgcaatatgacagctgaatgttcgtattttaatgatgacacaatccctgttgtttggctttaataaccccaaatcacaggggttttgttctcttatggtcgtgaaagcggctacttgtctcgttcgggaatcgctgaagctgtattgttccacagcgttttttatggtaagcttgttgaaaatttacaaatagaaggagtgcttgtggtgaaattactggaagaccggatcaaaaaggatggccaagttatcggaacagatgtgttgaaggtggataacttcctgaatcatcaagtcgatcctgatttaatggccgatctgggtaaggaattttaccggcgtttcagcaatgagccgatcaccaaaatccttactgttgaaagttccggcattgcccctgcgattgcaacggcgatggagtttcacaagccgcttgtgtttgcccgcaagcacaagagtctgaccttaaaggatcatctatacactgccacggtttattcatttaccaaaaagacttccaatgaaattgcgatttcccgcaagttcctttccgcggacgacaatgtgctgattattgatgattttttggcgaatggccaagcggttgaagggttgatggagatcattgcccaagccggcgcaacgttgagcggtgtcggaattgtcatcgaaaagaccttccagaagggccgcaagttgttggatgacaaacatgttcgggttgaatctttggcaaggatcagtgcgtttgaagatggtcacgtcatttttgcaccggaggactaagcgcaaacatgaaaagtaaaagcatttccaatccaaaagcggcggcactggggctgcaacatctgttagccatgtattcggggtcggtgctggtgccgattctgatcggtgcctctttgcactttacttcagagcagatgacctacctggtttcgattgatatttttatgtgtggcattgccactgctttacaggtatttggcaataaatattttggtattaaattaccggttgttttaggctgtgcggtgcaagccgtggcaccgttaattatgatcggacagaaattcaattttcaaaccatgtacggtgccattatcgtcgctggtttgtttgtctttctgatcggcggggcgttttcaaaactgcgctttttgtttccgccgctcgtgaccggctcactgattacggtcatcggattatcgttaattccggtcgccttccagaatcttgggggcggctccacaacagctaaagatttcggcaatatgacgaatcttctggtcggtacgttcacggtgttgctgattctggccattaatgtttggggcagaggctttttgcactctattgccattctggtcggcttgattgccggtacagtgttagccggttttttcgggttggtaagtttccagccggtcgtcgaggctagttggtttcatgtgccgacgccattttattttggggtaccgcattttgaatggagttcgatcgtcacgatgattttgatttcgatgacgtcgatggttgagagtactggcgttttctttgctttaggggatattgtcgggcgtaaaattgaagcggatgatttgaaacgtggctatcgcgcggagggcttggcagtcatgttaggcggtttgtttaacaccttcccatacacgaccttctcgcaaaacgtcggcttagtgcagctttcgggcattaaaacgcgaaaaccagtcatctattcggcaattttcctggttattttgggcttattgccaaaaattggtgccttggccaccatcattccggctccggttctgggtggcgcgatgctagtgatgtttggcatggtggcggtacaaggaattcggatgttgcaacaggttgattttgaaaatgataagaatctgctggttgccgcgatctcgattggcctgggtttaggggtgactgttcagccgcatatcgtccagtttttaccgaagaccattcaactgcttttcgggtcggggattttgatgaccagcttgagtgccgtgttgttgaactggattttcaattcacccagtcggacactggaaatgccgattgatcgcggtttaaacgaaaatgattcagataaataaagtcaaagcgaggaacaaatgtgacgcaatttattagtccaggagccactattggcatcatcggcggcggagtttcagcttttcgcatggctgataccgccagtctgatgggcatgcgtacagtggttttggcacccacgcaaaccgatattgcgcttgaaaaagccgatattcccttggtaggtaagtcggatgaccgcactgcgttaaaagaattgacgcaaatgagtacggtgatgacgtttaccgacgagaatgtggacggcgcgatcttagcggagttagcaaccgcgagtcaattgccttcaggaagcgacattttgacggtaacgcaggatcgttatctggaaaaagtctttcttgacgatctcaacatgaatattttgccttatacccaggtgatcacgcctggcgatattaatgaagcgattgatacgattggctatcccgccttattgaagccaattcaaaaagggatgggggtcgatcagcagttattgttgtcgacaccggatgatgtggatcgcgctaagcaactgttgcaacaacgtccttatattttggaagcctatttgcaaaatatcaaagaggtggccgtgatggtggcaaaagccggcacgaccattcgaatcggtccggtcattcaaaattattttgaccaccatcagctcaaagcttcatcggtgcgcgctgacgttgatccggccgttattgtggagatccggcgcattgccgaaaaaattgccaagaaacttgactacaccggcattttcagccttgagttcttcttggcgactaatggcacgttgtacgtcaagcgagtttacccggggccgaagttatacggtcatcttatgcagagcaccagcgacatttccgaatacgagttacatctgcgggccattcttggttggccgttaccggaattggaactggctgaggacggggttggtattccgctccggcaaaaagatatggatgcggtgttgacgcaaattcaaatcaagcctgactggcgcttcgctttctatccgaacggtggcgagttagtcggtgaaattgaaatcgttggcgatttgaaggccatcaaagacagtattaacgcaaccggacattttgttattcagtaacgtttttatcaagctataagttttcggatcggtcagttagtggttattaattggatggatctgaacctcatggatcttaaaagtcgtgctcaccttagaggaggaaaaaacctgtgattccgcgttatagtcgccctgagatggcggcaatttggtcagaaaagaaccggtacgctgcttggctggaagttgaaattttggcggccgaagcttggtctaagttaggagaaatcccggccagcgacgtcaaggccttgcgtgccaatgcaaaattcgatgttgatcggattcatgaaatcgaagccgtgacccatcatgatgtggtcgcctttacccgcgatgtttccgaaagccttggaccggagaaaaagtgggttcattttggcttaaccagtaccgatgtggtcgatacggcgcaaggatacttattaaagcaggctaatcagattctgcgttcggatctggatgccttaaaagcgagcttggcaaaattagcgaaggcgcacaaggatacggtgatgatggggcggacgcatggtgtccacgctgagccgacgacattcggtctcgtggttgcgacgtggtactccgagcttaatcgggatattcggcgatttgaagatgccgcaaatgatgttgaagcaggtaagattagcggtgccgtgggaacgtttgccaatacgccgccagcggttgaagcctatgtgaccaagcaactgggcattcgggcacaggaaatctcaacgcaggtgctgccacgtgatctgcacgcacattacattcagacgcttggattgattgcgacctcggttgaacggtttgccttgcaaatccgccatatgcagcgtacggaggttcatgaggtcgaagagcactttaacaaaggccaaaaaggttccagtgcgatgccgcataagcgtaatccgatcggttcagagaatgtctcagggttagcccgtgtcatccgcggttacgaaacgccagcattagaagacgttttactgtggcatgagcgcgatatttcacattccagtgccgaacggatcatgttgccggacgccaccggcctgctggattatatcctgcaccgctttaccagcatccttgatcacttggacgtcttcccagaacggatgaaggcaaacatgaatctgacacacggtttgatttatagtcagcgggttatgctcaaactcatcgaaagtggtctgagtcgtgagcaagcctacgatctggttcagccaaaaacagcagttgcctgggatgaacatcgtgattttcggccgttgctcgaggcagatcctgaaatcatgggtcggctgtccagggccgatttggatgacgcctttgactatcattatcacctcaagcatgttgacgaaatattcaagcgtgttgggttagcataacttacccgctgcacgttttggtaagtgaagaccaaaaaaccggttctagacatcaatttgtctagagccggtttttgcttaaagtgtaagatttaaatgagtcaggttatttggcaatagcgtttaaagataataccggtggctgttcccacgcattttggggattggcgcttaatagtgattgatctgtcgtcaagacaagcaggcagctgtcggtttgctgcaaggcgcgactggcttcggttaaaaaggaacgggtgacttgtgggtcaaacacttcagcacggccgcttagcagcaaataacgttttttacccactaagccacgataaaattgcaggtatagccgttgcatggtgtccaatgtagcagctggctgatcgaggattggcgagttgttattcagccattccggcaaaaagtccgtgttcttgctgtgcccattgatgtacagattattgcggacactgagataatccaaaatgccagtgtcgcggctgctgataaaagcaagctgtttcatcaaaccgccgctcgcaaaattcttaatatactgatcacggaggtcgttcagtgcttcctcgtctggcacatacagatactgaatcgttttgggtgcgaagagcttcgcaagattttcacgatacacatcaagttgttttgaccgaaataacatagcaatctcctaacgcggcatgactcgccgcttgcgaatcattgaaagcggggtcactaatcccagagtggtgatgaaaatcacggccatcccattacctaaagttgttaaaaagccggttggttgggtgatttcatccgttctaccgccgtaataaaataaagtttctcgagtaaatccggttaggtgacgggcaaataattgccgaaaagcccggttcatatccacactttgatagccttcctgcagcagatggccaaaaacggagcggttggcgctggttagaaactggatcaattggtcattaaacagaatgatcaaaaagacagtgatcataaagctgatccagaaactaaagaaagcttcaaaagcatactgcaagccaattgacatactgcttttgcccactaaataaagcgcatcggtttcagagcggcggtgataccatagccaagccgttccgatcagccagcagatagcattgaaaatcataacccgattcaccaatgattgtgcggactgaaccattttgatatgtgcctgaccaacctgcgtacttagcagaatggcttctttattttgatcgccaaaagaattaagacgctgcagaaatgccccctgtgcggattggtcgatcatttcactcgtcatcagcatgatgctgatcaagcagaacgcaaccgacagcagcatcatcacaatgtaataacggcgatgataacggaaacccgagaacgttcgctcaaagaaatgcatctacccgttcacctcataagcagtataagcaaagaatttgaacaaagtgtgaacttaaagcgagcattcactatgttatttgatttgtttggttcgaatgtcgactgtttcggagctgctagattcggattcgcttgcagacgaatcggtttgtgcctggactttttcagggaaatcggtgattggctgggtgtcatcggctaattcaggagcatcggtttgatagaggtttgtggttgattggtcattatttttactgtagagactggtactcttgctgccgcgactgtgttcgagcgacaagaccttgctaagactctggttgtagtcatactggcccggattaaccggtttgaaccccaacggcacatagaaacgtaacaaattacgattggccacatcgtcagagaggcttaaccgcgtatcaaccgatttctggtctttggtgatggccgcctgcaaagtaggggtcatggtcacaagtttaccggttgtgttgtcataaaccttgctgcctaaaacagtgtatttcggtgttacaaaattatggtttcgaaatgcaacaacatcatcatgctggctcgaaagcagatccgtgccaaactgaacatagcgtttactgctgatgcccagcaagtgcaataatgtcggcaaaacatcaatttcaccgccatacgtattgttgataccgcctttgaggcctggcatgtggaagattaacggaacacgctgtaactgcgcattatcaaacgctgtccacttgctgggatctttgcctaataacggcgccaaggtcgtgttacggtcgttgctaatcccaaaatgatccccgtaaagcatgaccagtgaattcttttccaaaccgctggctttcaggtaattgaagaactcgcgtaacgcctcatccagataatgagccgttttaaaatagccattaatcgttgcgtcatcggtcccagcatctggaaagtcggaatctgcttgcgtaatataaaacggattatgattgctggtcgtaatgatcttcgtgtaaaacggctgttgtagatgctccaaatatttcggcgtttcagccagcatcaatttatctttaatgccgtattccgttgcggccttttcgtcatgattataaaagttaccggaaaagtaatcatcgtagccaaggcttttataaacattgtctcggttccagaaagaagcagaaccaccatgaaagactgcgcttgtataacccgcgcgttgtttaagaatggccggggcaccttcaaaggtattttccgtgccaagactgctgaacagcgagccattggcaatcccgaacgtgctggtttccaacatgttttctgcatcactggttttacctagaccgacttggtggaagaagttgttgaaactgagcgtgtccttttccttgatcaatgaattgagaaacggcgtgacttcctggccgtcaattttctggccgatcagaaactgctggaaactttcaaggtgaatgataatgacattcttgcccttggctgccccgtaataactggcattgggcgcggcgtaatgagagcgagtgtattgcaaaaccggatcaaggttggcactgtctgcctgggcgcgaacctggttgttctgggcggttttcgccgcatcataaaccgtaaaaggtgccaaccctaagtatttgacaatgtaattgcggtcaaaagttcgggtcaggagctgcgggcgattcatttcactggtagcagtgagcaaggcaaaaaaggccacgccaaacaccgttactgcttgcggtaagtggtaaggcatgcggctggtatcaagcgataagccaaaatgcggccatttcagtggttgattgtgaatatagcgccagatgttccaaatgctataacccagataagttaacgcaaccagggcaatatccagtacataaatgatgtcatgtggcttcaccatgcttagtgaactggcaccaagtccctggctgacctttgaaacgcctaggatggtggtcaccgtcagaaaatcggtgaactcacgatagtaaaggacgttagcgagcaataataagttacttaatatgtagacaatgatgccaaccagataaccacgccgcgcatgttttggataaagccctaacgagagcaaaatgatgccagtgcctaaggggttgaggatgagtaaggtatattgaagcgggtcgttcaggcctagcgagaaatcaaaaaaatagccaaaaagcgttttagcccacagtaaaaaaagcaggagcgccaaaaagccgatccgggtattgcgaagccacaataaaaggcgattgagtcgtaaccgtttcaaagcggtaactcctttccactttgttctttgtcattgtacccgcaaataggcaattgcacaaagagcgcgagcggggccggttagaaaccggagcataagtggccttgatcgtaatggccgggctttggccattacgatcaaggtccttatgtgcaggtttctggccacgcgaacgcgtttaagtcagagcgtgagcggggccggttagaaaccggagtgtaagtggcctcgggcgtgatggccgggctttggccattacgcccgaggtccttacatgcaagcttttgcgccagtgaacgcgtttgattttttcagccaacatttccgcaccgaaacagcataccgcaactaggtcaaatccagtcaagactggctgattcttatggagtctttaaaagttattgaaatccagatgtacggtgggtatccggtaggtggtttgctacaatgactactggaggtaacgcgatgctttttttggggccattctacaattggattaacagcacatcattaagccgggtgaaccattttcccttggtgcggctggtggtttatagcctagacaaaacgatcctttacctattaatatttgcggcattacggtgcttctggttgttgacgacccaccggcgcacgtcatttggccatgagcttaaactgggcctgtttgtgggctatctaatcttactgtttgcgttgacagttttccgtgatgtttattacccatggcagttgacgtttcattgggatcgaccgctatcggtaattaacttacagccgctcgttgagacgctgaaattgcgacaggcagcgagtcattttgatttgtggtatcagtcacttggcaacgttgcctggtttatgccattaggatttggcattccctggatcagcacacatcggcggcgacttggttcagcaatcgcgatcggactggtgacctcgttaagcattgaaacgctgcaattcttgctgatcagcggggtggccgatattgacgatgtgatttttaatttgattggcgccatcctgggttacggtttttaccgcatgtggcatctacatcgctaaccggtgtcgaaaagatttttgcgtgccgagtatcgattaaaccaaaagttctcttagttttctaactgattttttggttgttttgctactggaaaaccgatagaatactagcctgtattctatttttagcttaacgatacgatatatagaaagaggcgcgttatggtaattttacttgcgctgatcccgatgtttgcctggggctccattggtttggtcagtggaaaacttggaggcaatgcgtatcagcaaactttgggaatgacgtttggcgcgctggttttcggcgttggaaccttgctcgtcatgcacccggcgctagatagcaaaacctggctgcttggcattatttccgggcttttttgggcgttgggccaaggccagcagtttcaatcaatgaagtatatgggtgtctcgatgaccatgcccatctccaccggcatgcaactcattgcgaccacactggctggcgcgctgttgtttcacgaatggcataatggcagggatgtaacgcttggcattttggcgttggcattgctgattattggtgccacgttaacgtcacgacgcgaacaaaacgatgatgtcacttctgcgtctggcgtgtccaaaggcatccggaccttgctgatttctacagcgggatatgccgggtacaccatcatcgtcaatgcagggcaattaggggcactggcagtcgtcatgccgcaatctgtggggatgattattggcgccttattgatgagcattggtcatcagccttttgccaaggcaactgtgaagaatattttgacaggtctgctttggggcactgggaatgtcttcatgctcttatccatggcgaaagtcgggttggcagtttcttactcgctctcgcaaatgggcattgtcatttcgacatttggctccatttacttactcggcgaacgcaagacgcacaaggaaatggtctgggtcagctggggttcggcactcgttattctcggcggcgttgtgctgggcatcatgaaagcaaagtaatctgatgagaagttgccggattgcttgcttttttacaaattcaattttaaagttaacttgttagagtgtgaatttgaacagcgccttttgctggttaaaattttgtttggaagcggtgccgcaacctttttatggtggcggtcaaagcaaaagttttgtcagcaattgacgtatttagaggaggaacgcacacgatgtcgtacatcaaatttgattcatctaagctggacaagttcgttcatgccaatgagcttgaacagatgcagccgttggtaactgcagctgacaaggaattgcgtgaaggaaccggtgccggtaaggaatttcgcggttttcttgacttgccggttaattatgataaagatgagtttgcccggatcaaggcagcagccaagaagattcagggtaactcacaggtcttcgttgcgatcgggattggcggttcttatttaggcgcacggatggccgttgattttctttcccagaccttccgcaaccttgatcctgatttgaagttcccagaagtttattttgcaggtaactcaatctccggtacttatctggctgacttgctcgacatcattggtgatcgcgacttctcgatcaatgtcatcagcaagtccggtacgacaactgaaccttcaattgctttccgcattttgaaggccaagttaattgaaaagtatggcaaggaaggcgccaaggaacggatctatgccacaaccgatcgggccaagggtgctttgaagcaagaagctgacgctgaaggctacgaagaattcgttgtgccggatgatgttggtggccgcttctccgttatgtctgccgtgggtctgttaccaattgccgtagctggcggcgacatcgatgaaatgatgcgcggactcggcgatggtcgcaaagcctatgcatcagctgacttgaaggaaaacgaagcctatcaatacgctgctttgcggaacatcctgtatcgcaaaggctacaccaccgaattgctggaaaattacgaaccaacgcttcagtatctgggcgaatggtggaaacaactgatgggtgaatctgaaggtaaagaccaaaaggggatctatccttcaagcgccaacttcagtaccgaccttcacagtctcggccagtacatccaagaaggtttgcgcaatttaatggaaaccgttgtttgggttgaagaacctaatcgcgatctgaccattccagacgacgcccagaacctcgacggcctcggctatcttgccggcaagaagatgtcctttgtcaaccgcaaagcctatgaaggcgttgttttggcacacacggatggcggcgtaccggttatgaccgtctccattcctaaacaagatgcttacaccttgggttatctgatctacttctttgaagcagccgtttcaatctccggttacttgaatggcatcaacccattcaaccagccaggcgttgaagcttataagaagaacatgttcgcattgctcggtcgtcctgggtatgaggatatgaccaaggaattgaatgcgcggctgtagtcgtgagggtttgtgcgttttgaaatagtttagaatagaagcctcaaaattgggttgtaaatgttcgtggctgaattttggctgaatagccaaagttagccgtgcatttctatcaccatttttgaggcttttttgcgtattcattcattgaggtatttttcaaatcgccgatgattttcctgttttttggcaggagagatctccgcatatatctgcgtagttgaaacattttttgccctaagtcatctttaatgtcatcaagactcaatcctgcttcacgcattaaaacagcatgggtgtgccttagatcgtgaattcgaatgtggggaagatttgctcgtttggtgatgcgattgaatgcgcctgtcgtcgcgcgcgggtataggttcaccgaattttgccttagtcgaatatgtgaagacaaaaccttggttatgtgggcaatttggcatcatccatgatgacgccgagatcttttagtcctgcaactactggaatggtattcaagctaacactgccattatatagtgtgatgtgacagttcacaccaccaacaacaagtccattagtaataggctgcgatattatgaattatggcataaggttggttcggctccatctgccaccggctggaggccttatcagcaagtgtattaccgaactcaaaccgcgaactgagcaaacttggttagatagctgcaacaatgtcacaacagtcgcattgtacgacggctgtgctggcgtgcctggtaagctacttgactgtttgcaaaaagcagcccattcttgatttagtttgtaaatatgctaatattgcttcatggaaaagaagtatgtgttagttagctttatgtctaagcagtctctaatagatgtcgcccaggtggctttaaatggttccacctatgaattaaaaggaaccgagatccttaacgtttataaagacaatgataattgggtcttcgaaatcaaaaacgataagaaaattataaagtcattttttattgtacccaaaagtggtgggggctttctagatatttcggctttggaacgggttaatagtcaggctgaatccatgtttcgcgaggattccttgtatggtattaaagatagacctggattagatagaattgttaactcgatttttaacggatttggtggagaagagttttatccaggtgttttgcgtaaagccaccgcctattggtataaacttgcaaccacacaaatgttttataatgggaataagcgcactgctttacttgcagctttggaaatgctagtaagtaatggatatgtgttgaacaacttgagcggtaaggagctgtacgatataactcttgcgatagcggctaaggaacttagcaaagaatcattgtgggaatatgtgttgaagaatagctctctgcaatattttaatactcgaagtgaagctttaaattctgaccgttgggtacaactcaattttaaagttgacgaaaatgccgatctggattagaaggaaggaagagaacaagtatggaaacgaagtttgttattcatgatgctaatggcattataaaaagtacgttaaaggatgccaatcaaaagtcccttcgtaaaattaacaccacccaaattgacgctaatctcaatgaactattaaagaatccgcaaatcaaattggctgtggaacgattagcacagagttgataaaaaataagtcttctgctcgctgacacgggtggtagacttatttttgtgcaatcgtgtagcaaatagcaacttgtgtatgccctgtcgcggataaatggaaaatcagagctttatatttaacaaactatatcttttttaacgctcgtttaatggcgcttacaatatctttattaggcactattgctgcattcatagccatgatatcgcctaagctaaagttatagtctgatacttcatctgcggtgatatttaggtaaattggtaaaatcgtctcatcttttcttttactctctttgacaaatgcggcgcgtaattcctgttgtgtccaaaacctggtaaagtaatcttttgatagcaccagaattgtgaaacgtgagttctgaaagcccttgtttattgattctacaagactacttccccaaacaatctcatcactgtcaatccagacttttatgtccgcctcttctagatcttcacgtaaacgggtcacatatccgctatcagaatgcgcatacgaaataaaaacgtcatactttctttgaacttgttctgcatcgtttgcagaagacaattgttcgttcaaaatagagatttgctggtttcttaattggttcagttgattttgataatctcgttgaatcttagccgcagacttgttttgttctgcttgcatctcttttgaaagttgagtttgaaggacaccaagtttttcgtttttcctctgcagctcctttgaaattgatgcttgatttttggcttctttggcttgggctgattgtccattgataatatctttgtttaagctgcttatgcgggatgaagacaagtttcctcgacccagtttttcgctagcagaagcgacttttgctgcttctttggcagacttttgacgcgagtgagtcaacttttcgtttaaacggtttaaatctcgttgtaatgaaataatagagttttggatagaactaacactcattgacgcattcgcttccttttagacattcttttctgcgaggctatttaatgaaaacaggcttctgagcatcaagcattaattaaatttagttgtttagtcagtgccaaatttatccatatatgaggcaataatattaccatcatcagctttcatcaaattactgtttggtcttcgatttttggaatctttaacaaagtctgacatcagatagtaaccagttgcttcattatagaagctcttgggattcttatagacgatttgaccccaagaactgaaagaaagttgattaagagtatttgagttaaagaaaaagctgaattccataagatttttctttttgccactagcatttcgatattcattttgttgaacgattccaatacctttgaaggtcattggagtttttttagcatttccgattatttgagccatatattcataaaagactggcttgttaagacttgtaacatcattaacgataattgttggtactccactaacggtcttgaccgtttgtactaaataacccgcatttttagtggttttgagatactttgcaagttttttattggttgtagcttgttttgcactgactttggttttggatgcttttttcttttttgaagcctgaactactgcatagtttgtcggcagtgtcgtctctgcaacagcagtagtcggaattccgagtgtgataacagcaactaaaagggaaacttttttcatggcttctcctccaaaagaacgagatcttcgacggcttttaatactgataagtatatattcgcagtttaacgatttttcctattgtggtatacctaaaaaatctggttacacgaaactaaagcttacaaaaccacctaaggaaaaggcaaaaagtttaaaagttcatgtttaaactgtagaactattccgtataatccatccgcacaatctcaagtggttctgccaaaaagtcatcaatccccgccagaaacttttgaaaatgtgccgtttggttatgtagttcgacagctgcggcgtcttgccaatgctcgatgatttcatatttgttggggtcggtgaggctttggaagtgatcgtagctaagattgccagcctcggcacgtgatccttcgaccagcagactgatgaagtgacgatacttgtccgtcagttccggttttacctttagcgtgacattaatgactttcatttgaatcctcctaaggggtttaggtttgttgtggcgtaatgtattgacaaaggcgtttaagaagccgccttaacataatttcattatacccgattactagcaatttaccgcgtcataattgttgcaagcgggtgtgatcatagctgaatgatggggctgtgccaaaagtgatttggaacatcacgaacgaacccacttcaacaattgtaaatggccgaagaaaaaagccgtgccgacaaatgtcgtctaacggctttctgtaaagaattcttgtgttttaatttttggtactggtaccatctgcgtaattgatggtgtaacccggctcaacattgaagatataaacgttgaaccgaactgtgtcatcgccaacgctttgcgcccgcatttggacgccacgggcaacgagctcattgccgcggaagattggcttgacttcataacgtacgtaatgctggctgttttgtttaaggtagtaggcgatatccatctcatgggctaacatgagtggactgttaagtgtttgggttcccgtcatcaggttcttaggattgttattttcgccagtcagctggtaaccgatcagatggctacgattgtagagccatccgcgtgctgtctttttgttgtgccagccggttggattccaggtgaggggttcccgtttggctgagggcatcagcgatttattcaaaagtgcattcgcatcggtgacgcgattttggctgtctaaatcgctgtaagttgcccaggcaccctttgctgtggaaaggtcacttttgttaaaagcggggtcattgttgttgacggttatttcttgttggccggtgtagtcaaggttagctaagttgctggtatccggagaactactcggggcctccgatgcttttgcttctggttcctgcttatttaaggctgttttgagcttgctgacctgttcacgtttgtcagtgattgcatcgtcaaggctgctgatggctgacgcggttttcttgttaagcttggtctgactagccactggatcggccactgttttggctgatttcgagctgctttcagaactgcagccgactaacaggacacccagaacaactaagggggtgaggaacttcattatctttcttttcatcattgcagcgcctttcgataacctgccgcttgtgcttcggcttcagtgttgaaataaacagcattagcagaattcatacgatatccagcctggccgggaacatgatagatcttgctacggctattgccgacaatcgttccctgatcgcctgtattcatatcgccttgattggtaggtggtgcttgctgctgggttgtggcagcttgttgttgctgctgctgttgttgctgttgtgcggcagatttctttgcttcttctgcctgctgtttagctgccgcagcggctgcggcggcttgggatgaagaagctgcctgcgcagatgacgccgcgactttgctggctgatgcttcccgggacgctgattctgaagctgccgaggatgctgattcttcaacggctcgtgatgacgaggcacgtgcgtcaagttggtcttccagcttggtttgttccttcttcagagcctttaattctgaagacttcttagctttggctgctaacaaaaccttgccacgtgctttttccgactttaaaaggcttttctgctttgcggtcagtttcttggtggtcgtttgcgctgatgaagctgttgatggttgtgtgtcgaccatcggactgcccacaaacatgagcacaatgccgccgatcaatataataaggttgaaacgtttcgttaatggatgcttgcgttgccgcaccaaacgaatcgtgccccagactgtaccaatcagtccgagcatgacaaataaattgcccagtgttgacatttttctcctccaaattccctagtgacaattgtacgaatattgcgattaaaaaatattcgtatgaacttatttctaaagtttattttcccagaaaaaaagcccaacggcaagcgtcggacttaatttttgacttatgactgcgtcggattcaatttatgactttacaacgtcaacattggcataaagattggcgataattgccagcatgtctttttcggttcgttcccagctgattgtttttagataagcttgggctttttcaatatgctgtgtgatcgtgtcaggatttgcacatgctgcctgaagcgttttggcaagatcacgctcgtcaagatgacaagagaagtaggtattgtctttcaagaagtaactgccagtaccttctttgaaatcaatcaagggaagaccggcgctcatcatttcgtaaggaaccaaggagaaattagtcatcgaggttgcgatgccgaaatcagcttcatgataaagctggttaagctctggcggtgttagctttccgagattctcaccattgataaagcgcttgctacgccccgtaccgaagtatttgatttttagatcaatgcccctagcacgcaggatgtggcggcaattttcaagaacaatttgaatcgtgaccggcgcccgtcgcggactgctccatttggtgtaaacagctaacttaatttgctgctttttttgatacggagcagtgtcacgttctttaaatggatatcgagcaacatcgactgggaaattgatgacgtcaattggactgttgacttggcaatgcgttgtgatcatatgggcgcaccatggaccaagcgtcaccatgtgcaggccgaggctatacgtacgtcgcgccatctggtagcggtcaccataagggtagaaatacggttcgtaatcctggacaaagtacatcttatagccgggtttgtttttaatgatgtaaaccgattcccataaagtagcgatccagatgtcagattggtgcgattcgagttcgcccataggcaagcatgtgcctttatagccagggtaattaaattcggcgttttgaatcatttcgtcttggctttgcgggacatagctgaggtaataaacgtcataacccgcgtcggccagaagcgtgcctaagtgcaacatggttgtttggccgccatcataaccgatgattccggttgagacaaacgttattcgattaccacgcggcttagtctgatcggccggccggtcattgaaatatttaagtatctgattatactgatgaatgctgccatcaggggcatcattaaatttagtttttgcaggtttcacagccgttcctcctatcaattggcatactgagcatgtaggccacaagcagaaaaatgggtagaaaaaagaggcctggtgccactgttgtttttacagcagcagtacccgtttaatgaaaagattctgcgaagacctaatgtttaatttagtttacataataaccgtaagccaaatattaaaaattttcaagtttgcccggaacagagtgcgtgactgagcgcggttataagtcggtctggagagagctcgaccattgcgacagaggcttctacatgctgactttcgcgcggacaatcgtatttcagagctgtatgattaaaaagtctaaagacattatgagggttatacagaaaacttagaagatagccaatataaaaatcctaataaatgcttatctttacccttggagaggcctgtgctagtgtgagagtatccatatcaatgaaagaacaggtgaagttatgttaacgattggtgtcatgggcttgggcacaattgcccaaaaagcatatttaccggtttatgcacaaatgcaagatcaagtgcagtggctgttgagcacccgcgatgaagataaattacaacaactatcaaagcagtatggactggctgcggcgggaaattcgttggaagcgttagacgcaaagcagcttgatgccgtcatgattcacacgccgacagaaactcactatcaatatgtcaaacattttttggaaaagggtattcatgtttttgttgataaaccattggcaactgacatggggcaggttaatgaactttatgacttggctgattcccagcatgtgatgttgacagtcgggtttaatcgtcggtttgccccaatgattcaggatctggctcaggtggcagataagaccggtgtgcgcgtcgataagaacagaattgacgcacttgatgacacaaaacatgctttgtgggatctcttcattcatccagtggacactgcgctcatgttagcgggctatcctgaaaaaccaaacacgcggtatgccttgcatacaacttcagacggccagctgcaacaggcaagcgtgactttcacggcacctggcattcggggggaagccggtattgacttacaggccggcaccaatcttgaagaagcgcaagttgcgtctccgagtggcgtccaaagagtgcagaatttagatcagctggttgtttatggtcgtggcggtgcgtcacaaacatttgccccgaattggcagccaatgctggagacacgtggcttcgcttcaatggtccaagcctttgtgcaagccgtggccgatcccgatggcaaaaatccggtatcgcctgcgaccagtcagttggcacatgcggttgtcgcagatctggttaatcagattcaagaatgatcgctattttcatggattgctagctgagagacttttaaaatagagccaactagcaggtgtccactctacttagtttgtcatgggggaaacaagatatatgtatcaaaaatcgtttatggaaattgccaatgaagaggcgcgtgccaatgttaatggatcagatggcggtccttttgggtgcgttatcgtcaaggatgggaagatcgtgagtcgcgctcataatcaggttttggtcgaccatgatccgactgcacacggtgaaattactgccatcagaaaagctgggcaagcgctgggaactcatgatctgtccggttgcgagctttatacttcggcgatgccttgtccgatgtgtcttagtgcgatcatctgggccaatatcaaacaggtttattatggcaacacggcggatgatgctgcagcgatcggatttcgggacgcggccatttatgacttcattaatgatggcctgaaagggaagatgcttacattgagccaacatgatcgggacatgacgattggtgcctttaaagcgtatcaaacagcccaaaagaaattgtattagttgcgagtgatgccatttatttgaaaatgcggcgcgaacgatgtaccaggctacggatggctttgtgttggtcgacaaatggctttgcattggccaaaatggctttgcattggccaaaatggctttgcattggccaaaatacagttgacttttccaaggtttcctgtagaatagtttgggtacgataaagcgccactcattgcccgttggtcaaggggttaagacgccgcgttctcagcgcggaaacacgggttcgaatcccgtacgggtgagaaatagaagcaaccagataaaacggaatcctcaaaatgcctttataacggcgttttggggttcttttttatttggtagcaaaagtcgcgatgctttttcggcacagacactgccctctgctaatccaatgcttgctcatggagacctctgaacttgatctatcgttacagagtaaatggtagcgatgagaagacgatctccttgacaactgttctatcatagacaatgtagggttctcgtataatatacagaaccaaacgattgaaaatggaggcgacggcatcatgcaatatcgaattcaactcgatactaaaaaccagttgtttgtggcgattgatgcgcatgaccagaatcattttggaactggtcgaacgattgaacaagccattcataatttaaaagcgacaaacaaagccgcataataaaaccccatccgtcgtcggcatgaacttaactgccaatggtgcggatgggggcttttttgtagtcgatactgaaaattagaaccttactgatagcgaaccaagtcgtggcgagtttttaaccagatagagaggagaatagcgacaagagtgaagacgccgatggctgcgatgatgaagagattgcggtagctgagccagtcgatgacaaggccaccaaaaagcggtccgagtgcacggccaacggatccccaggagtttacgaagccttgataacggcctttgatagcgcgcggcgtcagatcattgaccaaagcggggatagcaggagaagcggtggcttcaccggtggttagcgcgatcatggcgatgacgaagaagctatatgttcgcgcagtgatgaggatgaggaaggatatggcgaccatcaccaggccaaacaggatttggtagataatgcgaatcccattcacgtgttcattgaaccaattcaaaaagagttgaatgaccacaattagcgcagcgttgagcgtccataagaagctgtagttgcgcagtggaatgccgaggcttgtcatgtaaaccgataagtttgaagaccattgctggtacatcaaccaaaaaaccaatagcgcaaagaagaaagtcgtcagcatcaatttgtttgcggctggtaaagatggcttctctgctgttgtggtaacttcttttggctggtcttggggtatttttgcagctggacgaaactttgtgagcacgactgtgaagaataatgaatataaaatgacagcgattaaaaacagtaaggttacgctgatatcatagacaaatccgaccaaagccgttccgatcacaacgccgacattttgggcgaaatataacatggtaaaaacgtagcggccgtcttttgaacgtaaactggttccaagcgaattgaccatggtgatgttccaaccggatccgataccgaggagggttagccagatgcagtaggcaggccaaccatgccaaaaagtcaggccaatgagtacaagtccggtgaggccgacgccaaaaagggttaaccggtatggatccccttgatcgtacagccgtccgccaacaatgctgccgatgacgctacccagtgagttcagtaacaagacaatcccgatgaccgttaacgagatcccgagccgattatgtagataaatactggttagtggccagatgaaactcatcccgatgctacttaacagtgctcctgtaagcagccagcgtaacctgatttcgtgcaccatcaacattgcctccttacctgattaattatggccactgccgaatttgacaataacgcaataatctcatggtacgtcaagccttggcatggggtcaattgcgtttttacgaaaagtagcgttttgcactaacagagaaaatagccaatatggaacgataaaaaaacatcctcgcgcacaaaaacggcaaggatgttttctaattgacggattcaaaaatcattgagtgcgtggtacctattttgcttaacaaacgtgactaaagattcttgtccatgttgaaggtgagctttgataacttcaggctttccatgacataatcgttaattaacgccttagtcgctgccttagtgtgggcaacgattttatagttggcttcggttagatactgggtcaattctttggcgcccaattctttggcgccttcgtcaaaggattgaagcatttcgcgataatcgcgattgagtgctgtcagataatcgcgatcagcctgaatgaactgggggtaatgcgcttctaccaggacatcgagcaggcgatgcagccagtacgcggagtcagcgtcgagatcgaaggctttcggcgttttcgaatagctgggatccgtgtcattggcgttgcagtaaaacggtacatatggactgaaggtcggcatgccgattgccagccacatgatcgccgccaagccttcctgaacgtcactgcgtagttgcaagatgtgggaattttgggtgcgatttaagccgatcggacgatagcggaagcggtcggcatccgcaccgtggccataaggatcaaaaggcgtctcgttgtaatgactaccaagaatctgggcaatatcttcacgagtgatcagatggtcggtccgcatgataaacggtaagtcagctgattcaggatctgccgcgatttccggattgagcagcttgtgaccgtaccaaacccgcggcgtgttatagtggcgatctttttcattcatcgtgccgaaaatgtggcggaagttccagccttctttgtcggtattgagatgatggtcttcaacaaattcctgaatgccttcgctccaggcaaaattgtcggtgtcttcaaagtcgacctgctgaatggcaacttgattggccgcaatggcataagcgtcgtcagggatacgctgagcgacccagtgatggccagtgacgatttccatgtaccagacactgtctttgtcagagaacaggacagaattacctgcgggcgaaccgtattgtttgatcagctggccgaggtattcaacgccatggcgcgcggattcgatgaatggcagcaccatgttaacgatcagatcttcatcaagaccgtctttgacaagcggatcgaagcccagcgcccgttcattaccgtaagtactttcggttgcggacatcgcgacattgcgctcgttgataccactttcttcgtaatcgccgagcttatcgttttcgacattgggaacggcattatagcgataaccattttccggcaagtctgcttcaaacccattaagcggtgacttgacgtgtaatgatttttcgcctttccatccagcgtgcatatagaaccgttgcggtgtcaggggactaaacgtatcatcgttacgagcgatcatcgttgaaccgtcgatactggccttcttaccaaccagaatcgaagtgcatgcagattcaattttcattcttgcgcctcacttcttaagtattggtaacagtttacgacagaatcaatttttttgcacctccgtaaaaaaagtcgttgacaaccgcgcaaatcttttttaagatattattcgttgttaagttactgggtagtagcgaagtggtaacgcagtggactctgaatccataatcataggttcgatccctatctacccaatcctggatacgacaatcgcttatcgataagagcagaagccttgataaaaaggtttctgtttttttcgtttaccgtaaacaaggatttatttcaggaaattgagacatgattgagacaagcttcatgctcctgaaaatgctgttaggagccggtgagcacgtcatggtgatgttgcaagtcgcggatatactcacttttatcaaagccgctgcgtccatgccaaaaagccggcataagcaaagcaaatgcaggcatagattaaaaaagccgcaatcataaacgctaaccatggccaggttagaaacgctctggcgatgaataagaagaaagccatcaacaccgcgcgtaatccgcgggtaaagacggctttgacggcgctattcaaatgatacctcgatcagtaggcgcttagcctttgtcagatggctggtggtcatccacatctggttagtagacggggtttcaacgtcttcgcctagttcaggtagtagactcaatagccaggcgctaagctcggggttattgaaggaaaagtgttccggcaaccggatgacccgtaaccgattcggcgggaagaagagttgttgactaggaaagatcacgcggtcgtcgagcagaatgctggcgacgttttgatacgggacttggcggacgtgatagctttgcggatggtcgtgggcatatgccaggatcatgatggctgcgtcaatcaaaaaaaggcctccattcaaagatgcttacgcttttcatgataacatggatgaagatagcacgtgagccggtctattttcaaactggcgaaatatctggcgctggaccggcttgaaacaacaatgacgcaaatttataggagtgtcaaaatgaccaaaaggctatatttagtcagacatggtgaaacgccgatgaacgcggcgcggctactgcaaggaattacgaatgccaatttgactgcaaaagggcgagatgcagccgatcggttgggtgagttattgcaaccggtgccgtttgccaaagccttttcgagtgatcgaacgcggacgttggaaacggccaaacggattcttgccgggcatgaaccgaagccgccgttagtggcgttgtctgccttgcgcgaatattatttcggcgggttagaaggtgatccaggcaatgccattatggcacggacgattcgtcgttatgggctgacaacggcgtggcgggcttgggtcggatcaaaacgttttccgggattagtccggtcgattcgcaacgctgatccgacccatcaagcggaagatttccctgatttgttagcgcgcgcccgccaagcctttgagcaggtggatgcgcagagcccggatgacagcgatattttggttgtctcgcacggcttgcttttaagtgctttgatttatcagctggcacctgatcagttgccgttcagtttgttgaaaaataccagcgtgacgcgaattgatattgtgaatcagaaaatgcacgtccgtggcgtgaatctgacgcgagaacaggacattttggccttgcgccatgatgagccggaaactgatgatgccgctaaaaatgaagcgaaatgacgtcaagtttgctggacgattttgattccggtctgatttaaaatgtaagacgaaacggtaatttcggacctttgactgaaattatcgttttttgattgcttttttgcgcggctccgtctataatgacaccttgtcatatgacggattgtcacaaccgagtcacagttagtcgggctgagaaactcggagcagaaagggggtcgccatgccgaaagcaacattcttccgcttgccggaagcaaaacaacagcggttaatggatgcggcgtatcaagaatttgcccgcgccccatttaatgaaaccagtattagtaatattattaagcatgccggcattccgcgcggtagttactatcaatatttcgatgacaaggcggatctgtatttttatttattggaaaccgtgcggcaacggaccgttttgactttgcaacaggtcatgacgaagcatcacggcgatctgtttcctgccatgtcggaatttttcggcaaaaccatcacggcactggcacatgggccgcatgcggctttgtatcggaacgtttttttacacatggattttcatagcgccgccaaaatggccggatctaaggcgccgtttttaaagccgcatcatggtcatcaagaaatccatgatttcttattgactagcattgatcgcagtcggcttcgtattcagacagatgatgaggtcagtttactgattcgtcagattgtcggtatgttcatgcagacgatcgcctattattattcaaaccaggctgaaggtaagccgattacggtcgctgaactcaaacgacgcagcgatcagcttcttgactggttgcaatttggcgttgcccgtgataagaaacatcattaggccgcgcacaacaccggactgcctgtatgggtccgaaaagcatctgttaggaggaaattatgcttaaacttgcaaaaaagcgcatgtctggcatagccgttattggcgctattttgttcatgattgttcaggtgatgagcaatttatatttgccgaatctgacggccgatatcgttaacaacggggttgccaaaggtgatattgattacatctgggcaaccggtatgaaaatgattttgtttgctttactcagcattctcgctagtgtggggaacgtttttttggcgtcgcgcacatcgcaaaagctgggccaaaagttacggtcggacatttatcgcaaagtcattaactattcccatgatgaaatggataaggttgggacgagctcactgattacgcgaacgaccaatgacgtaacgcagatccaaaacgtctggatgatgatcttgcggatgatgattatggcgccgattatgttaattggtgccagtttccttgcctaccaaaagagtcacaccctgaccatggtttttctgatcagcttgccattgctggcgtttttcttgctgatcatcatgtattttgcggtgccgttgtttaaggcgatgcagaagaaaaccgataatattaatctggtgttccgtgaaggactcaccggtgtacgggtcattcgggcttttcggcaggatgattttgaacaaaatcggttcgaaggcgtcaaccaagactatacgcataatgcggtcaaagtcttctcgattattgcggcggttttccctgtgatgacgttgattatgagcggtacgaatatcgggattacttggtggggtggtaatttaatcgcccagcaagcactggaaaccgggaacctgattgcatttatgacttatgcgatgcagatcttgatgagcttcatgatgctgtccatgatttttgttttcattccccgggcgcaggcttcagcagcccgtctgaatgacgttttggcccaggaaagtcggatcaccacaccggcatcaccgaagacgttggatatcgctaatcctgacttggcattcgaccatgtccaatttcgctatcatcacgctgaagaaccggcgttgcgcgatattgacgttcatgttaaaggtggccagacaatggcgatcatcggcggtaccgggagcggtaaaaccacgatggtcaacctcatcccgcgcttttacgatgctgaaaaaggggcggtccgagtcgatggcgaagatgttaaaaacgtcgacttgaagaagctgcatgaagcggttgcgtttgtgccgcaaaaagccaatctatttaccggaaccgttcgtgacaacatgaaatacggaaatgaaaacgcgacggacgagaatatctggcatgcgctggatattgcccaagcccgcgatttcatcgaaagcaatcctgaaggtctggattaccaggtggaacaaggcggcggcaacttctccggtggtcagcgccaacggttggccatcgcgcgtgctttggtgaaggatgcttcgatctacgtctttgatgattccttttcggccttggacttcaaaaccgatgccaatttacgggcagcgttaaaagccgacaagaaaattcaaaccaaagtcgttgtgattgttggccagcgggtttccacggtcgccgatgcggacacgattgttgtcttggacgaaggtaaaatggtcggtagaggcactcacgctgagttgaaagcctccaacccaacttatcaggaaattatcaagtcacagattcgggaaggagacgagaaataatggcagacaatcaaaaatccgcaaccaagcggccatcatccggtccacgaatgaggccaggtggtcgagccggtctcgttgaaaagccgaaaaacttctggaaaacgaccgggcggctatttgggtatatgcgtaaccgcctgatcggtattatcgccgtgctggttctagccattgcctcaacggtttttcagattcgtacgccgaagattttaggtgaagcaacgaccgaaatctttaaaggtgtcatgaagggccaggcggagcaaaaagccgggatagcggtcggcagttacccgatcgattttgacaagatcaagcacattattctgatcgtgttgatcctttatctgggcagcgccttattcagcttcttgcagcagttcatcatgacgcgaatttcgcagaacacggtttaccagctgcgaaaagatctgaaatacaagatgaaaactgttccgatcaagtattatgatacccacagcaatggggacattatgtcacgggcgatcaacgatatggataatatcgcatcgactttgcaacagagcctcacgcaaatggtcacgagtgccgttatgtttgtcggaaccatttggatgatgctcaccatttcctggaaactgaccttgatcgcactggtgacgatcccgcttgggttaattgttgtcggcatcgttgctccgaagtcacagcgcttctttgctgctcagcaaaaggcactggggttattgaacaaccaagttgaagagacttacggcggccaggtcattattaagagtttcaaccgtgaagatgatgaggttcgcgactttgaaggccaaaaccaggcgttttacgacgcagcatggaaggctcagtttgtttccgggatcatcatgcctttgatgattttccttaataacattggttacgtttttgtggcgatcatgggcgggatcgaagtttccaacgggaccatcaccttggggaatgttcaagccttcttgcaatatatgcaacagttctcccagccaatctcacaactggctaatttggcgaatacgattcagtcgaccattgccagtgcagaacggattttcgccgtgttggacgaagaagatatgcaggacaatccgtccggtgtgccggcagtgccgaatgatccgaacaaattggtcatggatcatgtccagtttggctatacaccggatacgctgttattgaaggattataatctgcaagtgaagcctgggcagatggtggcgattgtcgggccaaccggtgccgggaaaacgacgattatcaacctgttggaacgcttctacgatatcagcggcggttcaatccggctgaatgggacggatacccgtgacatgaaacgggaagatgttcggtcgcattttgccatggtgcttcaggatacctggctgtttaccggcacgatttgggataatctgaaatacggtcgcgaagatgccacggatgatgaagtgcttgccgcagccaaggcagcgcatgttgataactttgtgcgccagttgccggatgggtacaatacgatcctgaatgaagaagcctccaacatttcccaagggcagcggcagttattgacgattgcccgggcgtttgtcgcagatccggaaattctgattctggacgaagcaacgagttctgtcgacacgcgaaccgaaattcatattcaacacgcgatgaatcgcttgctgaccgaccgaaccagtttcgttgttgcccaccggctatcgaccattcgtgacgccgacaatatcatcgtgatgaatcacggctcgattgttgaaaccggcaaccacgacgaattgatggcgaagaatggcttctatgcggacttgtacaacagccaattcagtggcaacgttgcaatttagttttcttatgaatcgtgattgtgctgcaggttaaagtttaactggatgcgattaaaaaaatagcctcagagagacgaacatgatctccctgaggttatttttgtacataatcgtggctgtgctgattaacgccgcttgtgacgcatgaaggtcgcataatgcagcaaacaagcgagtaggacgaagaagatcacgacaaaactgacatagcgccaccagaaattagtcgccactcccggtaaaacttgctgaatgcccatggtggccaaggccatgatcgcaatcatgccaaacaataatatgtaacgtttcaaagtctcatcatccttctttttaaaagtcgcgagtttcgtgcccagtgcgtgcgcctgattgattttggcttccggtaaggtcgtcatgccccaagtatgcgggagtaccaattcggcaatcttatggacaccagccgccgtcattgccttgtcaatcgccaccaaagtagcgtcggtttgatgcgtaaacgtgttatccagaccggttgcgaaacagctggtcacactgacataatgcttatccttgaaaatgccgggcagcgtatcgccttctttggtcatgcgtgtcatccggtgacgcatgcagtcgagcagttgcttgaactgaccggcgaccgtaccgaagtaggttggggtgcctaaaacccacacatcggcgctttttagcttggcttcaagttcgtccagtgtcgggttggcctgatcagaaacgtccggccgaatctggtattgatttaaatcaacaaattcagtggtggcaggcgcagtcacgctcgataagacggctttaaccaaacttgccgtcagccctttggcatcctgtccaccgtatatacctaatattttcatgtaaaacaaacctcccgagcgtgaaccggcgtgggtagaagccggagtgtaagtggccttgggcgtgatggtcggtctttgaccaatgcgaccaaggtccttacgcgcaggcttctgcgccggtgaacgcgttatgatggagcgtgaacccgtttcttcaccgctttttcgcgcatccccaccatctataactgtaagaaaaataacaagacttggcaagcgcatttattagtcataaccagcaaggaaaccaccgttgtttcaaatcacaagctttttgttggcaaaaaatgacctgactcattatgctgttggcaacaggccgaattgggaagctggaactcaatcggtgcttaaacagacaaggagcggatgaacatggcagggattgcattgccagaagaaacgcgtgtggattttattgcacttaaagttgctaatttggccaaggtgagccaatggtatcagcaggtcgccagattggatttgttgcgccaaaatggcgatacgatttatttgggaacccgacttaatcaacaggttttagtcgtcttgcatcaaattaagggactctcaccgcagaaaccggtgacgggattggatcattttgcgattttgctgccgaatccaggggcattgggagcggcgtatcgaatcgtgaaacaaggtcagccagtgacgaaggcctttcaaaccggttatcagcaaggctttttggctaaggatccggaaggcaatggcgttgcgtttacgattgatcgcgcgattgagcagtatcaagaggaacgacagtacaattgggaagatgaaaccgaagaagccattgatccggctgaaatcgggaagcatgcggcgcgggattacgatcgattgccttccgggacgaccattggttacgttcagtttcgggtggcggacttggccagcaccagtcactatctggaagacggactcggttttcgggaaaagcctagccccaataccggcgaagtctttttggccgcaggtgattaccgccatcacattggtattaatttgcggctagaagcgacgttattactgccgacgcctgatatgtacgggttggattatgtgagttttattttgccagacaaaatggcgatggagaatatcttgatgaaccttgatgcagccgggttaacggactacgattatcatcatgagaatcaatttttgatgattgccggtcccaatcggctcacgctgtggttccgcgtggcgtagtatggtcgtgactcggcgtcgggaagaaggccagaatggattttcaagcgatcacggcggagctgcaggcgtgggtgaccgggcggatcatacccggatttagtgtggcgcttatgacgggaaaagatgtgcaaagccaggtgagcggcgatgcgcagtggcaacccacgccagcgccgttgcggccggggatgctttatgatgtggcgtccctgacgaaggttatcggcaccaccaccgtctttttacaggcctgggatcagaaactggttgcgccggagatgccgttgaaacggtttttgccggcgtttccgcatgccactacatttcggcaggcattgacgcatacgtctgggttggaagggtatattccgcatcgtgatgacttgccggcgccagcgttgaaacgcgccctcatgacgcaattggccgtcacagatgaagtcgatgctaaagtggtttatcgggatgtgaatttgttgctggtcggttgggccttggaacagatctatcaccaaccgattcaaacacttatcacgcaacaggttctgcgtccgcttggtttgcccaaagcaacgtttcaaccggatccggaacaatgtgtgccaacgacttacgatccggttgccggcttgcggcgcggggtcgtgcatgatcccaaaagtgccatcctcggtcagcatagcggtgcggccggcttgtttgcgagcctagccgacttggagatgttcacgcaatacttctttgggcaaaagcaggcgtcggcgtggcccgatcatgcccggcagctaacccgtgactggacgacccatcagctcggtcgcagccttggctgggatcttcggcatgatggccagggacggctgtggctgtaccatacgggctatactggtactttctggctcattcagccgcaaagtcaactggcactgatcgtgttgacaaaccgcgtccatccgcagcctaatcgcgagtttctgggcaaacgcgaccaactcgtgcaacgctttttggcggatcagccagatacagggacagccgagtcctgaacgaaggaagaataactggccaatcgtggcaaagcagcaaaaaaacaggaccctttgacagtcaggtcctgttttttgatacaacgatgcggcttgtagattcaacttaaaatcccgccttaatataaccgccttcactcaacttcttgcgcaactgtaacattgccgtataagttgacaaaacgtaaagttgcttctgcggcattttttgcagctccgtgatgacgtcgctaaggtccggttgagtcatgagcttggcttccggaacgccggcgactgtcagccgcaatgcaatatctttgtagcgctcgccgccgaccagatatgtcgcggcttttttgctggcaacaaaatcttcgaagttcccatcccaaatccaactggtatcgataccatctgcataattggcattcagcagcatggcaaacccaaaaggctgcttcgccgtttcgatcatactgagcacctgattcaagccgacaggatttttgaccagaatcaaggttaattttttatcgccaagttgaatgacttcctggcggccgaaaactttctcgtcataggcgaacgcctggctgatttgttcaggactgacgccaaaagtccgaccaacggcaaaagcggccaaggcgttgtaaatgttgtacgtgccgccgatatcaatgtggcaaggctgaccgtcaatgacgaaatcgctgctttgcggcgtcattttggtcacggtgttcacctgatacttcagttgtggccgtttgaagccgcagttagggcagaaataattgccgaggttagcgtaagtgatggcgtgataatgtaagatatgttgacagaccgggcacaagacgccatccgtattcggcggggctttgtgatcacctgcgtcagtcaacgtaaagccgtaatagtgaaccggattcggcaacttacgggaactgaagatcggcgcatccccgttagccagcacaacagctttaggatcaagggtgacgccgtccagaattttttgataggtcgtgtagaattcaccataacgatccatctggtcacggaagatattggtcagtacaaaagcttttggctttaactgggcagctaccgaggcaacgttagcctcgtcgacttccaggaccgcaatgcctcggccatgtccgtgtttgggttgcgccaagaaagcggtggtgatgccttgcagcatgttcgagccggtgggattggtcaaaacttcctgatatttttgcttgagtactttgacgatcaagctcgtcgtcagggttttcccattggtaccggtcaccacgatgacatcatagtcacgacctagcgcctgcaaaacgcgcggatcgattttattggcgagtttgccggggaggcttgacccgccttttaaaaatgtgtgtaagaaccagtagctgctgcgaccaatggcagttgccagactggcttttgctgaaaatgccacggcgttcttcctctcaacttaatgggactattttagcataaacgacaagcaaaccggcagtcacggtgttctttgcgaaaaaaatccgttatactgtgagctgtgagattttagatggaggcggcacatggcccagcttttctttcgatacggtgcgatgaactcaggtaaaagtattgaaatcctgaaagtcgcgcataattatgaggaacaaaataaacgggtgattctgatgaccagcgccttggatgatcgagccggcgttggtatgattgcgagtcgcattggttttgaacggacagcgattccggttaagcatgaaaccgacttgtatgaaacgatcaaggaaactgatccgcacgcggcctgcgtgctgattgacgaagcccaatttttacaaaaacatcacatttttgaggctgcgcgggttgtcgatgaattgcatattccggtgatggcatttggcttaaagaatgactttcgcaatgagctatttgaaggttctaaatacttgctgctgtatgcagataaaattgaagaaatgaaaacgatttgctggttttgcgccaaaaaggcaatcatgaacttgcggattcatgatgggaagccggtttatgaaggtgagcaggttttgattggcggtaacgagtcgtattaccccgtttgccggcatcattattttcacccgccgttagataagatcgagcatcaggattagtgagtagttgctggcgttgcaccagctcacgctcggctataacgcgttcaccggcgcagaagtctgcgtgtaagggccctggtcgcaatggccaagaccgccatcacgcccaaggccatttacactccgacttctaaccgcgccagttcacgctcaggaggatttttatggataagatttttgaacaactcgacggtcttttggatcgttatgatgaattagaagaattaatgtcggatcccgaggttattagcgacacgaagcggtatctggctttgtcgaaagaagaaggcgggatgcgggatgtcgtggctgcctacaaaaggtacaagcaggttttgtccgatatcaaggaaagcgaagaagtgcttcgtgagagtaaagacgaggacatggaagcgctagctaaagaagaccttgacgatctgcaaaagcaaaaagccaaccttgaagataagatcaaggtattgatgctgcctaaggatcctaacgatgacaagaacatcatcatggaaatccgtggggctgccggtggcgatgaggccagcctgtttgccggtgacttattgaatatgtatatgcactacgctgaacggcaaggctggaaagcagaaatcattgattcgacgccgactgaagtgggtggctacaaagaagttgtcgtcatgattactggtgacaatgtttattccaaactgaagtatgaaaacggggcgcaccgggtacagcgggtgcctgtgacggaaagtgccggccgggttcataccagcacggcaaccgttggcgtcatgcctgaatatgatgaagtggatctaaaaatcgaccctaaagatattcggacagacgtttaccgctcgtcaggtgccggtggtcagcacgtcaataaaaccagttcggcggtgcgaatgacccacattccaaccgggattgttgtgtcaatgcaggatgaacgcagccagcaggaaaaccgggcgcgcgcgttacagattctgcgctcgcgggtttacgactattacgaaactgaaaatcaggaaaagtacgatcagacgcgtaaaaatgccatcgggaccggcgatcgttccgagcgaatccgcacttacaattatccgcaaaaccgggttacggatcatcggatcggcttgacgctgaataaattggatcgcatcatgaacggtgatcttgacgaaattatcgatgccttgatcgttcacgatcaggcccagaagatggaatcgcttaatgtctaaaacatacgctgaggcgctcaaatgggcgtctttgttattgacggaacaccatgttgatcctgatggggcgcggtatgtcatgatgacccgggcaaactggaccccgagtcaattaattttgcatcggcaagacgtgatgcccgatgcatcatggcagcaatttcaagcagatgtcgcccggctagcaaaatttgaaccggcgcaatatatcaccggtgtggcgccgttttttggtgcgatgtttaaagtaactccggcagtgttgattccgcgatttgaaacagaagagctggttgattgggtcgcaaaagagcagaccgccgcccgaaccggtttagatttgggaaccggtagcggtgcgatcggcattaccttggctcgccagttgccacaagtcgcgatgacgctaagtgacgtgtccgaagcagcgctagcagttgccgagcagaatgcccaggcgcaacacgtgcaggcacgatttgtgacgagtgatttatttagtcacttgctgggccgttttgattttgtggtcagcaacttgccatatatcgcacctgaagaaacacccgtgatggatcaaagtacattgcgttatgagcctaagttagccttgtttgccgatcatcatgggctagcactttttgaacggtttgtcgcagcattgccggctcatctgaatgaccatggagccgcttatttagagttcggttaccggcaacaaccggcactgcagaagttatttgcggaaaaagtaccacaagcgcaggtgacttttaggcaggatatggccggtcacccgcgtatggccaagctgcaattttaggcgttttccgataaggatttggagcgaaagcgattctttgggcgttacgcagcaacagacaaaatatggaggcaggaaaatttgtcaaaacgttatcatgaatctgatattccggaagccgccgctgctttaaagcgcggcgagttagtcgcgtttcccactgaaacggtgtatggcttgggtgctgatgcgaccaatgtggatgcagtgggcaaagtctatgcagcaaagggtcggccttcagataatccactaattgtgacggtggcggatgcggcgatggtcgggcaatatgcgacgattacccctgcagcagctaaactaatggcgacgttttggccggggccgttgacgatgattctgaatattttgcctgggcgcttgtccatgaaagtgacagggagcttgcagacggcggctttccgcaacccggataacgccttgacgcgtaagttgattgcgactgccggcgtgccgattgtcggtccgtcagccaatacttccggcaaacccagcccgaccacagcggatcacgtgctgcatgatttggcaggcaaaatcgccggcgtgctcgatgacgggccaacccgggtcggcgtggaatccacgattgttgatttaaccgtcaccccgccagcaattctgcggccgggtgcaattggccctgacgagttggagccgattttaggaccagtcgattcagcgattcatcacgtcggtaaaaatgaagcgcccaaagcaccggggatgaagtacaagcactatgcgccgtctgctcaagtggtggttgtcgatgatccgggccagtttcccgaagcagtcgaatgggctaaaaagaccggacagacttttggcattttggcgactgatccgattcttgccaaattctcggcggtaccgggttattcgttggggcaggacattaaaagtgcgactcatgacttgtttgccgggttgcgttggttcgatcttcatccggatgtcacacttgtgttggcgcaggcattttcccatagtgaattaagcatggcttacatgaatcgtctgcttaaatctgccggtaatgtccactatcaaccaaatatgcctacagattcgttttgatttgctataataaggccaactgaccagtgagtgtcagttggccttatttggattcgtgacgttaagccttgtacaatgaggtttttacggcgtacacgattgcaaaaggggcaggtcgtaagttgggtactaggaatgaatgcattcaagaggagagtggtagacatggatttcatggcacaagacccagaagtcttcggcgcaattcatcatgaagaagagcgtcaggagcataatatcgaactcatcgcctcggagaacattgtttcaccggcagttcgcgctgctcaggggtcggttttgactaacaagtattccgaaggctatcctggccatcggtattatggcggtaatcaatacatagacgtggtcgaaaatctggctattgatcgggcgaaaaaactttttggggcagagtttgccaatgtgcagccgcattccgggtcacaggccaatatggcagcctatcgtgccttcttggaagatggcgataaagttttagcgatggacttgaccgatggcggacatctcacccatgggagtccggtcagctttagcggtcaggagtaccatttttaccattatggtttggatgccaagaccgagcgcttggactacgacaagattcgggcgcaggcggaacagatcaagccgcggttgattgtggccggtgcctcggcttacagtcgcgagattgatttcaaaaagttccgcgaaattgccgatcatgtcggtgcctttttaatggttgatatggcgcatattgccggattggttgccggtggggtgcatatgaatccggtgccgtattcagacgttgtgacgaccacgacgcataagacgttacggggaccgcgcggcgggatgattttggcaaaagctgaatatggtaaagccattaattccgctttgttcccgggcattcaaggcggcccattggatcatgtgattgccgccaaagccgttgcgttgggcgaagcattgaagcctgaattcaagacctacacgcaacaaattctcgataatatgcaggccatggtcgccggctttgaggaagatccacatttacggttgatttccggcgggtcggataatcacatggtattaattgacgtcacgggttatggcgtcaatgggcggcaagttcaagatttattggacgaagtggacattaccaccaataaaaaccagatcccgggtgagcaaaacggcccgttcaaaaccagcggtatccgcgtcggcacagctgccatcaccacccgcggctttacgccagaagagagcaagcgggttgccgaactcatcagtgcggcaattgcgcatcgcgatgatcaaccggctttggatcaaattcgtcaagaagtccttgcgctgacggcccgtcatcccttatcatagatagggtttgcaaacaaatggctcacacaggaggcctcgcatgggtaaatttacagttttaaatcacccgttgattcagcataagcttactttgattcgaaataagcatgccggcactaaggaattccgcgaaatcgctaacgaaatcgcggaattaatggtgtatgaaatcacacgggatctgccattggaaagtgttgagatcgaaacaccgatgggtaaaacggttcaaaagcagctttccggtaagaaacttgcggttattccgattcttcgtgccggtttgggcatggtggatggcgttttgcgccttattccagcggccaaagtcggtcacattggcatgtaccgtgacgaaaagacactgaagccgcatgaatactttgttaagatgccgccggatatcgaccagcgggatttaatcattgttgatccgatgctggcaaccggtggctcggccaacatggcgattgaagcactcaaaaagcgcggggcgacatcgatgcgcctcgtggtactggttgctgctcctgaaggggttaaagccgttcaggccgctaatccggacgtggacatttatgccgccgcgctggatgatcatttgaatgaaaacggttatattgtgcctggtctcggcgatgccggcgacagactttttgggacaaaatgacatgaattggcatgtggtcacgcacatgcctttttcatttttagttaaaagattttttgtgggtgcattaagacccgtgaaaaccgtggccgccgtgaaaaaatcagtgaaaaagcctttatgacggccaaagtttctctttttagtgctttgttttttcactgaaatggtgttagagtaatgattgtgtttcaagggtctaccctagtaaccaacgattatcgaagtctctgcaatcttgccccatcttttcgatggtacacatgatatgaagccacttcagtaaggaggtgaattctgtgaacgaacaatatccctcgatcaagcttttcggcttaactttcaacctgaccaacgacattggtgttttggtttcggcagttctggtattcttactggtgctatggctgtcacgaaacctgaaaatgcggccaggtggcaagcagaacgtactggaatgggccatggactttacaaacggtatcgtcaaaagtgcgatgcccggttcggagcgctacacgtttaatttatttgcgtttacgctcttcctgttcatttttattagtaaccaaatcgggttattcatcgagttagatattggtaaagatacttggttccgctcaccaacagcatccccggtgattaccatgacgatggcgatgacagttctagtgctttcgcattattttggcgttgtcttcagaggtttcaaaggttacatcaaaggatatgcgtcaccggttccgattctcttgccaattaacctattggaagagtttacgaactttatcacgctttctttgcggctttatgggaatattttcgctggcgaagttttggttctattaattcggcagtgggccttttccggcggtgcactcaactttgttagtgcaacggtagccgagatagcttggcaagggttctcagtcttcattggtagtattcaggcgtacgttttcgtcacgcttggtatggtttatacatcacacaaagttctacccgagtaactaatttaggaggaaatttcttatgcaatttttagctgcctcactagccgccggcattgctgccttcggtgcttcaatcggtaatgggatggtcatcagcaaaacacttgaaggtatggcgcgtcagccggaaatggccggaaccttgcgtggtaccatgttcattggtgtcggcctgatcgaagctgttccaatcctgtctgttgttgttgccttcatgttgatgctccgttaattcagttcatcaataaagaagggagtggcaaaagatgagtttaggtgacacactcttcacacttgttacatttctgatcttggtgattgcagtcgggaaagtggcatggaagccagttaccaaaatgatggcggatcgccaacaaaagatttccggcgacttggactatgctgaaaagtcccgcaaagaggcagaaactttagcagccaagcgacgggaagaactgcaacactcccaggctgatgctgtcaagattgtcaatcaagccaaggaaaacggcgagaagcaacgacaatcattggttgacgctgccaacacggaagtcgccacgttgaagaaaaatgcgcaagcagacattgaccaagcccgtaaagatgctttggccagtgccaagaacgatgtggctgatttaagtctgacgatcgcgcagaagttgatcggtaaggaacttaatgcggctgatcaaaaagacttgatcgacgactacatcaaacggttaggtgatgcaaatggcagtcactaatcaaatggttgcaccgcgttatgcaaaagcattactggaagcagctcatgaccaggatcaagtagcgacagttcatgaagagttacaggcgctagcgtctgtattcaaagaaaatccgacgatcctgacaatttttgataatgcccgaattacggcagatgacaaagccaacctgatggcgactttgaccaagaatgccagtccgcttgtggccaacttattgaagttaacccagcaatatggtcgattcggtgcattgccggatatcatcacggcgttcaatcgcgcttatgatgatgaagccggtattattacagcgactgttacgactgcagttgctttgtcagcagaccaagccgatgccttgcgcagtgccattgctgcgcgttttggcatgaagtcgacgcaactggaacaaattgttgatccaagtgtcatcggcggcgtgcgcattcaagcacacgggtcggttatcgatggaacggttaaacaccgtttcgagaagatgaaggcagcactgctggcagattagagataagtaaagaggtgaaccggatgagcatcaagactgaggaaatcagttctctgatcaaaaaacaacttgaaggatatcaagatgatttggcggccgaagaagttggcaccgttacttacattggtgacgggattgcccgtgccactgggctggaaaatgccatggccaacgaattgctccaatttagtaatggctcatacgggatggcgttaaaccttgaaacgaacgatgtcgggatcattatcttaggtgacttcgatgagattcgcgaaggtgaccaggttaaacgaaccggtcggattatggaagttcctgtcggggacgccatgattggccgggttgtcaattccctgggacagccagtcgatggcttaggcgcgatcaagacggataaaacccgtccgatcgagtttaaggcacctggcgttatgcaacgcaaatctgtatccgaacccttacaaaccggattaaaagcgattgacgccttggtaccgattggccgtggtcagcgtgagttgatcattggtgaccggaaaaccgggaagacatccattgcgattgatacgattttgaatcaaaaagatcagaatatgatctgtgtttacgttgcgatcgggcaaaaggacagtacggttcgtgcccaggtcgaaacgttaaagaaatacggtgcgatggattataccatcgttttgacagctggcccttccgaaccggcgccgatgttgtatattgcgccttatgccggtgcggccatgggtgaagagttcatgtacaacggtaaacacgttttgatcgtgtacgatgatctaagcaagcaggcaacctcttatcgtgagctgtccttgctgctccgtcgtccgcctggtcgtgaagcctaccctggggatattttctatacccacagtcgcttgttggaacgtgctgctaaattgagcgataaactcggcggcggttcgatgacggcgttgccggttattgaaacccaggctggcgatatttcggcttatattccgactaacgttatttcaatcacggatggacaaatcttcttacagagcgacctgttctatgcaggtacacggccggcgattgatgctggggcttccgtttcccgagttggtggggatgcccaggttaaagccatgaagaaagttgccgggacactgcggttggatcttgcatccttccgtgaactggaagctttcacccagtttggttctgacttggatgctgctacccaagccaagctgaatcgtggtcggcgcacggttgaagttttgaaacaaccagtacacaagccattgccggtcgaaaagcaggttatcattctttatgctttgacccatggctttcttgatccgattccaatcgaagacatcggccggttccaagatgaactgtttgatttcttcgatagcaatgcggctgatttgttaaagcagatcaaggataccggtaatttaccggacaccgataagctggatgcacagatcaaagcctttgccggtggcttccagactagcaaacaacttgctgctgctaaaggttaaggaggtgccgcatggctgaatcattaatggatatcaagcgcaagatcgcttcgaccaagaaaaccggtcagatcacgcaagccatgcagatggtttccggtgccaaattgagtcagatcgaaaaacgggcccgaaaatatcaactttatgctgataaggtccgtcagattgtgactcatttagctgcgggacaacttcttgagttagctaatgctgcgaataatgatgctgaggcgaataagaatcagcttgtttccgttgccagtttgctcgagaagcgtccggttaaaaagacaggttaccttgtgatcaccagtgatcgcggattggttggcagttataacagtacggttttaaaagcgatgatgcagatgatcaaagacgatcacgaaggcccggatgattatgtcatgatggccattggtggtgtcggcgcggactttttcaaggcccgtggtttgaatctagcttatgaataccgtggtgtttccgatatcccgacttttaacgaagttcgtgaaatcgtgaaaacagccgtgacaatgtatgataatggtgtgtttgacgaactttacgtttgctataaccaccatgttaatacgttaacttctgcttttcgggcggagaaaatgctgccgatcagtgacttggacgtcagcgaagttgaagacaccaacgttgagtacttggttgaacctgatcttgacgctgtcttggatgcagtcttgccgcagtatgcggaaagcctgatctttggtgcgattatggatgcgaaaacggctgagcacgccgcatcgacaaccgccatgcgcagtgcaaccgataatgccaatgatttgatctcgcatctgtcgacccagttcaaccgggcacggcaggctgcgatcacgaccgaaattactgaaattgtcggtggtgcggcagcactagaataaacaggtgtgagctggctcgtgaatgggtcggcttgcgcttaccataacgcgttcgccagcccagaaacctgcatgtaaggaccttggtcgcaatggccaagttcgggccatcacgcccaaggccacttacactccggtttctaaccgggctggctcacgctcaaggaggacgaatatgccaaatgcaactggtaaaatcgcgcaagtgatcggtcctgttgtcgacgtagcgttcccaatcaatgacaatttgccagaaatcaacaacgccttgacaattacccgcaaggatggctcccagctggtgctggaagttgccttggaactgggtgatggcgtcatgcggaccatcgcgatggattcaaccgatggcctgcagcgcggcatggcagttcaagatactggcggtccgatttcagtgcctgtcggtaaagacacactaggtcgggtgttcaatgtattgggtgaccccatcgatggcggcgaagcttttggaccggatcatcggcgtgacagcatccaccgtgatgcaccaaaattcgaagatttgaataccagttctgaaattctggaaacgggcattaaggtcatcgatctgctcgaaccctacctgcgaggcgggaaggttggactcttcggtggtgccggtgtcggtaaaaccgttttgattcaggaactgattcataatatcgccgaagaacacggcggcatctccgtcttcaccggggtcggcgaacgaacccgtgaagggaacgacctttactttgaaatgaaggaaagcggcgttctggagaatacagccatggtctttggtcagatgaacgagccgcctggtgcccggatgcgggttgccttgactggtttgacaatcgcggaatacttccgtgatgtcgaaggtcaggacgtcctgctatttatcgataacattttccggtttactcaggctggttccgaagtttctgccttgctgggccgaattccgtcagccgttggttatcagccgacactggcaactgaaatgggtcagttacaggaacggattacatccacgaaaaaaggatcggttacttccattcaggctatttatgtgcctgccgatgactataccgatccggcgccggcgacaactttcgcccatttggatgccacgaccaacttggaacggcgtttaactgagcaaggtatttacccggctgttgatccgctggaatcttcttccagtgcgttgacaccggaaattgtcggcgaggaacactacaaagtggccactgaagtgcagcgggtcttgcagcgttatcgtgagttacaggatatcatctcgattttagggatggacgaactgtccgacgaggaaaaggtgattgttgcccgtgctcgtcgtgttcaattcttcttgtcacaaaacttcaacgttgcggaacgtttcaccggccaaccgggttcatatgtaccggttgaagaaaccgttaaaggcttcaaggcaattctggacggcaagtacgatgactatccggaagatgccttccgttcagtcggccgcattgaagaagttgtcgaaaaggctaagaagatgggctttgctcctgatgaacaggacacggatgctgacgaaaagccagctgcacaagctgcagctaactaaggaggcgacgcgttttggcagaaacgagcaatgttcttcgtgtcaatatcgtgacgcctgacggtttggtttatgaccatcatgccaagatgttggtggttcattctgttgctggcgaattagggatcatggccaaccatgagccaatcgtcaccccgttagcgatcggggaggttgacgtacaacgtgttgactcaagcgatcataacgattcaattgcggtcaacggcggcttcatggaggtttcggataacgtcgcctcaattgtcgctgactcagccgaacgtgaacgcgatattgacctgagtcgtgctcaagcagcacgcgatcgggctaagaagcggatcgagcaggccaagaatgaaaacaaccaagatgatctgcggcgggcgcaagtcgcattgcggcgcgccatcaaccggatcaatgttaaaaccagtcattagactcatgaagaacaaaaaggtactggaggcgattttgcctttagtgcctttttgtttgtgagcgcgagccggcgcggttagaagtcggagtgtaaatgtccttgggcgtgatggcctgggcttggccattgcgaccaaggtccttacacgcagacttctgcgccggggagcgcgttatgaaaaagcgtcagtttcagttaggcggacataactctgctaggtcaagcgctcctgctcacgctcttgcatgaatgccgaaagtgcgggaagatagcgtatgaggtgatcgcatgtttcaggaaatcggcctaaatgccgccataacactcgtgtcccactttgttttcatcatgttggcattccgggcattgaatgcgctgcgttttgagcggttcattaaggccaaccatgtccgtgaagcgcaagtattgttgcttttcatggccgtcgggttaggttatttggttagctccttctttttatcgctcgttcaagcagctttaaacttacctaaacttttcctataaaaacctcgtcttaactatgttataatgcgatagttagtcaatttacgaggagagatatatacccatggcaaaagatattgggatcgacttagggacagccaatgtactgatcaatgttaaaggcaaaggcatcgtcttaaatgagccgtccgttgtcgccattgatacccataccggcaaagtattagcggtggggacagaagcctataaaatggttgggcgcacaccgggtaacattcggtcaattcgaccactaaaagatggcgttatcgctgatttcgacattaccgaagcaatgcttgaatatttcattaacaaattaaatgtaaaaggcgtgttttccaaacccaatattttgatttgtgcaccaacaaacattacggacattgagcaaaaggccatcatccaggtggccgaaaaatccggtggccgtcatgtctaccttgagttcgagcctaaggtagcagcagttggtgccggtttggatattttccagccgcaagggaacatggtgattgatatcggtggtggtaccagtgacatcgcggtactttctttgggggagattgttaccagtcgttcactgcgtttagcaggcgataaaatggattcgtcgattgcagcttatgtgaagaacaaacacaagctgattatcggcgagcataccgctgaacagattaaaatcaaaatcggcgcggtttacgacgccgatcctaaagaaaccattgaagttcgtggtcgggatatcgcaaccggcttgccgcgtgaggtttcggtgacttcggaggaagtttctgacgctttgcacgaaaccatgatggcgatcatcgacggcgctaaaggtgtcttggaaaagaccccgccagagctttctgccgatattatcgatcgcggcattatgttgactggcggcggtgcgttattgaaaggcatctcccagttattcgccgcggaattgaaggtgccagtgctcttggctgatgatccgttagacgcggttgctttaggcacaggtgtcttactggacaacatcgaacatcatcggcagtattaggagttagcttatggacccggagtatccgaaacgcatttttcatcacattaaaatttggttgatcattgcggcgattgcgttgattttaggattgctgatcggttttggtatgggcggcagcaatccgtttaaggtttttttgccgtcgacgtggatccatttctttaatttcctgcgttaggagtggacatgaagcaaatcctgacctggctggtgcggggctaccagcggtttatttccccgttgttgccgccgagctgccggtattatccgacctgttcgacgtacatgattcaggcgttgcagcgacatggcgccattaaagggacgctcatggggattgcccggatcttgcggtgcaacccctttgttaaaggtggacttgatccggtcccggcttatttcacgttgcggcgtaatccgcatcctgaaaatgacttggatctcagcgatattcaaaatcttaatcataagctaggaggccatcatggctaaagaaagaaacatcaaggtcacccaaacggatgaaacccgcaatggccacacggtttcggtgttaaaaatcggtgatcaggaaattgggtttattgaaccggatggcacccggtttgctgcttacgttgccggttcagacaagccaaatcgctttaaaagtatggatgacgctgtcaacgcgttgattgcggaatatcatttgcatcagggttgacgcgatttggcagaacgcaaactgggcgagctcctggcccagcgagtgttttttaaaatagtgtataaaccaggagcttcacaggaggtttgccgtggaatcgcacgaaattaaatcaaattctgaaggcgatcgcatcgactacggcatcattttgtcagtcatgctgctggcgctgattggtttagtgtcaatttatctggcggcgtctcatgatggttcgacttcgcagaatccggtcagggccacgattatgcaggcagcctggtacgcgattggtggcatcgggatcttcttcgtcatgcggtttgatgcagaacagctgtggcgaattgcgccttatttgtatggtatcgggatctttctgatgatcgccgttttgattttttatgatcgggcgactgagcttaataccggtgccaaaagctggtttgcacttggaccaatcagtttccaaccttcggaaatcatgaaaccggcatatatcttgatgctaagccgagtcgtcacccagcacaatgcagcttattcacacacgatccaaaacgattggaaattaattggccgcatggtgttgtggacccttccgattgccgtcttgatgaagttgcaaaatgacttcgggacaacgctggtctttctggccatttttgccggggtcaccttggtggcgggcattaattggcggattctattaccgattgccttaggcgcagctgcacttggaacactggccattttgctggttacgcagtcgtggggccggtcgtttctcggctcaatcggcttcaaaacgtatcaatttgcccgaattgattcatggctgaacccgtccggcagcaccagtggcgatagttaccaattatggcaatcgatgaaggcgatcggttcaggacaattaaccggaaaaggcccgttccacatggccgtcgcggtgccagtgcgggaatcggacatgattttttccgtgattggcgaagcattcgggtttgtcggcgcagcggtgctgattctgttatactttatgttgatctatcagatgattcgggtcacgtttgataccaagaacgagttttatgcttacatctcgaccggtgtcatcatgatgatcttattccacgtgtttgaaaatattggcatgaacatcggcttgttgccactgacagggattccgctaccgttcatttcacaagggggttcattcctgcttgcaaatatgctatcggtcggcatggtcctctcgatgcgctatcaccatacaagctacatgttcagccgcgacacagaagattttgaataggagcgagaaaatggcaacgacttatttttggcaagacgaactggctgcgggtcaggttcgtttggggttaacccaggatgcacaggaaacgttaggtaaaattaaatttgttgatttaccgcaagttggcacaagtttaacgatgggcaacccgtttttgagtgtggaagcggaaaaggctgtcctcgatcttgaggcaccgctggccgggactgtggtagatgttcaccaagaacttagtgacaaacctgccttgttagacgaaaccgatcataatcacaattgggttgtgactgtttcagccaaataaccctgacaacctttcagcagcttgacaggtgcgcggtgtgtacaatttaaaaagcagctgacatcgacatgatgcctagctgctttttaaatttctgatggtgcaagtattagttgaagaaccgctttgccatctcctgataggttttgatggcagtcgtgtagctgtctaagtcgacgtgttcatcgacttggtggctgaaatgattgtcgcccgggccataaacgatgacgtcaaagtggttgtcagaccgaatgaattcagacgcatcggtgccgccgtaagctactgcaagtttggctggcgtaccggtgacagctgcaattgcctgattagcagtggtgacaaggtgaccatttttgtcggagtgcactggcaggaatctgtgtaaaactttgagcgttaatttggcagacgtagcttgattagcctgatcgactaattgcttcagcaggtcaacaactaagtcaatattggcagcaggagttggccgcaagttgccgcgtagataggcatgggcaggaatcgtgttgacttgatcgccaccgttgatcaccgtgattgaatgccgaaagacgcctaagtccggatcgtccggtgcttgatcaaaggcagttggctctcgttcggcaaaggccactaatccatcgatggcgttgacacctttttccggtcgcgaactatgaaccgagacgccttcactatcgatttcgtagttgacggtcccgccatgcgcatactgcagcaatttgtcagttggttcgccaacaatcaagcctgccaaatcatcggcatagccttgctcagtgagttgtcgagcgcccatcgcgccaaattcttcaccaaccgttgccatgaaccgaatgtgatgtttaaaaccggcttgcttcaaagcgatgagcgcgagtgtcattgctgccagaccgcttttcatgtcatcagtcccgcgaccatacatgacatggttgacaatctttccggaaaaaggcggatacgtccatgcagactcgtcgccgggactgacaacatcttggtgaccggtgaagccaagcacgcgaccatcttgattaagctctgccactaaattaacccgatcatctttgtacggaatcagtttggtaggaataccggcggcctcaaactcagcctgcaagacttttgccacagccagctcatgaccgtttgctgagtcaatgcgtattaatttttgcaacagtgcaacaggatctgtcatatttgctcatcctttcagtgcgatgtttcatggccgcttaattgaacttttcactgacgaccaatgttgaagcaagcttacactctttttgaattaaaattcaatgtttgactactaaaaaaattgtgctaaactcatgcatacaaacttgaaattgatgataaacggactaagtgagtagcgtcgcgagacagtacagaaaacccgaattgatgagaacggggttgcaagcgcgcgtgaatatggcttagtgcacacggcacaccgaacattttttgtaaggctgtgatggccagcgcccattaacgcgctcccggatgaatccgtccggtgagtgggtcgcgcacagcacggccaattagaatggtaccgtgggtgaagctcacttctaactgtctttggttagaggtgggctttttttgtgagcgcgagcaggagcgtttagaaatcggagtgtaagtggccttgaagcccaaatggctgggctttggccatttgggcttcaaggtccttacacgtagatttctgcgactgcgagcgcgttatagaaagcgaaagctaaaccctcaccaagccctcaacagtacgagtactaaggtatgaaaaccattgcgcccaaggtccttacatgcaggcttctgcgctggggagcgcgttatagacgttatagataggcaacccggtgaacgcaagccactacattcatagtccgtttatcattcaatcaagccaatacagctgagcaccgactacacgaggaggattcaagatgaagcgtttttggaagatttttgccaccattgcagtattaggactgattttggttggttgtggtaacagtaacagcagtagcagtcagaagcagacgacggttaagatcggggttgttggcgcggataatcgggttttgcaatccgttgccaagaaagtcaagaaacagggcatcaacattaaaattgtccagttctctgattacaaccaacctaatacagcattgaaggatcatgatattgatttgaacttgttccagcatcagtattttctgaacaactggaacaagacgcatcatggtgatcttgtcagcatcggtcagaccattattgcgccgttagcgatttattctaagaagatcacgaaaatcagtcagatcaagcaaggtgacacaattgcgttgccaaatgacccgaccaatgaaggccgcgcgttgcagttgctgcaagcggcaggcttgatcaagctcaatacgaaggtggctttgccaacgacccgtgatgtgaccgccaacaagctgaatttgaagcttaaagcggtcgatgccgcccaaacggccagttccttaccggatgttgcagcgtccgtgattaactcaggcgtggctcaggatgccaagttgaatcctaagaaggctatttacacggagaaggtcaacaaacaaagtcaaccttggattaacgtgtttgtggcgaataaaaaggacaaaaataataggacttaccagaaaattgtgaaggcattccggacgaaggatacggctaatctgattgagaagttgtaccatgggagtgaagtgccagcttggacgcagaagttttaggattgcgggtaatgcgcgtagggaaactattgggttcgctttccggttaccagtttgaggaatttttaggtggctagtaacttgtttgtttggagaatggcatgataagttggtgaggacaaagcgacgccaaaacgcgttcactagcgcagaagtctgcgtgtaagaatctcaggcgcaatggccaagatcgggccatcacgcccaaggccacttatgctccggtttctaaccggccacgctcacgctctctctacctttctcttgacaacttacccttctttcgtctaaactcatcttaattcatttcgggaaacgaatgatatgagtgagtagatttgatgagactgtacagaaaacctgattagctgagagcagggtagttgattgaatcgaagatggctcattgatcggcatcgctgagcagtggttaggcgatgatggctggcggtcattactccgcacacaggtgattgcctgttactgagggcgctttggcgtcgaattagaatggtaccgcgagcaagctcgcttctaaaacattgtgtttagaagcgagtttttttatttttcaaaaagcttgcgcatattgttcgtgaacccgaacgaggaggaagaagtttatgaagtcttggaaaagagccattatcacacttgctttggttttgccattatttgttttagcagcctgtggtaagtcgtcatccagcactagcaaaaataccacggttaaagtcggcatcatgagtacggacaaggaaatctggacggacatccagtcacggttgaagaaacagggtgtgaccatcaaactggtgcagtttacggattataaccaaccgaaccaggcactggaagacggcgacattcagttgaacgcttttcagcatcataatttcttagataactggaataagaaacacaataccaagatcgtcgacatcggtgcaacttatatcgggccgatgcgcgcttattccaacaagatcaagtcgctcaaagaagtgaaagcaggcgataagatttccttgcctaacgatccttccaacgaaggccgagcgctgcagttactcgcgcaaaacggcttgttgacactgaaaaagggtgtggcatcgccaaccattcgcgatattacggaaaataagcttaacttgaagtttaccgaactggatgcagcccagaccgcacgctcactggatgatgtggcagtggccgttgtcaataatgatattgcggcagcagccaatctgaagccggccaatgcgattgcggttgaaaagattaccaagcagtctaagccatgggttaacttcatcgctgccaagtcggcgaaagacaagaacaacgccacttacaagaagattgtcaaagcttaccagacgaagcggacggctgagctgctgaagaaggtttacaaaggctcaacattgccagcctggaactacaagttttaattagaaacggggacaattatgtcagatcaagcagttgtgacgttaaaagacgtggacgttgaattccacgggaagacccgctcggtacatgccgttgatcacgtcaatttaacggtcaatcgcggggatatttatgggattgtcggctattcaggagccggcaagtcgacattggtccggaccatcaatctgttgcagcggccaaccagcggcagcgtcaatgttttaggccaggatatgctagctttgtctgcggcacagctacgtaaggaacgtaagcggatcggcatgatttttcagcattttaatctgatgaacagccgcacgattgccgataatgtcgcgtttccgttaaaaggcattaaatcaaagcaggagatcaagaagaaagttgctgagctgctggatttggttgggctgacagatcgggcaaattcctatccggcgcaactatccggcgggcaaaagcaacgggtcgggattgcacgggccttggcgtctgatccggaaatcttgatctccgatgaagcgaccagtgcgttggatccgaaaaccacgagttcaattctggatcttttgaaatcgttgaatgaacggttggggttaacgattgttctgattacccaccaaatggaggcggttaaacagatttgtaatcgtgttgccgtcatggatgcgggcgccatcattgaacgcggcgatctgctgcaggtcttttccgacccaaagcaacagttgaccaaggatttcatcgatacgacgttgcagcttgatcaggcgattgaatcagttttgcagcagcctgccgttaaaaaccttgggccgaatgatcgcttgttgcggttaacttacgtcggggcttcggccgatcaaccattggtggccaagttgtttgaaagttaccacgtgactgcgaacattttgtttggcgatattcagattttacaggatacaccatttggcaatctgattgtggttttgtccggggatcaagcgcaagtggacgccggcattcagtatctcaaacagcaggatgtcaaaatcgaagacatcttaaagaaggaggcctaggcagatggtacaattttttacgaaatattttcctaacgttgtgcctatctggtccggcgatggcggcgtgacgcaggcgatcaacgagacgctgtacatgacggccttgacggcaattgttgccggggtgctaggcattattattggaattttgctggttttgaccgatgaaggcgggctactggccaatcatccgttttacttcgttttggataaattggtgaacatcttccgagcggtgccgtttatcatcttgctggcgatcatgacgccagtgacgcgcgccattgtcggaaccggcatcggaccgaccgcggcgttggtaccattgattgccggcacgactccgttttacgcgcggcaggtacaaaatgccttgttgacggttgatcccggtgtcattgaggcggccgaagcgatgggcgtttcaccgctagggattgtctggcgcgtttacttgcgtgaagggctgtctgaattgatccgggtttccgtcttgacgatcatctccgtcatcggcttaacggccatggctggggctgtcggtggtggcggtctcgggaatctggccattgcggtcggctaccaacgttaccagtacgacgtgatcattgtttccctgatcttcattttggccctggtcttcttggttcagtttatcggcgatttctttgcacggaagagccaccactaatcgcgataaaaaatagcgttttgtattcaagcgccccacaattgtcagataagcaaagtctgatgactgtggggcttttttgaaagcgggctgtttgccgccgtattctttatgacgtagaataacggtataatgaaaagtcaaatccagtcgggggtaacattgtgcatacacttgagattaaagatttacacgtcaaaattaaggcagaaccggagcatccggagattttaaccggagtcaatttgaaattggcgacgggcgaaattcacgccattatgggtcctaatggtacaggtaagtcgacattggccgagacaatcatgggcaatccggcttatgaggtgacccaaggcgacattctgattgacggcaagtcgattctggaccttgctgtcgatgaacgggcgcgtgctggattgtttcttggcatgcagtacccgcaggaaattgccggggtcacgaatgctgagttcattcgtgctgcgatcaatgcgcggcgtccggaagatgatcagattcgcattaccgattttttgaaacaattagataagacgatggcaacccttgagatgccggaatcaatggcagatcggtatctgaatcaaggcttttccgggggtgaaaaaaagcgtaatgaaattctccagctgatgatgattcatccgcattttggcttactggatgaaatcgactccggcttggatattgatgcactgcggatcgttgccaagggtgtcaacctgatgcgcgggccggaatttggcagcatgatcattacccattatcagcgtctgctggattatattattcctgatgtggtgcacgtcatgaaaggcggccggatcatcgaaagcggcggccctgacttagccaaagaattggaaaagaccggctatgaacaccttaaagtgggtgaacaaaatggttgaaacaacaacgctgccggcgcctaatctgcctaagtttccgttggcgcgctatttaaagaaccaacctgatgccgttgaagatcgggtcgtcttgcatgcgcctcaggcaattgcctacgctgccgggtcgagtgaagtccagcgttttacaccaacgaattcgcttgatgcatggttgctgcgttcacctcaaggggcaacgacggtcgatattcccgcccattttgtcagcggcgatgaccccatcgttctaaccgggcctaaaaacgccggtggtttgctatatgttcatgttggtaaaggcgccaaggttaccttgcaggaaaaatgggccagtagcggtcatgtgttaggtatttggctcatgttggtggttgatgacgacgcggacgttaattggctgagctatgatagctttactgccgacactgtgctggtgaatcgcacggcgacattagccgccaatgcgaagcttaattggacattggccggattttcgcataactccgggttgaatcgagtcgatgtgcggttgctgggacaaaacgccgaggcaacagttaacgtgggcgttttagcttccggcaatcagcatgtcagctatacgacatctgtgaccaatgaaggccagcatacagtgggtcatattaatcagcgcggtgtgattaccggcaatgcccacctgatgtttaatgggattggccacatcatcaagggtgcccgcggaagtgatgcccaacaggaaaatcgcgtgttgatgttatcacagcgagcagaaggcgatgccaacccaatcctattaattgatgaaaatgacgttacggccggacatgctgcttccgtgacgcgggtgaatgccgatcagctttactatttaatgagtcgcggactttctgcaaccttagcaaaacgattggtgattcgcggctttttggaaggcggtttggctgaaatcgacgatgttcggctgaagaaagaactgtttgcaacgattgatcgaacgctggtggctgaagatgcgtgaacaatttccgttttttaaggctcatcctgatctggtttatttagataccgcagcgacttcccaaaagccgcaagccttgttggatagccttcagaattactatattaatgataatgccaacgtgcatcgcggtctctacaagttggcctatgatacgactgaggcatatgaaggagttcgccagcaagtcgctgatttccttcatgcccaaagtgccgaggagattatttttacccgtggcacgacagatagtctgaatttggtggcgagtgcgtttggcccgcaagcagtgcctgctggcggccggattgtggtcagtggtgcggaacaccacagcaattttattccgtggcaacagcttgctaagcgccagcaggcaaccttcaccgtaacgccggttcatccggatgggacagtcgatgcgcccgccttattggccgctatcacgccaggtaccaacttagtagcgattgcccaagtgaccaatgttgccggcgatacactcccagtggcagagattgccaggaaggcgcatgacgtgggggccattgttgtcgtcgacggcgctcaggcagtcgcccacatgccagttgatgtccaagcgttaggtgcggacttctatgcgttttccgggcataaaatctatggaccaacagggatcggcgcgctttatggtcgtgctgacttattggcaaaaatgccgccgattcaatttggcggtgaaatgatttctgaagtccgcgaccaagaaagtacgtgggcagacgggccgatcaagtatgaagccggcacgccccacattgccggcgtgatcggcatgggcgcggcattgcattggtttcaggaaaatgttgatgccgcggcgttgcaaaccgaacatgaattgacgagtcaattacgaacagcgctgacggcaattccggatctaacggtttatggcaacgacgacagtctggcaacggtttcgtttaatttaacgggtattcatccccacgatgttgccaccttcctggatgagcagcaaatcgccgtgcgcgccggccatcactgcgcccagccactcatggccaggttaggagtgccagcaacggtgcgcgccagttttggggtctacaacaatcaggatgatgtcacgaaattggttgaagctgttcaggccgcaaggaggtatttccatggcattgactaagctagatcaaatgtatcgcgcggtgattctcgacgaggcgcaacacccgcggcatcacggcgttttagctgattttgatcacgaaatcacggtgcgcaaccccagctgcggtgatgttttacacttgcagattagtgaaaaagatggccgcatcaacgatgtcgctttttctggcagtggctgtaccatttcccaggccagtgccagcttgatgaccgatcagattttaggtaaaacgcccgctgaaatcgagcagatggtcgaaactttttccgacttgattatcaaaggcgacgttcctgacgccgaccgtctgggggatgcagctgtgttaaaaggcgttcatcagtttccggcacgcatcaaatgtgccacgttagcatggaaagcagctgcgcaagttttgacgcagaaaggtaaaaccgatgactgagacaaaaaatactaaaaataatgaaactgttgcggcggatatcgactttttacctgacgaaaatcccgctgatttcaaagacgatatcaagccggtctattcaaccgggcgtgggcttaccgaagaaacggtacgggccatctcggcggaaaaacatgagccggagtggatgctggattatcggctgaaggcgtatgcgacttaccgtaagctggcaatgccgaattttggcccggatttgtcggatttggatttggataatatgctttatttccaaaaagcaaccgatcgcacgtatcgcgattgggatgacgtgccggacacgatcaagaaaacattcgatcgtctcggcgtgccgcaagcagagcggaaatacctggccggtgccagtgcccagtacgagtctgaagtggtttaccacaatatgcgcaatgaatttgaaaagctagggattattttcatggacatggattcggcgttgaaggaatatcccgaactcgtgcatgaatactttgggaaattagttaaacctagtgacaacaaatttgcggcgcttaatggtgcggtttggtcaggcggcagttttatttatgttcctaaaggtgtccaaaccgatgtgcccattcaaagttacttccgaatcaatgcggagaacacaggacaatttgaacggaccctcatcattgtggaaccgggcgcgcacgttaactatgttgaagggtgtacagcaccgaattattccagtgatagcctgcatgcagcggtcgttgaggtctttgttaaaaatgatgcctattgccgctacacgacgattcaaaactggagcaagaatgtgttctcgcttgaaaccaagcgggctcaggcgcttgataatgccacaatggagtgggttgacggcaatcttggcagtaagacgaccatgaagtaccctagcgtctatctggacggcaaaggggcacatgggacgatgctcagtattgcggtggccggcgaaggtgtcgatcaagataacggggcgcgcatgattcataatgcgccgaacacaagcagttcgatcgtctccaaatccattgccaaagatggcggggcagttgactatcgcggaacggttcggtttaccaaaaaggccgacaacgccttttgtcacgtggaatgcgacacgattttaatggatgaaaagagctccagcgacaccattccttacaacgaaatccacaattcgacggtctcaatggaacacgaagcaaaggtttcgaaagtttcggaagagcaactgtattatttaatgagccgtgggatttccgaagccaaggcgaccgaaatgatcatcatgggcttcgtggagccgttcaccaaagagttgccgatggaatatgcggttgagttgaatcgcctcatcggcatggaaatggacggctcggttgggtgatgctgtggtgacgcggtttgtggggcgttttggcgcttctaggaaaatactctccacaaaataatcgacaagttaatattggataatttcggtatgcctaaaatcagtcagtcatcaatactcgcgtgaatacgcagctagttggtgattggctgtttttttaaacaaagtattaggcaagcctaactttttgttttatgatagatgcggtaccaaaatggcaacattgagggggctgctaatggacaactatgataaagcaaggaaagtcttacaatcaatggcgctgtctaaaattgcacaggaaactggcatcagcattggccagatctggcattatcgggatcgccatgaaggcattgaaaaggcaccgccggcttatgtggagcgaattgcgcgtctgtatcgcaaaaaacgcgtttaaagtggataaagttgggggatgtggtagtaggtgagaggaagtggccgaacgtttttaagataaggctcaggaaattaaacatcgcgacgttgtcttgagctaggtaacttgattagctgagacggtgcctgttcgggttgttgatccgaacgtcgacaagaccgcatggcaagtgtgatagctgccatgcggtcttgtcgttttttgaccttcggagtaagtggacgctatttagacacgggtgctacaatgggtgaatgtatggattggcgttggctaatcgaatcgcgacttctgggtagcatattatgatcaagcggcaggaggaagatcatggctgaagacttggaacatttcattaaaacaatggcgctgggtattccaaccatcaagccggatgaaaagcgggcttttctaggcaattttcgcgaacgggtggcaatggccgtgaccattcggcaactgcgggatgcccgaattacggcgatgcttgactcggtgctgacgcgctatcccggttatcggatctttttgaacggtcggatgggggagagtttagttaatcaatatatgttgcaagcattggcgcatcaatatccctttacgattatgaatcagccgggaatgcgcgtcaccaagcgtgtgttgccaaccgactttggctgggttcttgcacatccaacgcaaaaaatcagtcgtccgattttgttgtagaaccagcaggcatgaccacgggattgcttggcgacggcaaaccgcaccacaatgccatttagctttaaaaggaggcccattttgacgcaacttgatactattcaaaccacagtccagcaactgcggacattactgaatcaaggtaaaatttttgcaacattgccggacatgctgggaaaagtcattgatagcatcgcaacggaatcgaaaacgcgtgtcacgattccgcgcgatgataaaaccgctattgcaagaattcgaaccattcaaaagcggatcaagcaaacgagtgatccgagcgtcaccgatgatgagattgcgtttttggtggcgcatttagctagtacaaaacctgctgtccgggacaaaggcgtttttttcttatttaatgatttgtttcaggcggaggcgtttacgaatgagcaagtcaaggcgctttttaaacggttgcaagcgccggatattttgttcagtcatatcttcgagccccaaaatgatgccgtgtttctgcgaagctttgcggttatgattttgagcggtatgatttatgccgatcagaatcgctatcatattctcagtaaagctgattatctgacaaccgtgcagaatatcgggacgtatattctgcttgaaagagatggccggggatatgtcgaaaccaaaggctgggcccatgcatttacgcatattggcaatatgttggaagaactgagtcaagtcgatgttttgccgcgatccgagaaagttttcttgatggcggcagtcgtggaagcttggcggcgcattgaaacgccgttaatttttggcgaggatcatcgaatggccttgtatctcagcggcatcaccaatgttaaccagttttatagcgagacgcttttaatgtgcctcaagaattggcaacatacgctggtcaatattcgtcctcaggaatcttacgctttttgggtgcggtggtacaaccgcaatcgtttgttgcaggcactgacattacgcgctgatttgccgcaaccgattacggattatattcaacagattgtcgatctattctgaatgagagcgtgagctggcgcggttagaagtcggagtgtaagtggcctcaggcgtgatggcccgatcttggccattgcgcctgaggtccttacacgcagacttctgcgccagcgaacgcgttttagcagacgccatccttaagtaagagattggtatactttttaatcttactaaaagcaggatgaagttgatttgtatggcctatgagttgtaacaatttttgaaggccagagcaatagaaatatttatggttaaatataaataaacagatattatagtatgctagttttgacattgtgacctttttcattatcaaagctcaaaatttaaaaaatttttttacaaaaaaagaataaataccggttgttattgttagcttttaaaaccagttatccgtataattgacactaggttagggggaaaccccgtgacttctatgttgatttgttaaaaggaacactggggagtgataagtgtgcgaaaggagcagcaaacgctacggattttgggggataaagtccgctactatcgtaagttaaaaggcctatctcaggcggaactggcagcaaatatctgtacgcaagcaacgattagccttattgaaaaaagaaataaggttccaagcatgaatattctgatgcgacttattagtcgattagggatacaacttgatgatattgttgtcgaacatcatgatcggattcaacaactgcttaacgcgattgattaccagattcagcatcatcaatacgcggttgcggcagataatctgagcaagatccggctggataagattaaaagcgaagatgatcaaaagcgttattactattatcaagggatcatcgagctattcaagaacaacgcacctgatgaggccatttatttctttggtcgggtattaagtccgctcgtcaattcagagcgtgatctatatgccattttggcaaccctcggcttgggactggcatatgcggacaagcatacctttgatcgttcacgggtctacattgatcaggcattacgcatgttaaaacatgtgccgctgtctgacagtaagtatctcgatgttgaactgacgatttattggcatattgcgcgcgtatactacgaactaagtgattttaaagccgttttgaagtataccgaccatggtattcgtgaagccgttaagcacgataagctttttttgcttgacgaactttacaccttgcaggcccgggccttgaaattacttggtaatccggaggcacctaagagttatcaaatcgccattgcgtttgctcaagttaccggatccactgcactggcggcaagtcttgctgccgaaatggtaacacaaaagccaaacagcgagactgcataaccgccagttatcggcaatcgtttggtgatattcaaaaaatacctgaggctttcgttctgcatctgctgatgtagctggcgaaagtctcaggtattttaatgtcgtttaagtgtggagtcattgaatggtgagtcggcaactttgcgctcatcattccaattcggcttagcgtttaatcatcttgatgttgttcggttggctttttggtacttgccagtgccggcttgttggtcaagtcagtccgaaccacgaggacatcgcataaggcgttccgcgtgacatattcggtgaccgatccaatcagcagacgttcaacggcgtttaaaccagttgccccaatcatgatcagatcgatatttttagctttggggatgtctctggcgatgattgtttttggtgcgccgtattcaatgctgaaactgaccttgtctaatccggcttttttggcctgatcgacataaccttccatggtgctcttggcattttccgttacttgttcgaccatcgctgaatcaaagctggaaacgttctggaacgctcgggtatcaacgatatgaataagaattaactccgcctgatttcgtttggcaacggcaaccgcttttttgaatgctaactcggcttcatatgagccatcgatcgcaaccaaaatatgttgatattgttgtaacattcctcatcacctctatcttcattgtacttgattccatcgggaaattaaatgaaaagcgtttcacaacttcatttgggtcaggctgataaaaacaaaaactgttgctaaaaaagcgccgctaaccaaaatgaccaaattcgcccacatcgggaacagaatcccaccgatgatggcgaggatgccgacaagggtgaaaagataggcaaagttcttgagaaaacgcgtcatgcccggagacggttttttgataatcagaaagttctggtagcgatgaagccatgtgtaggctgccaacccgaacaaggcgaccgcgtaaatgcacattaaaatgattgtcaaaggatcagtccttcctagccgtttgcttatattatgccacagcagcaaggaaaagcggttggctttttaatatcgccgacgtacatgaatgatctgattaacaacttgcagttacttggagggcattcgcttcagtaatgccgcaattttggcatgaaaaaagccggcacggagccggccaaaaacatgattggttttttgtgaaagactaattggtgccgttttcttcccggatcgttgaaacccgctgctagctatgtgggtccagacgtcgtagacattagccgctaagtgaaatagcagcaccgtctatggctcttccggtcccaaggtctcgatactgttcggtcaactgatagttaaggaagcgcgaacaccttagaactttcaccgttatagtagcacgagaagccgcataggtgcaagcggaaacgctttcgttactttttcctcaacttttcggcatcacgttgccattcttcaagttgctgctggcgctgggctagcgcggcttcataacgtccggtggttttaggatggtagtactgttgatgcttgagattatctggcaagtattgctgcgctacccagccgttaggataattgtgcggcaacttgtagccttggccatgtcccagttgcttggcgccgcggtaatgggcatcgcgcagatcatcgggaatctggccggcgtggccgctttcgacatcagccagggcggcgtcaatcgctttgatgccggagttacttttcggtgcaaggcaaagatcgatcacagcatcggcgaggggaatgcggccttcaggaagccccaaacgttcggcgctttgaatcgctgttagcgtgcggctggcggttgccggattggctaagccgatgtcttcataagcgatcaccaacaaacggcgtgtaatactgttcaagtcgccgattgcgattaattgggcgaggtagtgcaaagcggcgttcacgtcagagccccgaatggacttttgaaaagctgaaataatgtcgtaatgggcatcgccattgacatctccggctaacgatggcttttgcaggctttgctgaatggtcgtcaagtcaatggtaatagtgccatcgtgatctgccggggttgataaaacggcgagctcaagaccattgagtgcggcccgtaaatcgccgtttgtggcatgggtgaggtagtcacgggcctctggctgtaaatcgacctgatacttgcctagaccgcgtttttcgtctgccagtgcccgatcaatggcggtgctgatatcatcagccgtcaacggtttgacctggaaaatctgggtgcgactgcgaatggcgggctggatattcatataaggattttcagtggtggccccgatcaagataatccggccactttccagtagcggcagcaaaaagtcctgtttggttttatccaatcgatggatttcgtctagcagcaaaatcaccgtgccactcattttggcttcttccgcgacaatttgcagatcttttttagtgtcagtggcagcatttaaaatgcgaaaagcatatttcgtactgccggcaatggcgctggcgatgctggttttcccagtgccgggcgggccatagagaatcatggaacttaagcggtgggcactgaccatgcggcggataattcttcccgggccgacaagatcctcttgtccgacgacttcatctaaattttgggggcgcatgcgataagcaagcggttgttgcaaaggaattcctccttgtaaaagttgcgtgtaacagttgagtttgtcttgattaaggtgtcgagaaatgcaaggaagcttagcgggccgggaagcggtttttctcaacgtggcggctcgcgctctgatttaaacgcgcttaccggtgcagaagcctgtgtgtaaggaccttggtcgcaatggcctaaacccgggccatcacgtccaaggccgcttacactccggcttctaagcgcaccggctcgcgctcttgtctaaacgcgcttacagtcgcagaaatctccgtgtaaggaccttgaagcctaaatggccaaagcccaaccatttaggcttcaagcccacttacactccgatttctaaccgctcctgttcgcgctcttgcctccagcgtgttaatctaattctaaatcatcaactaaaggaatgacacattgtgaatcattattggcaactgattcaaaaacagcatttatctgatttggccacgcagacccggcttggcgttgtgcggacggtgaagccggtgttaccggaaggcgcgcagttggctgcctggccccaattaagtcggcatgcattggttcagccattgtcggcctcgactttacaggtggtaacaccattgctggacgattttgccggtgtgattgctgaattacgtgcagggctaagtcgcatttgggcaaatttgcctgaagacgggcgtctgccggttttttcggaagagcgcgtgaatcagcaagtcgttcgcatcgttttgccggaaacgttgtttgaacgcctgtatactgcggaaaattttcaggggcagggtccggattatgtggcttaccgcaatgaggtttacgacttggtggcgaatggtctgatgcgccagttgcctttactgacggatttatttgctgcaacgccgctgtctggtcaccaagcattttggccatcatcggatcaggagcggcagctggttcaaaaagtgactgatccggaccatctggatcgaacgctggccttggatgttatggtcgaacttgacccttatactgctagtggcataacgtcccaaatgctgacctttttacgggatagttgctggtttgcgttgagtcagccggcgattccggtcgcggtggccagcgaagtgcgtcgccatgctttggaagaagcacggaagattgctgcaatggagcctgcaacgccggttaaggaactgacagcgaccatggatgctatggccacgtggttgaaccatatgggaatgacagcgcaacagaagcaggcgtttgaactgatgcaaacccgtttgatgaaaccggagacgacggttgccggtcaggttgcggccgcttttggcgaaaaaaatgccgcggccaaatcgttaagtgaagaagcccgcacggatttggcgggcacggacgggttaccgggaatgatcgatttgtcgggtaatacgcaggcgttggtgcaggctgccattgatggcggttatcaatttacgctcttggatcggcaacaagggttggtgcaaattgcaacagatacgcaaacacaagtgattgtcgatggcaccattaccaaatacacgccgggtaatgccttgttaattgcaacgcaccggcatgccgctaaaaaactacttgctgcggctggaataccggttgcccgcggtgcgaagttcactcggtggtcagatgccaagtcggcgtttgagcggagctttgcacataaaagcattgtggttaaaccggaagcacgcagccaaggcgttgcggttgaacagtttgcagttccgccgactgagaaacaattcgccagcgcttttcatgaagccaaccgttatcacggggttttaatcgagatgatggcgcggggaacgacctatcattttaccattgtcagtcagcaggtcctcagtgttttggaaaccgcggcggcgaatgtggtgggggatggccgcaaagccattaaagagttggtggcactgaaaaatgggacccgaccggctgcccgccagttgcaactcgatgccgctgctctgcgtcaattgaagttgcaatcggtaaccccagagaccgttttgcgtcgtggtcagcagatttttctggcgactgcagcccatccgcaaaccggtggcgatctttatgatgtcatggatgagattgatccaagttataaaaagctggccgttgaagcagcggcagctcttgatttgccagtagccgcagtcgacatcgtgattgataatctgtatgctgcctatgatccggatgtggcaggacaagccgtggtgatcagtgtcaatccggcaccagacctaacctcaccgcaacagccggatatgggcacaccacgcttcattgcgccgaaactgttgaactggttatttgctgaaaagtaactgatgtcataaaaagtttcgccgctcccgttaaacaaaagtactcccggaaacgtgcgcgtttttgggagtacttgcttttatattttttattgatgtgaaccatgccagcgatggtttgcttacagatgcttgaacaaatcgaagccgcgttttttgggtttggttttgtcttgatcttgatccagtggtggcaggtcgatcgtgctttggttgatggctttgtctgaaacaatcagcaggccagcagctgtgtcatcagtttgggcggtttcatttgccaccagcgtaaacggaatgttggcgtcggtgagcattttcatgtaaggacccgtgatggcgttatcaagtttaccgtttaacaaggccttgtagccgtggtcatggaaatcttttagcagcggggctacttggtgctggcgtttggggtctgccaattcctggttggaaacgcgcaaggcaactctttcgcgtaatgagcccataaaccgccgccgctcatcggggttggtctgcgggggaccgtaaagtgcactattcagatgttcctgcatgttatcgtctgacatgattgatgcgtcctccttcaattgagttatctgtgaagcagtgatgatctagtcactaatcaccgccacttcatgtgtctcattgtaacatgatcttttgtaaagaaagggatgagaggccggtgtttacccaagcagatttcgaggcttttgcagcgccaacgctagaggcgcgaatggccttaattcgcgcgcggctagatccaaagtttgccgaggccgccaagacaattgtgcctttgttgcaggcgaccaatcacccgatttttacccatatcgcgaaacatcagcgccgccataagaatccgccgcctaacacatgggttgccttttccacgagtcgccgcggctataaaatgttgccgcaccttgaattgggcttttgggatgatcgcctgtttttatggctcgcttgtttgcgtgaaagtaaaatggtaccgcagctgttggcaggcgtcgcaccgctggtcaaaaagatgcccggtcagtggctgatagctgatgaccataccgccaaggctgcggttgcgctcagtccaaccgcgttgacaaagaaaattgcgcggtttgaaacggttaaaaatgccgagttcctcatcggacaggtatatttagcagatgatcctatttggacgaccccggatgtcttgtggacagagattcaggggcgtgtcgctgaattggcaccgatattggatcagctcgtgcaaaacgtggcggcttatcaggcaaaaaagtgatgaactgactgtcaattagccgcgaggaagaaatagaacgaaagctcttaaaaccaagcataccgaagttcagggtggtaaaatcacattgaataggaactcacgttgtttttaaatgtcagcctgcattgagcgactggtaacacctgcaaataaggagaaagccatgccagatattcggtttcacagtgtctttgatattatcggtcccgtcatggtcgggccgagcagttcccatactgccggggcggcacgtatcggcaaagtcgtgcatgatatttttggcgaaaaaccggaagtcattacgatttatctgtatgaatcatttgccaaaacctatcgtggtcacggaacagatgtggcactggtcgctggactactggggatggcgcctgatgatccgcgactgccggaatccttgaaattggcatacgatcaaggcatcaaagtcagttttgtgccgaaaagcgataaggttgatcatcctaacacggcccatatcgtcttgcaagctggcgatcatcgactggcggtgaccggcgtttcgattggcggcggtaacattcagatcacggaaatcaatggcttcaagatttcgttgagtatgggccagccgacttatatcaccattcacgatgatgttccggggatgattgcgaaagtgactggcattttttcgaatgcagggattaatatcggcaccatgacggtcacgcgaacggctaaaggtaagcaggcaattatgattattgaggctgatgattatcaagctgatattctggcgaagttgaagttgctgccgcacatgcgcaatgtgacttatttcgagtgaatcgcatttaaaaagttgtcacgaattgcctgataaaggagcggaaaatgttttataccgtcaaagagcttgttgagcaaagtcatgcttttccttctgttgcggcgctgatggtgcacacggaagttgaaaattcgacgcgaaccgaagagcagatccgccatttgatgagtcgaaaccttgaagtcatggagcgatcggtgaaggaaggcattgctggcgttaaaagtgtcaccggtctgaccggtggcgaggcgaagaaactgaacacctatattactgaccagcaatttatgagcggccagccgattatggaagcagtgcgcaatgcgattgcagtgaatgaagtcaatgccaaaatgggactcatctgtgcaacgccgactgctggctcggcgggtgttttggccggggtcttactggcgatgcgcgatcgactgcatttgagccatgaccagcagctggattttcttttcacagctggcgcgtttggcttggtgattgccaataacgctgggattgccggtgcggaaggcggctgtcaggaagaagtcggttcggctagtgcgatggccgcggcggcgttggtgacggctaacggcggcacggccgagcaggcggctacggccgttgcgattaccttgcaaaatatgatggggttggtgtgcgatccggttgccggcttggtggaagtgccatgtgtgaaacgtaatgcgctgggtgccagtcaggccatgatttccgctgatatggcgcttgccgggtgtatcagtgtgattccggccgatgaagtgatcgaagccgtgaatcgcgtggggatgcagttgccggctacgttgcgcgagacgggtgagggtggtttggcgacaacaccaacgggtttacggttgaagaagaaaatctttggcaaagcatgattgtcgaggataactgaatgaaacattcgggcaaggacagctatgattcattgttgatgtcggtgaatggcacgttttgaaaaggagcagactgtgattaatttatacttagtccgacacggagaaactgcaggtaatgttcgccagttgattcaaggtgtgactaattcgcgcttggatgcccatggccgtaaacaggcatttgctctggggttgggcttaaaggcaagtggcttgaagtttgatcgggttgtctccagtgatctcattcgcgctcaagaaacggcgcaacagattcttttggggatggacgaaaaacagccaattgaaaccaatagcggtttacgtgaggaaaatgacggaatttttgaaggtcgcgaactcaaagatgtttcagaagaagtttttggcgtctcggattaccatcaactcgtgacaagtggcaaggtgccacttgagacaattcctgacaggtttcatgccgcggatgtgaccaatcaggcagaaaacacccaacaaattgtttcccgctatgatttggcattgcgccggattgtcgccgcagcagaagccgctcatgagacgagcattttggtcgtcagtcacgggactgccagtttgttgtggctgctggcacatggcgcggacttacccaatcgcaccgaactcacaaatgccagcgtcagcaaggtgacgtaccaaaacggtcgcttcaaagtggactgggtggataacacgacgtttcgggatcaggggttacaagaagcgtggtcacaatgattggatctcaaaaaagctgagaattgatgataattcatggctcccatacagaagcgaacgcactccaataatgaaaaaaatggaggtgcgttcgtttttagctttcggaaagataacgcggtaggaatatatggatcttagtgccaaggcggagcaatcggaggccagatgggctcagtggtgagattgtactagccgggcggttttcccggcgtagtacaaggccgagcttagagactctgccggttttgcagaggctctaagtcgtgcccaccacgttccagcccaatctggccggagattgcggagtttggcacggaccgaaacttattgcctgtgcttttccgcattgtttcggttaaaaagattgtgcactatctaaaaataagcagcacgcgtatactgatggtgaatcaatcactggaggcgatgtgcgatgaagatggcgccggaagtctatcttgcaaagttaacgaatttattgctggcaccggggacgagaacctttgagcgagagcagttgttgcgagcaaagcagcaagttgaagcagggcaaacagtcggagcaagttgggatcagctaaaagccagtttgcggccgcttgcgatccgcgataatctaaccccggatttagccgatttttatcgaacccaaactggggatgctgaagcggcaagcgaaactgatgtgagtgcgcattttcagcgcgatcttgcttatcaggatcgggcaatctttgcgggcggctgtttttggtgcatggtggagccatttgttgataagccaggcgttgaatcggttgtttccggctatacgggtgggcacgttgaccatccgacttatgaacaggtgatcagcgacaccaccggccatgtggaagccgttgaaattattttcgatacccggaaaatgtcgtatcaacaacttgtcgacctttacttccaactaacggatccaactgatgccttgggccagtttcaggatcgtggtggtcattatcggccggtgatcttcgtgcgcaatgatgaccagcgccggattgccgaagaagcgaaggctaagctagcagcctcgggtcgttacttgcgcccgattgtgacagccatcgagccggctgcgacattttggttagcggaaaattaccatcaggacttttacaaaaagaacccgaaacggtatcgaatggttgaaaagacccgccagcagtttcttaagtttcagcatgcacaaggtgatttaaggatgctgttgaaacggcgaaagcgggcttaaaatagtcattgacggaggtgacacagatgcaggcacctaaacgacattggacggaacgcgacataccagatcttactggccgatatgcggttgttactggcggcaccagcggcgttggttttgccatgagcgcggcattgctgcgacatggcgcaactgtgatcattattgggaaaaatcggcttaaagggcaggcagcggttgaaacgttgaaacagcaaacgcaacggcaagtgattcgtttcatcgcagctgacctgagtgatcaaaccgccgtgaatcagttggcagatgagctcctggcaactttgccgcggctggatattttaatcaataatgccggtgtcatgatgccggctgagcgcacggtcacgcgtgatggtgttgaattgatgtgggcggttaattacttcgccgggtttatcctcaccttgcgtctagcttctttgttggcaaaaacgccaaatgcccgggtggtcaacgttgcttcaattgccatggggcgaccgcatttaacctttaatcaatttgatgggcgtgattaccgcccgtggacgttttacgccaactccaaattagcccaggcgatgatggcggtgaaactcaatcaactgttccatgaggcgggacaatcggtcatggtcaatggttcgagtccgggattggctgcgaccagtcttaaaaccattcagtcacgggcaacggcttggccaatgcggttggcagcactgagttttcgcatcatgccgttgctgcgtcagtcgcctcaacgagcagcattgcctgcgctttacgccgcaacggatgcccatgcacaaggcggtgtcgtgtatgcgccggcgtcatggcatgggttgcgcggttatccggggctatggagctggaacagtcggcccgaattgcatgatcaggacttactaaatcggctgtatcgcgcatcgcggcaggttaccggcgtttgaagcaggacattttccaggcgtggtctaaacacaaaaatattctcgatttcctgaaaagccgagttaatcacgatgaaaacggttttatatatgtagcacatgttgtggtagatgcaactattaccaccaatatcttgtatatgcaagacttacatttcaaaaaatcttgcggcataataaagacgttcgttatcatacgacgaaattcaagcttaaaggggtcttgtttcgtgcaaacgtctgggaattattttagttggttgctgcatcagttaaagggatggccgcaacaaaattattatttgttttggtttgcttttggctgtcagctcatgacgctggtggatgccaaaataacggcagtaacagtgattaccttcatcggcaccacacttggcgttctttgtgtcttggccatcaacgcgaccaaagccgttaatggctggctaggtcttttgagtgccgcgtgctttatttttgtcgggttcaccgcccgcaattatctttcgatgtttgaacaggttgcctatgtcatcacccttgatctgccagtgttgatcagtgtgcggacctggaatgacgataccaagaatcatttgaagaccttcaacttgcaaaagtgggtgctctcgattggctttacgctggttgtctgggctgtcagtgcttacttaatcggccagtacaccaatgatccacgcccgatttacgatggcatggccttcgcgatttcgttgacaggcggcattgtttgcttcttgcgttacaacaatcaatacttctggtggttgttcagcggcattgcgcagctgattttgtgggcggtcacatttgcccaaggcgatgccagcctggcgatggccatcaattccagtatttacgtcattaatgatattcttgctttcacggtcagcccatggttcaatcgcggccgcaagcaacttgggttaaaggcactttaagtggtgttttggtagccgttgtggtaatgttttgatttgttgtcatcattttaattcggataattgaggagcgagatttgtgatctacattctgggtagtattggtgcaggaaaaacttcattgacaaaagttttgtcagaagatatggaagcccctgcgtattatgaagatgttgaaggcaacggcatgattgccaatatgttgcagaaattttatggcgccggggcggacagtcgcaagcgcacaggtgccatgttgcagattgcttttctaaccttccgttatcagcaattaaaaaaagccgttacccaggaaaatgccattatggattcatcgcttgagtccgactttgtgatggcgtcacagttacataagcatggtgaaatcgatgatgtcgattacaatgtttatgtcacgctgtcacaggagatgcaaagcaacgtcaacggtagtccgtggaacggtatgccggatttggcagtttatctgaaaatcgatccagaccacgagcttgatgagatccaaaatcgcggtcgagatatggaagatattcgccaaaaaccggagttggtggattattatcggcgggtgaacaccgcgtatcaagagtgggctaaaggttacactcgatcgtccatgattacggtggatcgcgatcgctatgattttatccattccgcggctgatcgcgccacagtgcttgatcaaattgaaaccaagttagttgatttgggtaagctgtcgcctaaagaatttgacgccttacaagccaagcacgcagccggcccgatctcgaaatttgcttgatcgatcgttggctttaacaattacgatattaacaatggtcttcggtacgctgactcgagttcgggtaggttgctgaaagccttttttgtatcgccggtttgtctgctgccttggaggacttgagtgaagatgcccgcgcttttgctagaacttgcccgccgattgtcgccagttaccgttgttgcgtagcttttatgctatgcttaatgaaacgatgacattaaatcaaacggagcgtcattatctgcacagcgtgacttttttggaggaggcaatttttcgtggcgatttacgatcaacacatgcacactttatactcatttgactctgaagctcaattgcgcgattatctggcgcaaaccaaggcgccggttgtgaccactgaacatctggaattcgataatcctgacgatggcggacgcgatgatctaccggattatgccgggatggtacggactcaagcagcccttgccacgaattatcataatgagttgctgctgggtattgaggccggctattttgccccagccgaaccccgtctgcgcgactatttggcgcatcatgactttgatcttacgttgttgagctttcatcatgatggcaaacatgattatttggatacgcagatcgcaacactaccacccaagcaagtgttgacggactatttttcacgcatgttaactggtatccaacgctttcatgatgctgacgtgttggcgcattttgattatggcgtgcggcagtttgaaataacgccggagcagttagaagcgtggggaaaagcggcacttgatcagatttttgcgattgccgtggatcacgacctagcgttggaactaaacacaaagtccatgtataagtggcacaatgcgtccttgtatgatctggccatcacctggtatcaagcggcaggtggacatttgtttacaatcggcagcgatgcacacgaaggtccgcactatgaggctaattttgcgcaggcgttggccatgctcaaacgtcatggcgtcaaagagatcgccacttatcgccatcacaagcgaaccatggtgcctatcgaaccgccagtgattgacgcagataatgcgtattgatcaataatgaaaacactaaaaagccggctcgcgcatcggagtcggcttttggtttacttcaaataggcatagacaaagttaaaactgttcccgggactggttttgagatcgtgcattttcggatttaccatccgggcggcgacgagctgataaagcggaatggcgccggcctgattgactaacagttgttcggcttgcgtcatgtctttgaaccgcgctgtcggatcattcgcatcagttgtgttggccttggtcatgagcttatcatagtcgctgttttgccattgaccgtggttgtactcactcgtgctagtgaaaagatccagatacgtgttgggatcgggataatcggcaccccacgtactcagaaccatatcaaaattgcggtctgacgcgcgttgttggcgatttttggccggcacactggcgatactaattttaagccccggcagattttcctgtaacgttccctgaagatactcttgtgtagctttaaccgcatcaacatcatcaccgagcaattcaacactgacgctcttgaggccggtttccttcaacccttgttcccaaagtgtttgggcctttttcttgtcgtaagacgtgacagctttagtgcctttagcgacggcggttgcgaaatctgtcgagctatttggcaactggctgaggtcggcaggcgtaataccgcgggcaacgatcgagccgtcagcgagcacatttttgacaaaagaatcacggttgatcgccattgaaattgcttggcgaattttagtgttcttaaaagccggcaccttattttcattcaactccaaaaagtaagtgcgcgcccgcttgttggcaacatacccagttttacctttttgctgagcagcgagctgaccggttaacgtggcatcatccagtttgccggtatgataaaggtcaagcgcggtattgctgtctttgacaacctgaacatcgatttgcgtcaggtgaacgttctttttattccaatactggttattcttgacttccacccatttatcgccggttccgctccagtccttagatttaaaggcgccattggaaagcgtgtaagcagacttggtgccgtatttgtcgccccatttttgaacctgtttggccggttgcgggaaaaaggcgacgttgttcaatagactattgaaatatgggatgggatgttccaaggtaacttccagtgttttgtcgttaagcgccttgacgcccaacgttgacgcaggtttctttccagcgcgaatgtcatcggcgttttgaatgccagaatacatgttggcctgcgatgatttcgtggctgggttaaccgtgcgctgccatgcgaaaacaaaatcctgagcggtcaccggcgagccatcgctccattttgcatttcgcagtttaaacgtataggttagcccattattggttggcttgacgattttcgttgccatcgccggttgtaaatcatgtccttcatacttataaaggccattcatggtgtcaatgatcgcttgcccagagacgccttcggatgctttgctagggtcgagcgtttgtaaaacatccgattccattcggtgccagacctgctgcttgctcgcactagaactggttttagctgatgactggccgcatgcagccagaaccagagtcagtgcagcggtcatcatcacgagccatttttgttgcgttttcaaagcgagcccctccatttcgtaaactgcttttaggataacaagatacttacaaaaagcaagcgttttatcttgatggacgggaaccataggctggttcaaacttgagtcaggatttctcatatcaagatttcagactaatggcggatatcttagatggaaactaatgttaatataaaataaatcgtaatcagattagagggtaaaccttggtgttaatacggattgttgtttggaaaacttatgacaacgtaaaaccaaataagcctacatatcagcgatttggaaaacattggtaagattaacagcagtgagaagggaatggtaaagatgattaaaaaactacagtcactacacgattacgttaagaaaaattacgaggccggtaagtacgatgcatcggcaaatgaatataaacagtggacggaggattatcaagccgccgccacaacgagtggacatgcagatgatgacagtgattttgacatgggttaccagcaagcgatgaccgatcacgaccatggatttagttttcgaaattaccccgaagctgcgattgattttgggaaccttgtctcgggcaatcggatgcatgaagttgccgattttatcaagggctataatgcggctaagaaggatattgttgaaaaaactcaataattccagaagattctttcattccacaatcattgaaaaaatcaagaattcaggagagccgttgctaatgcgacggtttttttgatgatgtttgttcatttacttgctggaaaaacgtcaaaaacttttctgctacttttgatagtggcgtattttttgtccaaatgagcgccatttgtgtcgcaagcttaggcgaaaagggcacaaactttaatgacatttcttcttggttcaggagccgactgatgccgactacgtaacccaatcccgcctctgcaagtaatccagcattatagattaaattgtaacgagcgacaatttggctttcggaaaaatgatgaccggcccatttttgcaacatttctacgaccgattgtctttctgaaacaatgagtgggtacccgcttatctgaggggcggagataccaggcaaactagccaagggatcattagttggtataagtaacccccaaagattttcgccgttaattttgctaaaagcatatttgtaagtgtcagttggatcaatcacaacgccaaagtccaacaaaccttgatcaagtcgttccataatttcgtcggcattaccgctataaagttgcagctggatgcttgggtatgcgactaacagttgtttaacggcgcgcaggacggtgcggttgagatgggattcgcccagaccgattgccaaattgccaccgatgatattttcatccgtgatatcggtaattgcagtttctgtaagattaagaatctggcgcgcacgattgaccaaataggtaccatttgccgttagactgatcgcccggcgcttgcgctgaaagagtttggtgccaagctcggcttcaagttcttgcatttgtctggacaaggcgggttgagaaatgtgaatcttattggctgcggctgtgatggtgcccgcgtccgcaatggccacgaggtaacgcaaagttcttaattccactgagaagccccctaatgaaacgatctgcccggatggaaacaaaacttcagacgagatgaatcgggacagattgtttcgtttgagattttgtcttttcggttggtgaacgcatgttaattttaaatatagaaaaaacacataacgtaacatgttatataagcattatacatttttaaacgtctgaccgataatggaagaaaacataagaaggcacaagcaatgaacgataaagatcaacaagcaggcatttttggattaggtgcggttaatagcgcgtatcaacaatattttactggaaaaagttatctgaaaagtttagcaaatgcgtccgatggcgttgacgtgtacgtgtccaatgtgacttttgaacccggatgccggaataactggcatattcatcacaatggctttcaaatcttattagttacgagtggtgaaggttggtaccaagcggccggtgaacctgcacgcttattacgtccaggcgatgtcgtcacgatacacgaaggcgtcaaacactggcatggggcggctaaagatagttggtttagtcacgtggcaattaccaaagggaccagtgaatggttagagccagtctctgatcaagcttatgcacaactacgggaggtaaagtagcatggtgaaacaaacagccggacgcaaacaattgggtgaatttgcaccacagtttgcggctcttaatgatgacgtgttgttcggcgaagtctggtcaaaagaagatgaactatctgtgcgcgatcgtagtctcattacgattgcgtgcctcatgactagcggcgattttccgcaactaaaagcacatctgcggatgggcaaggagcatggcatcaccaagaaagaagtggttgctgaaattacccatctagccttttatgcagggtggccaaaagcttggtctgcgtttgctctggcaaaggaagtctatggggaatgattagattggcgcgcgattgactaaaacaatggattttatcagctaaaaattggcaaagacttggtggccgtgagcgactgaggctttgccttttttctgtgaatggggttgtcatcggaattcagaagaactacgctagttctatggatatcgaacaaaaagacgagaaaattgcaaacatttttaaagtccttggtgaaccgcatcgcattgagattttgcggatactttaccacgcgggacgagagctgacgtgctcggaggttagtgcgcagcttaatttaagtaaatcaacggtctcgtatcattttcgcgccatgcgattagcggggttaacacatacacgccaagtagcccaaaccaagtatttatctatcaacgaggcaacttttgatcggtttttaccaggctttctggcgacactttaattttttgtctgttagttcgatattcatcgaataaagggagatgcacaatatgcttaggttattttacgcatcaggcaccagtgcaatggcgccgcatattttattgacagatgctggtctagattttgagacagaaaaggtcaacttggatcgcaaaacttggcgaggcggcgattataatcaaattaattccaagtcatatgtgccaacgttgcaaatttcgccgacaaaatatttgactgaatgcgctgtgatattggagtttatagccttaaaagctaagagtgattatcgcagctcagaggagagtatggcttactggcaggaacgcatgtggttaaattatattgcgaccgaattgcacaaaaattttatatcaccatttcgccgtggtaattggctgccgaatactgcggattcaaaaaagttggtgtggcagcgtgtggtaccgcgattgcagtatgttgaggaacgtcttcaggggccatggttgatgggtaaacggttttcgatggcggatccgtatctattcgtcatgactaactggatgcggcggctaggcttttcgtttgatgggttgcagaatttacaggcgtttgacgaatcaatgcgtgagcggcctagtgtgcaggaggttcttagagttgaggggaagccgcatagcgtcacggatgtataaaaatggataaagctattttgaaacctgttagttgtttagcggcattgcggtataagtttgagtgtttttgggaaccgatccgagatatgatcagatcatctatctttataaagtattgaattctaaatggtttgaggtttttccgatgttgtgaattcttctgaattcttgtctggtattaggaagtcgtagaacgaatgatttaaacaaaaaactaggagcgattatcctcaaaaattaagataatcgttcctagtttcttgtttgcatttaatacctgtatcaattcattttgctgacacgcttttcaacattgctttctagcatgaaaggtaatgcaaactccttaactaaccttgcatcatcaactactgttgaagtatcagtattataatattgacttgattcatctcggacagctgaaaaccagttgaaggacccatccactaaaatatgaccatcgatcacaacttgcttggagtgaactcgaaatggcgaatcaacgacagttgccccagactcttggaggaaagcgacacccaaattaaagttgtccatttgatcaatataatgtgggctgtttttattatacattccacgactcgagtagatgttaacttgaacaccttgttctgtggccctttttatagccgcaagcaaaggttttgcaccttgtttaatggatcggccggaaatataaggagagtttatatcgacctgtcttgaagcgcgtaacaagtgctgaatcaaccagttatcatgcttatcagcgccaatcagtcgcgttgtgacttccgaggctttaaaatatgatgcaccccgcaattcattctcttcatgtgcgaatagctggcgtgcaagttgagatgatggtgctgtcccgttagttgataaaatatctgtatttccaaaatatagaaagctatccttggctcttgatactgccacatttagcatgttaacgccacgatcaaaaaagaaagaattgctcgctgtatcatatacaggggagaaaataataatgcgacgttccgctccttgcagagcatgaactgttccgacaatgatttcctcttcatccaagtgttgacgggtcagtgcttttttgatttctattgtttgttccttaaagggggtaatgattgcgacagttttccccaataactgatcgtgctcgttatacaaggaaagcagcttgtttttccgttcacttaaccaagaggcgatagcatctgcttcgcgctgattgtatcgactgccgtttcttgaagtggcgtgaccaaagaggtgggcatagcccatttgtggcaaatggacttcagttgttgctgccggttctttgcgcattgaaataagtctaccgttataggcgagtgaattaaagtagttcataatctgtggcaagcaacggaaatgttcgcgcagtagtagaccactatctgactctgagtctccagtaaaggcactttgattctgagcaagtgtcattaaatctcctgttgagactgtaaaaccattatccttcataacctttgcttccgactcagtgaacccaccgaggtttctcatatttgcctcatcaacattttcttggatgctccagatgggttggatttgtttcgtgtcaccaaccgcgaggaatcttttggcaagtgctaggctggcaacggctagctcagggcttacttgtcctgattcgtcagcaattaaaaggtcaatggcgttgaacaaaggtgttttttggtccatgaagaaagcatcaacttgataaaacgtaccaacgaagcaaggtgttaacatagctcgtaattgccattgctggcgtaatttggaaaagctatcgtttggctgagtttctgatttcggctgaacaacattcagtaaccatgttgcctcccaataatgggtcgctaaaagaaatgctaagtaccgcaacttagtatcgatctgtccgttaactgaatctgagtcaatattatagcgttgacaagcttgcataaatgtcgtcttcgctgtgttaatggcatctaatttagattgtgcatcatcaatctgtgctttgacccgttcatttgttttcctttcctcgtccaattcagtttccggattagaatttgccggtttacctttcaaatgcaaataagatgcttttctttcagccttgcgccgcggacctatgagcgggagataatcaagcacacctgattgttgattatcataatcaagccagtctgccaagaacttttcagcggccgtcaacctattgttgctgctagccaattctttttccagtgaactaagcgtcgttgtcaaggtaattatttttgaatcgttgtcaacatattgcccgcttgcaattgtttgtatatcctcgacaacttcttgaagaagtttatgaaggctactttgactttgttttaaggaatggcggtggttaggaaatacagtggagaacttattaagaaactcttccttcgcttgttctagatagtcagcttgaatcatctgatctaggtagtcagtattatttcgagaaatggccgcaaattctttgctactctccgcaagcttgtcggcggaaacgagataaagaccatacgtgtcgtgttatgttttggtaaccaatgagaagctaatatggctttgtttgacctagcgccttggtacgttgacgtgttgggaagataaaagctgtctaaatttgaatcatctgaagtattggacttaaaactgcggataatgtttgttacggcttgattattaactgaagaagcgacacaaattgggggcatagtttgcttgactgctgctttaatccactcagtcgctacaacactttgaatgagtgtcgtttttcccgtgccaggaggaccgctgactgcaagagttttgccgtctgatgttgcatcaaaataggctagagcatcgcgttgggtggccgtgatgccatacttcggcgtcatctgacctaaatgatgcgaataatgcgtttgaatttcactttttgacagtgaaacgtccttttgatcggaagaaatttccgggttcaatgaatctagcaatggcagtgatcttttagtctcaataatgacttgataaagcctttgaatccagaatgacatgccagttatctggccaccaagattaatacgacatattttgggcattgatgcgtgaaattgttggccactggtatattccaaggtgttaaaatctgatattcgttttccagttaagtctttgaacagtatctccgtttgcttgacataatctgtccacgacaaatcgttgaatgcccctcctttgatcccctcaaaatactggctaacatccgcaattggccggtaaagggaggacacggttgagtcttcaataactggagacataagatcacgtgggatccaaggtgttgcatactcctcgtgttccaattgcccactagcatttatggtggcaggaataataatggggaagataacccgattatagactggaataacaactggtgtgatgagaatatccagcgaatcttgcgttttaagtttcttcacaatactggcgttgagtgagttcatcttgcttgcagcaacatgtccttcacggaattcctcgtaagcaatatcgagatgaggacttttagcagcattaccacttattagcacgctctgacgcaaactttcaaggtagtagtttgctagcttttttctatcaatcatttaatctcccccacgatgcacataaaatgacgcgcaaaagtactctgttcaaaattttttagcaatgctattttggaaactagtataccttgttttttggccaaagtgtgagaattagattacaccgtctacgccaaccacttattatctccaccgccttaatccgattgtgcatcccaagcttgctaagaatggtggagagataattgcgcaccgtcccttcagaccaaaaaagacctcagcgatttgtttagagggtaagccactagtcacctcagccaaaactgtcagttcgcggtcggtgagggggttgctttcggcagtgatcatgtttcgagaatattaaaaattaaacagcatcaccccagtctacgttcaggagaatggggtgatgctgtttaattttaagttcaactgaggtaaccatgaaaactacgactcagctatctcaaaattgtttccagcgtgtctcagacttcaattcacgcagtcacgcggactgcgacgttgaaagcacaaggagcaaatcaatcagacaggatttcaattcgcgcagtcacatggactgcgaccgcaacatagtgtgttttctaaaacatgagaagaatatgtggcggttaaagatatttataaaatgtaaaaaagcaagtcttgagtcaactcgcaaaatgtattttgtaggaagagagcgaatgcactagcaatctcatgtgtaccttacatttgcactttgactttcatcgcgggagctctctccttcttgtctaataatataccataatacctgtccgcatcttcaacatttgttgcgatgacagcaaccctaagccaaccacttattccgcttagccacctccaccgcctcaatccgattatgtaccccgagcttgctaaaaatggccgatagatagttacgcaccgtcccttcagacagaaacaaagatgccgcgatttgtttagacgacaacccgctagcaacctccgccaaaactgccagttcacgatcggtgaggggattgctttcggccgtgaccatgtttgtcaccaactctggcgcgtaaattgtttgcccagtcatcactttacgaatgactgcgattaagtcgtcgcttggactgtcttttaaaagataaccgttcactttagcagcaacagcgcgctcgaaataggccttttgcgcaaaggtggtcaaaataatgactttcgttggcaagtcactctcatgaattttatcagcgacatcaaggccggttagtttaggcatttcaatgtctaaaatggcaacatcgggcttgagctgttgaatatcttgccatgccgttgcaccatctccggaacttcccaatacatgcaaatcatcctctaagtccagtagctgggtgagtgccgagtttaacatgctttgatcttccgcaagatataacgtaatcatgagacttgttgctcctttggtagtgtcagtgtgacaagggtaccttgtcgagtgtgggtgattgtaaaggtaccgttcacgtcattcattctttgctgcatgccgctgataccatttgatccagcacgagcataattatttttggatcggccgtcatcttgaatgttgacgatataggcgcttggcgtttgttcgaaagttatctcaacttgatgggcatgcgcatggcgtatcacattcgtaatggcttcggaaatgaccggacttaggtgaatctgtaccttggttggccactcggtggcggcattttcgccgtccgtcagcaaaaccacattggcttccgcaagatttttcccttgcgttaacatcatctcacttagcgactgttggtgcaggtcattgacgatcgagcggaccagttgcaaatcgtgacgactggtttgagcaatgtcgtccagttccggtccgacgcgctcaggtgccttgtccagtagttttttggcgagctcagccttaagggtcatcatcgaaaagctttggccgagggtgtcgtgcaagtcgcgcgcaatccgttcgcgttcaccacgacgaacgatggcctgcagacgccgatttgtttgccgaagttggcgttggcggataatggagcgtgaggcagtataggcaaagattggggagacaagcgggaaaacaagattgagcaagttaccatttgagatgtttaaagtacccggatgaaccagattggcgcgccatagacccacgagaataatgaggtaaaaagctgtggcgaaccagtgaaaatattttcgtgggtacctagctaaaataaaggatacttgccaaccgggataaataatcatgtaatcattgaaggcgaagatggcaaataaaccggtgatcgccagctccagcggaatggtgacgggtagccaccggtcgatttcgttaaccaaaatgtagacgaccagaaacaccacgcccaagccgagccaaatccagtcagtgaccgattttgtcggaacatattgagccatgatatacggcaaatagaccagccaaatatagctggtccattcaagattcattaaccatgaccgaagattatgcttcacccaaagccacgcccttccgttgttcatgttttgtcatgacaaccaccagcaaactgccgagcacaaaccagacggcaatcccaactagatttgttaagtctactgtagcacgtgaggtcacctgatttaagagattattcacgaagtaagtcggcgtctccttgccgatggtttgtaaccacttcggcagcaggctgatcggccaccataagccgctgataatggccatgggaaaagtgagtaagttactggccaagctgagcatttcttcacgccgaatatgagacaacgcaatgccaatcatcaggataggtaattgaccgaccaaaataatgccaaggaagcctaaccactgactagcatcaaggctgacattgttaacgccaatcgcaatgccgcctaagacaatcaccgaaagcaagctcatcatcaacatccaaaaagtgattgagacgtaataggggaccatgccttttggcgatagtcttaaaaatgtcgtgaatcctttgtcgcgatcgcgtttcaagatagatgcaatgctgaaaagagcttcgaggagaatgctaaagacaatcatttgatccatataactaatattaaattgtttaatttcaacagcagagccactgatcatgactttggtataaagcagatagaatcctgctggcattaggagcgagaagaaaataaacgaaaagttgcggagcaccaggcgcttgccgtcaaaggccacttgagctaagaatgttttcatgattgtggaacctcctgtttcgttaactgtaggaaaatgtcttcaagtgattcgcgattcaagctaatttgatgcaaacgatcaagcattggaacgagtgctttcagcgtctgatcaccgttgcggctgtgaatgaccagtttgtcgcccatgctgtggacgtgatcgacatcagccagtccgctaaaaatggctggttgcagatcagtttcacaagtaattgtggcgcccagatgttgtttttgaagctgttgtaaggtgccatcgaacgtaaagcggccattttgcaagatcaataagcgatcggcaatttgctgaatttcttcgaggtagtgactagtgataacgatggtcttgccttgttgtcgcagttgttcaacttgatcccaaaaagcttttcgggcattcgcgtccatgccgacagtcggttcgtctaggaacagcagataaggttggccgattaacgcaacggcaaaggtgacacggcgcagttggccgccggagagattaccgagacgctgggtcttgagttgcgtcaggttcagatcggcaagcaagctgtctgggtcaagcgcatgctcagtctgttcagcggcaagttttaacatatcgccgacagtaatgccggggatgatcatgtcgccttgaagcatcgagccaattcgggccttgctattggggttaccgggctttttgtcaaaaacgctgacggcgccttttcccgataaaagccctagcaaaatgttcagtagcgttgttttaccagcgccgttgacaccgatcaaaccgatgatttcgccggcatggacggttaagttaatgtcttttaaaacctgtttcttgtcatagttgaattttagatgttctgtttgaatgattgtggtcatgttgtccacctccactactgatactacgtggtcgggggatggggtagtagtcgcgaatgtcatgaatgtggtgtgacaaatgtcatgtattgcgaaaaggctgacagcatgctaaatgggggcgctattgtgcgaggcattcttcttgtataatggaaggcatcagacaatggtatggaaatagaaagggaccagcttatggcagcagccttatcagcacctttgcggcagttattattggcaacccaattaggtttgagcgtgcatcatccgcttgccggttggtttgtgttgacgattctttaccgtgatgctggcagtagtagtgaacccattacgttaagttacctggcacgaaaatataacaacgattatctggatacaagcggcggcgaaacgccgattgctgatgatgttttgaagaaagtgcttgatgtgctggtcacacaagccggtttggtcgagatgaatccgcgaaaagtgcgtgctcgcatgcacaatggcagctaccatattatccaatcttatgtttatcggattaccagcagtggcagcgaatatttgaaaatgatgcaaaaagtcatcgatgctgaaacaaccattactgctaacacgaatcgtattcaagaatatgtcgatttggtgaaaaaattgagtgcacctgtgcgctcagccgcagatactcagctttataacgattttaaaaatatgctggatgcttttgatgatgtgatgaagggcatccataaacttgaggatgatcttgatgaattggcaaatgatattgccttcaatcacggtagccaggcggccagtcatttgcagcagatgctgcgtcatcaggcgatccctgcttatcgagaggtgctgaatcaagcctcacgcattcagggtttagttaatgatccaacttttgtagatcagattgctcactccttacaaggcagcgatgatatgaatgcggctaaggttgttggtcgcgaggatatgctggtaatgcggctgcagcgggccaaacaatgggcgcaggcgcagatgaccagattagcactcagtatgagtccgactgccacagcgattgacagcagtctggattcgatttatttagtgtttaacacgttattgggcattgttcacttgttaagccaggagtttaaacatgccaagcgccaaaccattgacatcaaggcgctctccaaaaagttagatggcttgctggcacactatcaacagcttcatattccagcgcaggtaccacggcacttgccggcggatcgcgaggtagaagatcccagcgatttgcttgatgcctcaacaatgggaccggtcagctacttagcgaatccgacccgcaagcagccagccagcgagaccgataatccggatgtcaccgatgatgcacccaccgaacaggcgcaggtggcagggttacgcgaatttcgccaaacgttgatggtggatgatcgtcacggtcgggtggatcacgatttgacgttgcagactgtcacagcgcgggatgagattatcaagttgtttgcggcgacttatcacgaagatctgaatggctttgccccgttcggccgtcccgccaaagcagtggatgccttaccgaacacgccgccactgcaattgcaggtggccggagaagattatgcggtcgtgttgccgtgcggttttaagtttacgtttgcttgaggaggacgcttatggccagaattaccaagttagaccagcttgccatcaatgaattgctggatcatggcgtgtttaccacaacgccattacccgctgcgacccaaatcagtcgcgctgctattagtgaacttaaaaaaccgtccgtgcagcaaaagcttagttactatttcaaaaatatgttcggtgcaacgccggagaattttcaagaaaatcttttcctcatgatcggtaaggaagaactttcgccagaagttgtgcatgtgcttttggcaaccgtgaaaacgatcatcaatgaaccggaattacagagcaatttggaggatcgtgccattccgacgcaaaaaatcgtccgtcaggtgcacagcgaagtgaccgagcttgacgaacgcgaattactgcgttgcattgatgcactctttgtgaagcgttttgggctgttcacgccggatcggcttgaggaaggcacagaaaatgttcctgccgaaatcgatgattactgggagattcatcccaactttaacgaatttgcccagaacctggtcgattttctgaaaaatgaccaaacgcaaccggttttgagcgaggttcaaaaggttaatcgggtgttgttgacggaacaattcatgagtcccaaaaccatgccgcagctttggccggttcttgtggcccataaagaagccattgccgaacagtggacccgaggcggccgtttcgtcctggaagtcggggatcagtacgcgttattgctggatcaacagcggcagcccagcgttgccaagccttacctcgctgcgttagttgtcgcccatcaactggggtcgggcgtggccgccgctgacttgactggcttaatcaaaaccgtgacggccgaactttttccaggcttcacgattcaaccgagtcaggtaaaggccgccttacttgaaaatgatttaatgcgtgctcaggatgattactgggtgccaacgccgattgtggcgcggtttgcggtgacgcaggatgaagaaagcaaagaaggagctaaatcttgacgcaacaattagtgccagtcagttatcatttgcgtaattttaataagtacgccaagttggacatgcaagcggccgaaaatggcaatctgaccttgatcggcgaaaatgcggtcggcaaaacgacgcttgccaactgtttctttccaatgctgattgatggtgccattacgacgccatcgtttaacccggcaaagaacacggagaaagtttcgcaaagtgcgagtgtccgcaatagcagtcgggatacgcggacttttgaatcaatgttgctcggctggggtccgggcgctatgaaagtgcggacaggttatagttatgttttgatgcgctcggatcagcgtcaagttatcttaggtcttggtgcgacgcgggtgcaagatgatccgcgcaagccaacttggtggtttattgtcatcgcgccgaacccgactgatgcgttagagcttcacacaacggatgctgaagggaaaagtctggacaaaaatcagtttaaagctgcgaatgcgggactgggtgaccaactgcatgtatttgataggccggaagattatcgagaatttgcggcaacgcggatttatggcttcagcgacggcaaagtgctaggccgtctagcaaatgcctatcgcttattagcctcgccaacgttaacgtccggcaatgaaaagttcgcaccgattcttgcggcattaaaagacgcccaggaaggtatcgatgatatggtgattcgccgagtcgctgacagtcagcggcaggtgaatacgtatcgcggactgttaaaacgaatcagcgaaggccagcggcgattgaagcaaatgaagtcgcggattttttggcataacctgaatcatcttcaagagattttattgacgccgtatagccaacggtttgcccgcaattccgccaaccaggaaaaattgacccatacgcagcaggaagtacaggcttattccgcacaattggctgatttaaatcaagcagtaacggaaataacggagcaggttgagcagttgcgcaacgaaaaagccaagcaggatcagctgattaagcgccgggcgcaatatgaggagcaaattgagggcaaccaacgcgtattagacgattatcggaagacacagcaaaaagtcgcaacattacagcagcagctggcaaccttggccatcaaacatgaccggattaaacaacaattggccgatcacacacaaaccaatctttccccgatcagagtcaaactactcgctttgacaagcaccttgaacaacttttcccaggtgatgcaggccgatgactggcaggagattgaagcagaacttgggcattatattcatcaagtgtcagcggcaaaagttcagtacgatgggatagaggagaccatcaatcgcctcagcgccgatgtgggtattaccaagcagatgcaagccaaaatgggaaccgcgattgatacgcgagtccaggggtttggtagcggccgagttcatgatggtttgcaggaagataaccgcactattcatgaagctggcgcggcgcaaatgaacacgcaatatcagctattgcgtgaccaacagtcagcgatcctgaaaaaacagccggatttgactgtgattttgaaagatccaacgattttgtctcagttgaaggatctgcgcaaacagctcaaaccgctggtgcagactttgcttcgcatacaatcgctgttaactgctaatgaaagcgagcaaaaagcgcatcagggcaaactggatacgctattagatactttagatcctggctttgacgcggatgaactggcgcaaaccatcgcgcgactgaaggccgaacaagcggcattgaaaattgatccggaactgccgaaacgtttggctgcggcggtcaataagcaaagaaagttaacccaacagttgcaaagcgtggaaaccgaaatcgccaccagacaaggggtcatcagtactttgactggtacgattaaaacagacacggcgcaattagccaaagaggcggcggatgctgcaggaaagcttaaaacgttgaggccgtattttccagagggcgttcaccttactgacatggatgagctgttggcctttgccacgagcaatcgcgctaaaattcgcagcagcagttatagcgatatcagcgcgcagattggcaacctgattcatcgccacgatggtcacggcgaggatcaaaatgcgcttgatgcgctttttgccgatcggggttttcctgccgaggcaagtgcaatgcgccaacagcgttcagtcgcagacaatggcttgaccgtggtggcgtttgacgttaacaaagcattgaaacttttagatgatgatcatgccgcggtggagaaagctttagctgaagaacaaagcggcaatgacatggcttatacgacctttgtccaggcggcaacggcagcgatcagtgcgcagtacaacgtcatcacgacctacaaccagattcttgccgctggagccggtcatcaacatatcaaattgaaagttcgcttgacgccgatcaaagggatcgcaccggaagccatcgaagaagcctgtgatccgcagcgtcaacagcggccacaccttgaggcattggtgaagcagcgccttgatcaacttgccaacaacaccgaggtttcgaatgatgatgaggcgttctttgctgctgcgcgggagttgctcgatacgcgcgaatggtccgattttgaggtactgattcggcggcgtcaaagcggcgaaaacgattttgaagtcgttgacgataaatttgtccagtccggcggttcaggcgcggaaaaggcgcaggcgatggtattaccactcttgctggtgccgaaaatggttttgcaacggtcgaatcgtgccgatgcaccgcatttggtcatgtttgacgagtttgccgataaactcgatccggaaacagctaagtcttttgccaaaacgattgttaattttggcttcagctttattgctacgatgccaagcggggcgcaaaacaagcttttggcagacggcgttgacaacattgtgtgggacgtcatggcgtcaccgcagcaaggcgacggccgcttccatttaaatcgcgttcagcagaactttatttggaaaaaggacaccgataatgattgagtcatggattagttaggtaagagggggatagcaaggatgagtcgttacagcgatgcttttgaaagccagacaggacaagcagcaccggaaaaagctgcgcaactggatcaactgtttgatcaaattgcgcgcgggaaagccttgccgcctcgcggacaacaggcagtcgcgctgggattaaccgcgcataccttgaacgatccgcacgaagatccgccgctttttgcctattatcgctgggtcatgacccattgctttcagtccggccaggtcaatgaactgacggcacgcctcatcggaatggcgtttacctcggctaatatttttgcgactgacctgcctcagccgctgacattgaatccctggcagctcaaaccaatgctcgactttccgctgaaaaacacgcgggcggtggtgatcgaaaacaatggcgtcttcgcattgctgaatcaggaatatccggactggccattaattttgcaatccggcaatgacttcaatgatgtttatgttcagcttattcagcgcctcgaagaccgcggcatgcgttatgcctatttaggcgatctcgacagcaaaggcgttcaaatggccgatcaattcgcgcgattgctaaaacagaccgctgcaaaagacgtggcggccttacagacacctaaagatgttcgcatctggctggccgatatgggtaaaaaagatccgcatcgcaccagacaattaaaggtcgtgatgcctgtctatcaggctgagatgacaacgatcaggctattcgggaagtttgttgagcaagagcagttgatggggatttatgaaaagcggattgggcagtggcttgacgcgggaaagtaaggtaccgggattgattgatggaagatgcttacaaataggggaaacgatggtcgcatacacaattaaaaattatcaatcggaaatgctggaaagctggttgcgttgtcgcgcactggcatatatgcgtagttcgtttcaggacgagattactgccgaaaaggaaaatgtttcggatgccacaggtgtttcacttgtggcaattaaggatcaacaagttattggtattgccgaggctatctttttgaatcaaggccaggcaaaagcggcatcttatggtcttcatgaaggaacagtcctgaccacacttgatacgattgcggtgcatcctgattatcaacgtgttggaattgctaaagccttgctgaagcaattgcgcagccgattaaagatgcgcggtggtattttactgatttatacgcttgatgatgatgctgccaatggcttgtaccaaacgattggcgccaaactttgctatcgggcatccattgttcatggtcacagttccaagaatcatgtaccggaatggacacattttcgtgtcaccgatgataagcaggtagctgtttacgatgaacatgatcaggagattgcatatgggcaggacatggagacatattatgtcggtaagtctgaaaacatcaaacagttgacagatgttcacaaagttgtcactgaaaatgtctatattttggagctttgatcggctttgctttaaatttacaaaaaagattgaagttctttaaaaagtttctgaaacggtgattgttgtgtcagtacgcttatttacaagtgtgctggcatttttagctatcttgcaagagaagtgacaccgtgtcaccttctatgattcaaaatttgaaattgtcattaataaatgccgcgaaaatacttaatgttccgaatccattcccgtttgatatatggaaaaacacactgcacgtaagcatttttactttgcggttcccagccgttcgttaaaagccagtgttcatcgaataacttttcccagtcatgatcattaccagaaagatcgtcggaaaaattgccatggccaagaggaatatgccacgcatcaaaatcgcttgctagaacaagttggctgggaatatcgacgattaactgaactgacgcagcacgccgatcattcaagccccgatattggacctcatcgtgaagcggatgaatccagccccagagtaacgcgttatcaggatttagcggcattcgacgaagctcaaactgatgacgcatccattcataaggttcccggaaattgctaagatcgggctcgtgccaaacctcgcgagaacgcggagtggttagtgtgttacccggttgtttgataaaagaacgacgttgcacggttcgaataagcatgctattaccccaatgattagcgttattggcacaacatttcacagccaatattcgattatctatttaaaaattttgctatctatgttaacggaaatgaagcttttagcaaaatctattgttaacacaaaaacttataaatgatggtcggttaagattgggggaggatgttaacagcactcaaatatgttgaatcatatggaataaagcggtacaacgtggacataataattaagtggaagctgtccgtgtgttcaaaccgagttaactggcaaaatatcttgacaagagcctcaatcgatactgtatgatggttcttaccaaagttccgctagctagcattggtttgaacgcttactctgagcttcctctaaagtggcgtttaaccagccaattgagaggaggtgacaacttttgattaaaacgcataagattaagctctatcccaatgcaacgatgcggcgtgaactggagcgattgtttaattatcgccgatttgcttggaatcaggcccttgagacttggaacgccatgtacgatgcttctttggtgatggcagacaaaactttgcgaccaaatgaacgcaaagtacgggatgagctggtctggaacaaagccgattggcagtacgaacagtccgcccgggttttacagctcgcggtaaatgatttaggtaaagcgtggaagaattacttcaatccgaagatgccgaaccatgataagcccaactggaaatctaaaaaaagatcccgcaaaacatttaaaacggatcgagcgcaacttgtgaatggcaagttgcgcttagataaacctcatggtgctggtgcctggtatgacatcaagctggcggaacaaccacgctggcaaggaaaattgaaacaggtttgcgtcgttcaagacgctgacggttactatgcctccttttcaattgaggttcagacttctgttgaaaagaagccgggtctaatggtcactggagttgatgccaacatcggcaagtttgactatcaaacgtcaactggttatgcgactcaacccaccttacctgaacgtctgccaccactttacgcccgcattgctcattatcagcgacaattagcgcgtaagcggaaagtaaattccaagcggtttaactctgcggcttatcgcacaacgagagccaagttgaagcgtcaataccaacgagttgaacggattcaaacggatttactccaaaagtttacgactatgctcgtcactgattatgatctaattgggattgaggatttggataatcaccatatgcgcatgaataaacggctcgcgaagaatctgcatcgatccttgtttggcaagttcaaagtgatcatgcaatacaaggctgattggtatggcaatacgttggtgctggcggatcggttttaccccagcacccaacgttgttcacgatgtggttatgtgaaaaccgctgatgaacgcatcacgctgagtggaaacttgaaacatcatactggtcacgatgattatcattgttaccagtgtggggtaaagttgcggcgagacgaaaatgcggtggagaatctgatagcttatgcaaaatcaaaggttacggggtaggctatacccttaaagttcaggagacggtcactgtcatgctgaattatttcagagtgggaataccgttgttgacgggactaaatgaaatgtaggattgtcaatcaagaaaggaaatatataaaacctttattggtgtcgcagagacattcttccacattttatatagcaggcgcaaatgactagggaaaaacttaaaaagttgggttctgatgaacgcttcacgtttcaggcaacttatgccgacattgggatgaagcggacaacgcgcgggaaaatcaacacgcgctttttgccaacaatcttatttgaacgtgtcatgcttggcgatcaagaggtcacagatcatctttggctcaattatacgaaacagtttgccgaattgggacttttaaccaaaggcgagattgttcaattcaatgcgcgcgtgcatcggtataaaaaaggctatgcagcggtcaaggtgattgattacggcttgcaacgacccacgaaagtatcgattatcaagagcttgaccgacaatcgcgctaaattaccaccgttacctgatgagaagaatgccttaatcgggcttgttatgaaaactaataaggacacttacctcaaaaacgggcgtggatttgatcagtggtatgtcgatcaatataacgcgtggctgcggaccgaaagcaactcgaccgagtactgatcttttgccgaaaatcagtcaaagtacgaatccttaaaagaaaaacatccgcaattttggtaatatggtacttattgagtcgacaagaagccaagtagaaattgtgaggaacgttaaattgattgaagaacaaactgtccagttaatgcagcaggatttaactaacatcactcatcatcagatcagcgccgttttgaatctgatgcaagaaggcaatacggttccgtttattgcgcgttatcggaaagagatgaccggcagcctcgatgaagtgcagattcaggcgatcgaggaagcgtacaagcatgtgacggccttgcaggatcgcaaagaggcggtgatcaaaagcattgccgagcaagggaagctgacgcctgaactggagcggcagattcacgccagcacgaagcttcaagacgtcgaggatatttacttaccttataagcagaagcgacaaactaaggcaaccattgccaaagagcgggggcttgaaccgtttgcgcgctggctgctgtcgtttcccactggcagtttgaatgacgaagcgcagaaatacgtagacgcggacaaagagcttgcatcagtgcaggatgttttggacggagcgcacgaaattctggcagaaacattcagcgagattgccgccattcgtaactgggtgcgcaattttacgatgcggaccggaaccattcgcaccacagttaaaaccaagggtaaggacttggacgaaaaaggcgtttaccagcagttttatgattttgaagaaaccatcaaaaaaatgactccgacccgaaccctggccattaaccggggcgaaaaagaaaagattctgacggtcaaggtgctggtcgatccggcttcggtcatgcagtattttcattttaaaatcatcgataatcgtcctgacagcgaagcaacggcgttcattgaagacgcctatcaggatgcctataagcggtttgtcggcccggctattgagcgggaagtgcgcggtacgttaaccgttgacgctgaagaaaagtcgattaaagtattcggccagaacctgtacaacttgctgatgcaggcgccgattaagggcaaggttgtcctcggttttgatcctgcctaccgcaccggttgtaagctagcagtggttgatgagaatggtaagtttctcgataaagcggtcatctatccgcacaaaccggcgccggaaaagaagcgcgaagcagcagcccccgagctaattgcgttactcgaaaagtatcaggtaaccatgatcgccattggcaacggaacggcaagccgtgagtcggagcagtttgtttcagaaacgctcaagcagattaaacgcgatatttactatgtgatcgtgaatgaagccggtgcgtcggtttattctgccagtcaggaagcgcgtgatgaatttcctgatttgcaggttgaacagcgtagcgcgatcagtattgcccgccggcttcaggatccgcttgccgaactggtgaaaattgatccggagtcaatcggtgttggccagtatcaacatgatttaccgagtaaagagctggctaatgaagtagatgcggtcgttgaacgcgcagttaaccgagttggtgtgaacctgaataccgctagttaccagctgttgacgcgtatttccggtttatcaaaaacaatcgcgctcaatattgtgcactaccgggatgaaaacggtcgctataatagtcgtactgagctaaagaaagtgccgcgcttggggccgaaatcgtttgaacagtcagttgggttcctacgtatcattggcggtaagcaaccactggacaacaccgacattcacccggaaagttatccagtcgccaaaaagattttggccgcggcaggtctatctgaagcagaccttggcgatcaacaagcggttgccaaagtcagcaacgttgacttagcaccattcgttaatgaaggcgttggtgccgaaacacttaaagatattgtcgccagcctacagaatccgggccgagatttgcgagacaacatggcggcaccgattttgcgcaaagacgttttaactatggcggatctgaaaccggggatgaagctggagggaaccgtgcgcaatgttgttgattttggcgcttttgtcgacattggggtgaaacacgacggcttggtccatgtctccaaaatggcccacaggttcgttcgcgatccgaaaacagttgtagccattggcgatattgttgaagtctggatcgaatcggtggacttggctcgcgagcgcattcagttatcgatggtcggccctgaaaaataatcaatgatgatgggcggcttttggtagctgtaaatcagacaagttagataaacggattgtcatccctgaattgcggatggcgatccgtttttttgtcaccatctgaaaaaaatggttcgatttgaaatacgcacacatggatgttcttgaaggcccgaatggcaccgatgtaaggaaataacgttattttaaagagtacaacctcaaaaacattgccgccttatattaagattttggttgaaaataattatataaagattaaaatacaagaatatctaaaatacaaggagctgatagaatgcgaccgattatcgcacttacaggtgattcaatggtcgcgccttcgcctgtcattaatctaaattacgcagacatggcgcccaatatgattaaaaacgccattgtgaaagttggcggtgcacccttgattttaccttatccggaagatgatgctgcttccgaagcattagcacaacagtatgtggctgttttcgacggattggttttgccaggcgggccggacgttgacccgacgttttaccatgaagaacccattcaagccatggggcgtgcgacttatcaaaaggatcggtttgaaattgccttaatcaaggcgactttagaagcgaagaaacccatttttgccatttgtcgtggtattcaaattttaaatgtggcattaggcggaacgttgtatcaagacttaccgagccaaaaccctaaagtcacgattcgccattcacaagccgcgccgggacagtggccaacgcatcatgttgcgatcacgcccggttcgcatttagcgtcattgatgggcacgagcagctatgtgaattcccgtcaccatcaagcggtcaaagaagtcgcgccggatttgaaggtaaccgcgcaggctcctgatggcgtggtggaagcggtggaaagcaaagattccgatttgattctgggtgttcagtggcatccggagaacatgtggccgagttttcccgaccaattaccattatttagcgacattgtgaaacgcgcaggaggtgaggctcatgaataatagcatcgtgaaaaaagagcaaatgggctactggagtatgattttacttggcatcaacggcatcattggttccggcatttttcttttacctaatcaagccgccaaattaatgggttccgccagtattttcgtgttattgtttgatgcgttgctggtgattacgattgcgctttgttttgcgcaggcggccacttattttgatcgtgatggcggcccatacttatatgcgaaagatgcgtttggcgattttgtcggctttgaagtcggctttgtgacttgggcgattcgcattattgccgaagccacgatggcagttgcctttaccaccgccttggtcggcacgtttccgtcactgaaccagccagtgatcaaagacgcggttatttcggtcatggtcatcgggttagccctgatgaacatcgccggcgttcgggtttcgaccgttgtcaacaacattattagtgtttccaaattggtcccgctggtgttattcgttgcgattggcattttctttattaaaggcagcaacttcacgccattattccccggcggcagttacaaatccggcagcttcggccaagccgcagttgttatgttttacgcgttcaccggatttgaaggcctcgtggttgcggcaggtgacatgaaaaatgccaagcgtaacctgcctaaagcggtggccacggtcatgacggtggtcgcactcttttatattctgattcaggttgtcagcaccggcattttaggcagcgcgttggcgaatactgacacaccgattcaaacagcctttgccaaagtggcaggcggcttcggtaacgccttagtcgctgctgggacattgctctcaaccggcgggctattggtggccagctccttcatcaccccacggtccggcgtagcacttgcggaaaaccacatgatgccgcaactgctggccaaacgtaatcgcgtgaactcgccatacgttgcgatcattgtgtccgccaccatcactctgatcattgcctactccggcacatttggctacttggcgcaaatcagcgcagtctcgcgatttgctcaatacatcccaacttgtttggccgtcatcgtctttgcccacaccaaaaccaaagacaagagcagcaccttccatttgcctttaggtccggttatcccggcagtggcgatcttggttagtttgtggttgctggttcaggtacaggtcagccagcttgttattggactgggtgcgctcgtcatcgcggtgccattttatttcttgacgtatacgtatcgggagcatggtaagtcgtaagttatagaataattttctaaaaagaaagccagcttgacttgggagagtcagctggctttttgcggacattgtgtttttaggtattatgtattgcatgttaggccgacctggggtatattatgtgcaggaactagatggtattacccactagcagagaaaggaaaaaagatggcccaggatttgcacacacaaatgctcaaaggcatcttgcaaggttgcgtcttgatcatacttagtcgcggcgaatactatggctatactttaagccaggaactcgaaaagtatggctttgccgaaatttccaaaggcaccatttacccgctgctcatggctttggagaaaaaggggctgatcaccagccaactaaggtcatcaccggacggccctccgcgtaagtattatcaagttacttcggacggtatggttgcctgtcatgattttatccagcaatggcaccaattatcacagcatgttacccaattattaaccgcagaggagggcgtgagccatgacgaccaaggaagaccaactcgttgaggaaaataatcagctccgtacacaactgacacctggcaataaacattattatgaggatttgttggtatatatgcgtacgggagcggtattaaaggacagcacagccatcgaacaagagttactcacgattctgacagatattttagctgcacaaaaagatggcgtcacagccgtagagtattttggcaaacaaccaaaggaaaccgccgatgatattctggctgaagtcccgatcagctggtttaaatcattcaaaatggtcggttatgttttgatcacctattttttggtaacaaccattcccgccttaatgatgccaacgcaaccttgggacatcggtgaagaacttcttgttggcatttatttcacctttgtggcgctgggaattgtcacttatattgggcacacaacttataaaagaaatcagcaatgggggcgatggaggatctttctcctttggctggcgtgttgtgcgcttattgcgccagggttcctactgccactcttcttgaaaacaccttggcaacttgatttatcaggtgtcagtggcgttgtactcattgctatcttgttaattgccctaggatttgctttttggcggcaagccgataaaacaatgtggttaccatttgttccgattatcggtatcatggccgttctcggaatcgccacccgtgtcccggcctggcaacctttcctgctcaagagcacagtagggcggatcggcttggcgtcagtgttgattttggggattattgtttttaacgtgttgatttggttgaccgttcgtaagatgaagcgggatgattgaagccgattaattgtttgctgctgagatcctggctattttggctgttgatttgctcatttgagtttactacggtgtcaagtatgagacacgaaagtatgacttttttaaaactggcttgtgttttgatgatgaaagcacgagatttaaagatcactattttaaaatagttagcggggaaccaatcttatttgtaattttgataatttggattgacgataaatcgtttcttgtccttcttgtcaagagaatagaaagtcttactgttaggtacaattgtcattatggtttctcccccttgttcgtcgcttacgtagccggcaaaatgtgtggaataaagttgctggttctgggcggggaaataaaaactgatgtaatgtgcgttgtcactcggagctgggtcttctgagaagtgataaataagagttatactctttgttttgttattagtatggtttgtatctagagcatatttgactttttgggagtatgtaaattttccgactttgcttgtatcagcatcgcgccatgaatcaccatatgattttcttaaccgctgaagtatcttatctgtggttttcagccgtgcaatttcaccgaaagttatcgaaggaagatttcttccgttcgcgtcgtggggatcagattgaaccgttaattctgctactctgtcattttttataaggtaaacagaccccggccgagaatctttatccaatggtatgggtgcctgaaagaatatctgtagttttggactatgcatgattgaattcacaactgttctgttgtcagggagagattgatttgttgtgattttgtttgtgctattacttgttctattgctatgactgcaaccgcttagtacaatagtgcccagtagtaaagtcaatgcaatagcaatttttctaattctcatttgtttattcctccaaagatttaattttatgctgtgattgtggattagaattcttgaccttgccatcgaatatccacggccttcacagcttatttgttctccgttaactgatggtcaatgtaggttacgaggatggcctttagatacaacaaaaaccagcttatgcttctttgcaagctggatttgtcggtgctgtgttatatgcttagtctgcctgtgaacaaaattctcttgaaattgaggaagtatatgcagcaggaataccgattataggtcatgcgaaatcattatccttggaaaggaatcgtaatgataccattacccgtaaaaacatagggactatctagaggcctcttcttatttaaatcttgggcaaattgatccaaatcaactgttactttggaagcgtcatgtttcttcaccgcagaatcgagaattagttgtacatccaaactatcaaactttgaaccgttactttctgttgttatgtctaggtcactagcaatcatctggacagctgtatcatctactttccacccgacagttggatcgcttagcatatgtccttttaagatcgttgctacgtcaatcttttttccagtgggaatagttccgacgacataacgtttttgggccacttctttgccgttgtgtgtcaatgtcaacaaatatgcgtcaccctgctgaacattgctgattgtgttgtttatattaaacaaaggacgagaggtgtcatcatctcgtttaatagttcctttgaattgctgagcatacttttccagcgcctcaaatttactttttaaactgctgtccacgtcaccataatcaccataaaaggcatccattgcggtttctatttgatcatagctgtcaccactttcggcaaaaattcgaatttgaggggcaatttttttagagaatttgtcaatttggtcactagttaatcccaaactcttgcctttaagatcaatcatcttttttgcaactgattgatcgttaagaactgcgctagcatgatctgatgttccctttacttgaattgcatcggctaagtattcaggatgcagtgactttgaggacgcctttgaggcagaagaaggggagttgctagagcgagtggtacttgctgcagtgctggaatggctaaccgattgagtgcttttctgatttgaactgcatgcagacaaagttagcgggatcgtcatagagactaatagtgctaatgttcgaatagttttcatgttcttctccatatcacattttttcgatgatttctgatgccactagtgcgtaataatctctttcggcttgtttgcgcttctccttatcgccacttaagaacttaatgcctttacgtgttaagccttcaagaaaatcactatggctagatccggttcccgaaaaaacatcaacaatatgattttcccttcgagcacctttgtcgaaaattgcactttgtccagcttggtaggctgtcacgaaggcaaaggcagcttgtttttccattttaaagacatagtagaaataatcgttggggtgttcgggatgatacatgagaagacaagactcagatgaaccaaataaaccaccagttttaagttcatcagtggcaaaagcaacaggcaattgggcagctgatgcgttggccgcgagtgcgttttgcacggatgacaaagaaagcccgccctttgaatcatgaaacttaaagcgaactaattgttgtcgtagttgattttctttgatcattgtaaacatctcctccaaagatactgttatttgacagttagctttttttaatgaagttcagtagcaaaactcaatagaacgaaaaatcagccaatcattaccggttatcattcgataagttctgatggtctttttctgccgcttgttgcattttataaatgatttgccaacccgtaacgaaagcgaaagtacaacttagaaacataaccaaaaaattccaaagggttttaataaacatgcccaaaagccctaaagcctcattagcattcttgccaggttgaaaggtttcggtatgcgacgtggcgtttgcagtgatcttgggaataggaataccatgggagtctcgtttaacatcatcgaaaaaatttcgttcccacttcacattcccaaacatatctttatcaacctcggcagtgaccttcgttgtcgttcttgttgcataaggaagttcgtcatcgcgcatggggttaatcggtctgctgtcgtctgctaatagtttgtcagtttttagacgaacaaagggataaaaccgacagtcggtatacaacactaacgcgatcagaagtgagaagatcaaatgcgggatggagacagataaagattgaactgaactggcaaaagacattataaacatgtcccgaaagtcagagtatacatttcccaagtcagtgagcaccaaggtaatagcgattagagccagcgcaagactcgggattgtgatatattgtcggaactttaattggccagaaaaatgccaaatacgtttcatctttttcatagttcacccccttaattttgataagcgccaccacaggaatcgaacctgtgcagaaatattctggtaccaacgtggcttagttgtcgtggataacaagaagaggcatgtgctttagctgctagtaaagcatataggttcccattctccctgtggatactgcagtagaaactcggtagtaactgcccgtatcaacgacatatacggcagcaactaatgaatcaaaattactgttaattatgttgtcgtaatgtccaccaacttttccatcattgttttcaggtagttcatcagtaatatattgttgatacatggcattagcaatttccttgatgaggttatcaagatttcctacaactgcggattttttaatacttgattgtgaaatgttttcggtgttaaaggtctgtgagggctcgccgttcacccaaccgggactatattgcttgcctggaacttgtttgtcaggtgaaccatgattgaagtcgtacatgacctcaacagctcgttcggccatagctagattatcttttggcaatgtattgagtttggttaaagtgtggccggttcgcgtttgctccttatttaccatttcgttaaataacttggctacacgcaaagataattcggaattagtataggtttcggcttcttggatatcgacttgtgtatcgtctttagtaatttgatctgaaatggcttttgtcatcggatcatcggttttcttaatggcagcaacaattggatcaatgacgatactcttattacgccaaattaaaactgttttggtgacggaatagatatcaccgtttgctgccgtgtgatcttgcgtagaggtcgttttgtcaacctcaatgtagttggctgtactggtcaatttttcgccggacatttcatcaatattgatgacggttggggaattgatataaaagtgttggattttgtgatagatttctgttgttgttacagtagtcgtgacatttccatcattatcagtcgtattttctgaagatgtatttcgtgaaatcaaatgatagccgtctgtatttacaagtacgtctccattttcgtctttcttaacagtaattttgacagttttgtgatttgggttggaattaggtttctcccaaagaatcgtcgtcgttacgactgtggtagtatctccattcttagccacttcgtctctactgctcgtttttgtagcatccttaatccggttatagccttcagttgaggtcagtgtgtgaccattctcatccacgttaaccgtcacatccttggtaaagtactggatcttatgataaacattggtcgttatgtgatgagtcacaatggtgccatccggatcggtcgtttctttggttgacggttggatcgtcatgagatgataagcgtctgaaggcgtaaccaggttgccctgctcgtctttattaaccgtctcataaatgtcacgttggccaggttgttgggtggcctttttccaggtcacggtcgtggtgatgacagtcgtgacatcaccattttgagtaacttctttcttggtcgtggtcttttcgtccccagaagctttggtataaccattagtggactggagagtttggccattttcgtcgacattaaccgttacttgcttggtaaagtgctggatctggtgataggtttcggtcgtcgtataggtggtgatggtatcgccattggccaaggtctgaacggtcttaaccggggcgctggtcttgatgagcttgtagcccgtggtatcggacaactgatgaccttgttcgtccactttaaccgtgacctgcttgtcggtattcactggcacgtgatcgtctttcggcatgttggcgttggtgtggtcaatcgtggtttgcgcttgctgaccggcactggtggtatcgtttgcctgagcggccacattcgctgtgttagccttggtggtttgctccttggcctgatccaatttggtttggacagccgcaatggtctgctgccaagcttggatctggtcatttaaggtcttgagctgaccatccagcgtcgttaattgggcatcataattggccaggtcggctttgagctgcttggcttggtcactatttttggcggtcgcctgttgtggcaaggccgccaaattggtgttggcctgttgcaactcggcattagcgctggtgacttgaccattaaagctatccaactgatttttggcattagccaaggcttgctgagcagccgtttcggcttgttttgcggtactcagttgttgactggcttgactgagttgctgctcataggtttgcaaaccttgttgtgccttagtcagggcatttttaagggtggccactttggcctgggttgccggatctttggccgcttgcgcatcggcattaatggtgtccagttgcgcctggagactctgaatctggctggtttgggagttaatgccagccgttgcggtgtcaacttgcgtttgtttggaggccgtattggccgttgcggtatctgcggcttgtttagccgttgcatacgcttgttgggcagcttgcagcgcttgcgtggtactttgaactttagctttggcggtatcgacagcggcttgggcagccgttcgtttcgtctggagttgtgccagggtctgaccattttccgcattgagcaattcggtcaacttggcttcggcttcttgcttcgccttttccgccgcttcccgttctgcttgtagtcgtgcctgctcttctttagctgctttgatggcagcgtcaatatcgttcttgtttgggacagacttgtcattacttgttccggtatttgaatgattgtgcccagcaatcaacgcagcatctgtaacggtggttttctcattgccgatactctggccatttgagccagttgagttttgctgaggtgtgacaatcgcaggttttgcaggattcagattataagtctgatcatttcctgcggcgtctttggttgttaccgttgcattttccccagatccttgtaagtacaactttgcgcctgcataaatcaaattaacattagcaatgtgattgatctcagctaaacgattaactgaagtggtgaatcctgtatgatttaaggcttcagaaattgttgagagagtgtcaccccattgaatgtcgtaaacagttttatttgaagctttaatttgagcttcaatttgactaactggccgcaaagtccacacacgtccagtcgttgatgttgacttttgtgtggtaatttgctgattgctgctagcatttaccacatttgtttgtcctgccaacccaacagctactatccccaacccaatgctggttaaccccaaagtaaaccagccacgatgcttgctatgcaccagggaaacacggtgtgactgcttttcaagagcaacctgcagtcgacgccgtttccgagaatttttcatctttacccctccataacagtaattatttgagcgacttcattgtaccttcaatttactctggagtccataatttgttttatattgactttttagcactgattttctgctttgtattcgtttagcgttgaattatcagcgaaaacgagacttgtggtctgaagtcaagggagtgattcaaattatctagacttgtttcatttttcagagggtatacttcccccagcccagggatt

SEQ ID NO: 311 - DNA, 220016 bp, Lactobacillus casei
aatccaatgaacaactagagaatatcacgcaacatccaagtacggagctatccaagaacttggttgtaatttaaatatacgaggagggatgtcagtgtcattaccagaacaagttgctcaaagaattcgtgatctgcgcatgagcaagcatatttctcaagagcagcttgcaaatatggcagggatggacgcatcaatgctggcaagaatagagaatgggcggcggcctaatattaaactggcaacattggaaaggattgttaaagctttgggggtcaattaccacgagttctttacaatagaagatgatgaaaatccgcagatgcatttagctgcctcagtggttcttctcaataatccaaaacttgttcaatcacttcaaaatattgttgatttagcattggacgatttccgtgacgccgaagataagcaataattaatgggaaacatctagaaaagggtgatccaaaaaagctgtccaaatcctttagggcttgggcagctttttagatatgcaggtttgggaaatgttttactgtaaagcaaaagtggatgttggtggattgggacccaatgctcttcatggaaagcataggttagaatgacgtacatatcatttgtcccttaagttcagttatagttaaactgcgttaaagacacagccatcaagaggaatagttgagtgaaggatggtttattatttgtacaaacagatttgaacgaagtagggtacccatatttttgagggggtgattttccgtcagacggcgtgcccgtacctttcctaatgaaatatggtgtagctgaccgacattacattaatatcaaaaaaacacgcccaagatggacgtgttcggcaattgtttgaccagctaaactgagtgcacgcaaccgcacgcgataaatcgctgtgaacgccggtgtagaggcattcgtggtcaaaagtattaaagtttctggttatagtattcaacaaccagtgattcgtcaacttctggttcgagttcgccacgttctggtaagcgaacgagggagccttccttcttgttgtcgtcaaaggtgacgtaggccggacgggaaacggtgttctcgatggcgtcattgacgatggcgaggttttgtgagcgttcgcgaagaccgatcacttgaccaggctgtacttcgtaggaaggaatatcaacgcgcttgccatcaacggtgatgtgaccgtggttaacaagttggcgtgcttgcggacggctggaagccagacctaagcggaaaaccatgttgtccaagcgggtttcgagcaggatcatgaagttatcaccatgggtaccttctttgatcttgccggcgcgcaggaacaggttctggaattgacgttcgtttaagccgtacatccaacgtagcttttgcttttcacgcaattgctgaccgtattcggagatcttccgacggttgttggcaccatgatcaccaggtgcataaggacgacgagctaattctttaccagtgccggaaagggacaagccgagacgacggctttgcttccagcgaggaccagtataacgagacatatagatattcctccaagtttttatttggagtaaaataacgaattgcggctttagcacacgggcagtcctgcaaaggttcacctttgcagccgcggttactactgtcaccggcttaacgccgaggcaggactggagccgaccatgccggccgctgctgcattattttacacgcgagctagtataccgtgtttaacgcggcagtgtcaagatgtgcggccagtgtctgcccgaattgcgtcaggatcttttcgtcttcttcgctaaaccgatcgaattttggcgaatcgatgtccatgatggcaactgttttaccgtcaacgttgataggaaccacgatttcggcattgctggcggaatcgcaagcaatgtggccggcaaattcgtgaacgttcgcaacgcggatgacggattgttgctggaagctggtgccgacaacgcctttgcctggctgaatgtgcatgcaggcaactttaccttggaatggcccgaggtcgagctgcccggttttggtattaaaaaggtagaaaccggcccagttgaggtcggtcatactatcgtttagcaacgcgctggcattggcgagtgcggtaatagggttggtttcgcctgtgagtaagccatcgagttggtcgataatgatgggatcgagagtcgtcatttgatcagtccttttaggaatttatgaaaagcggcatataggccttttaactgaaggctttttttgcgatacttgtagctaggatattctcgtgttttgacacttaacggcattttagctgtgaagcgggcgaaatgcaatcagaaaagataatcggtaaagcagagggtgtagggatgatctggttctttattatcgtcgtgattataattgtggccgctggcggtgtctggtggcttcagcattattttcagactcgcatcaagaacttagacgaaaaggtcgaggcgattgatattggtgcgctttcgagtcaagtccgcagcattgagcaactgaagctgaccggcgacagccttgcgacgtttggcaaatgggagcgggcgtttgatcaattaaacgatcatgacttggcagatctccagaaaattttgcttgatttggaagatcaggtcagacgattccggtttgatcacgcctctaagattgcaaaagtgttggaagccaaaatcgaaacggcccgccaccaatatgagctgattagcgatgccttgcaggatattcggcatgatgaagcagataatcggagcaaaatgttgcgactgcgggatgattatcaggtttcccgcaagaccatccttgccaaaagttttgttttcggcgatgcccagccggcgttggaacaacggctgcaacaacttgcccagttattccaaaaaatcgaccagatcaacaacgatggcgatcaccaaacagccaaggcagagattaagcagttggctgaacaaatggacgagttaaaaaagcaggtcaaagaattgccaccgctggtcaatgaacaggtcaatgagttccctggtcagattaatgaaatccaacacggttatcggcaattaaccaccgcccattatgttttcacggatgatatcccaggcatggtggcggacgtcgaagcaaaaatgaaagacgcgaacgccacattgaagtcgattgacgtagctgcaactgctgcggctaatgccgaaatcgaagccgagatcgacaagatgtatgcgattatggaaaaggaaatgcaagccaagaagcgggttgacgcggctacccctgacttgcggcgtttcattgaccatgcgttgcgtcagaatcgcgagctacaaaccgagctggagcatctggatcaaagttataccctgaatcatcatgaaatcaaaacggctaaaaatctaaaaatgcaactcgacacgattgatgccaattatacgaaagacactgatgccatcgaggccggcaaagcggtttattctgatgtgattggcaggtttgatgcgactaaagaacaattaaccgaaattgaaaagcaccaggttcaaattaatcaagatgtggccggtttgaagaaaggcgagattgttgccaataagcaggcagaaaactttgagcttgatatgcgcaatatcaaacatgaaattgttcgccaccacttgccgggactgccgcaggattatgtagatcaggtgaagcatgtcacctcggaaatcgaacagctgaatcacgatttgaatcaagttaaaatcgatatggatgcgattgcgaagttcttgattaaaattgccaacgatattgaggatttgaagaaggcaaccagtgcgttgatagatgctgccggtctgactgaagaattgatgcagtatgctaaccgctacaagacaacggttaagccggtggccgatgccgtgaagcatgccacggaactttatttgcattttgattatcagcaggctgcggatacacttgccacggcgctggaacagaccgagcaggggagttatcagaaggttgaagatgcttatcttgcgcggaagaaagcttcattatattaggagttattgagaagccagtctgattgggctggcttttgttttggcgtgagggggttgggactgttggctctcacagtcgcagaaatcttcacataagggcttcaagcctaaatagattgcagctttctggcgcaaaaacgcgctcaccagcccagaaacctgcgtgtaaggaccttggacgcaatggccaaacccgggccatcacgcccaaggccacttacactccggtttctaaccgggctggttcgcgctcttgaaacttactaactttttgtctataattcaacccagtctaaataacggaaggggccggctgatgatttattttgataatagtgcgacgactaagatttcgcctgatgctttggcgacttacaataaggtcagcacggatttttttggtaatccgagtagtttgcatgcgctggggacgaaggctgatgaggttttgcagagttcacgggcgcagattgccaagttgattggggctaagccggatgaaatttattttaccagcggcggcacggaaggcgataactgggtgattaagggaacggccatggcgaagcgtgagtttggccggcacttgattacgaccagtatcgagcacccagctgtgatgaatagcatgaaacaacttgaaaagttgggctttgaagttacgtatctgccggttgatcaccgcggttttattcatatcgatgatttgaaggccgcgattcggaaggatacgattctggtttcaatcatggctgtgaacaatgagattggcagtatgcagccgattgttcaggccgcacgggttttggatgcttatcccaatattcatttccacgttgatgcggttcaggcggttggtaagggcttggatagcgcattgcaggatcctcggattgattttctcagtttttccgggcacaaattccatgcgccgcgcggtaccgggtttatctatgccaaggaaggccgcatgatcgatccattgctgaccggtggtggccaggagcgtgattggcgttcaggaaccgaaaatgtcccggcaattgcggcgatggcgaagtcgttgcggttgttgttagcaaacgaagacgacaatgttgcccagcagcaggcggttcgcaagcgtatttacgatcatgtcagccaaaagcctaaagtgacgatgtttagtcagttaacgccggattttgccccgcatgttctgtgttttgctattgccggggtgcgcggcgaaacgattgtccatgcgtttgaagatcatgcgatttatatctcgacaacgagcgcctgctcaagcaaaaaaggcacggaaagcagtacgctggcagcgatgcatactgatccgaaaattgcgacatcggcgattcgggttagccttgatgaagccaatacgttagctgaggctgatgcgtttaatgacgcatttgaccagatttatgcgaagtttgccaagctcgataaggcgactgtttaactgaaaggattttgagatgcaatattcagaaattatggttcgttacggcgaactctcgaccaagggcaagaatcgccaggccttcatcgggcgcttgaatgggaacgtgacgcgtgcgttgcatgagttccctaagctgacgattcggccaaaacgggaccggatgcatatcgagttgaatggcgaacccagtgatcaggtgatggcacggctgtcacaggtctttggcattcagaatttttccccgagtattgccgttgaaaaagatatggccaaagtgcatgaagttgccttgcagttgatgaacgaaacggcacctaaaggcattagctataaggtgaatacgcggcgtagtgaccatgactttgccttggacacgaatgcgatgaatctggacctcggtgactttttgacggataaacggccggatctagtggttaaaatgcatcatcctgatatgattttgcgtgtagaagttcggcgtgaggctatttatctgtcaaccaagaccattcagggtgcaggtggcttgccagtcgggacggctggtcgtgctgcgttgatgcttagcggcggcattgattcgccggtggcaggttattatgcgttgaagcgcggtgtggacattgaaatggtgcactttttcagtccgccttataccagccaacaggcgttaaataaggccaagcagctgacggctaaattgaccccgtatgtcgggcggatttactttattgaagtaccgttcaccgaaatccaggaagacgtcaaagcaaaagttccggaaggctatttgatgacggttcaacgtcggatgatgttgcgcctcaccgaagcaattgccaagcagcggggcgacctggccattttcaacggtgaatcggtcgggcaggtagcgtcacaaactttggagtccatggcggcaattaacgatgtgacgaccatgccgattattcgaccggtcgcgacgatggacaagaatgaaatcattgccgaagcggaaaaaatcgacacgtatgacttgtcgatcatgccgtttgaggattgttgcacgatttttgcgccgccatccccgaagaccaaacccaagaccgatcgcgcgcgctattatgaaagcaaactggatgttgacgggctgatgacgcgtgcattagccggaatcaaggttcaggagatcaagtcctcggatcagtttatgaatcaggatcaggacgttattgcagagttgctttaaagcttgatggcaccggacgcagatggtaatgattttgttgcctctgccgcccggtgttattttgttgtctaaaagaaaaagttcacaaaaaatctcatcattttagccgcggcttcgcgaaacccttttcggatgcttatagacgacgatcttccgcaacgttggtaactgggtcaacatgaagcgcaatctgctattcgccaattttttgccatgaaaaaggtggctaaaatcgcttacatctgttaaactaaatatgtgaaatgcttaacaaataggtgcggaggtgttcatcttggtcgtcaataaacaagcattgtcgcaagcaacgattaaacgcattccggtttactatcgaacggtcaaagctttacaacaatcgggtgtcaaacgggtgcgctcggatcggttaagcaagatggtgcatattgcccccgcgactattcgccgcgatttttctaattttggcgacctaggccgcagcgggtatggctattcagttgatttgcttgcggaagtttttggcgagctattagaggttcactccgaagagcagatgctgttggtaggctgtgggaatctggggcgggcgttgctgaccaataattttcgacgtaatcccgacttatccattgtgatgggctttgacacggatcccagcttgatcgggacgacaattgccggtattccgatttataacttggcgaccttatccgaaaaagtccgtccaggcatgcacaccgcgattgtctgcgtgccgagttctgcgcaggcagcagtgattagccaacttgaagctaatggcataacggcgattttgacctttgcacctaagccggttcccgcccaacccgaaacaacaattcgttatattgatttgaccagtgaattacaagcgttactgtttgttgaccatcaaaataagttaacacaagagcaaaaagcacctttgaagcaatcatgacagcgttgaccctgccatgtccgcgggttataatgcagctaatgcaatgatcaagagggtcatgatcttttttcccagcgacgagatggttggtgtgaatctcgaaaaggggtcgtgattgtagcttgtgagctgccgtcctgaagtgagtagggaatggccggtgacagccgttatcctgaattaagtggggaagttattcccaatttaggtggtaccgcgagtgaaatcgtcctaatttttatataaattagggctttttttgtgtgagcgcgagccggtgcggttaggagtcggagtgtaagcggccttgggcgtgatggcgttttttgccattgcgaccaaggtccttacacgcagactcctgcgccggggagcgcgttatggagaagcgtgagccggcgcgttataggaagcgcgaaccaacgcggtcgacaaatctgcatattgcggtcctgaaaacctggatggacagaaaaatttgtgaggtggagccagtgagtgatgaaacattagcaccaaaatatgatcataaagcggtcgaagcaggccgctatcaggaatggctggacgaagatgtttttaaaccaagcggcgatccaaaagccaagccgtattcgattgtcattccgccacccaatgtaactgggaagctgcacatgggccatgcctgggatacaaccttgcaggacatcgtgattcgccaaaagcggatgcaaggctttgatacgctgtggctgccggggatggaccatgccggaattgccacacaggcgaaagttgaagccaaattgcgcaaggaaggcattagtcgctatgacttaggccgcgaaaagtttgtccagaaggtctggaaatggaaagatgaatttgccaaaaccattcacggccagtgggcgaagatgggcttgtcgctggattacagccgtgagcgcttcaccttggacaaaggcctgaacgaagccgttcgcaaggtgtttgtcgaactctacaaacaaggcctgatttaccgcggcgaatatatcgttaactgggatccgcaagcccgcacggcattgtccgatatcgaagtcattcataaagacgataaaggcgctttttatcacgtcaaatatccgtttgccgatggtagcgggtatatcgaaatcgccacgactcgtccggaaaccatgatgggcgatactgcggtggccgttcatcctggtgacaagcgctacaaagatatggttggcaaggaattaattctgccgctggctaaccgcaaaattccaatcattgaggatgcctacgttgatcctgatttcggaactggggccgttaaaatcaccccagcgcacgatcctaacgactttcaggttggcaatcgccatgatctgaagcgcatcaataccatgaacgatgacggcacgatgaatgaaaatgccggcaaatacaatgggatggatcggtttgaagcccgtaaagccatggtggcggatttggataaggaaggcctattacttaaagtcgaaccgattgtgcatagtgttggtcacagcgagcggaccggcgttcaagtcgaagcccgtttgtcgacgcagtggtttgtcaaaatgaagccgctcgccgaagcagccatcaaggcccaacaggaaagtgataagaaagtaacctttgttccggagcgctttgagcacacttatttgcaatggatggaaaatattcacgattgggtcatttcccggcaattatggtggggccatcagattccggcttggtacaacaagcacaccggtgaaatttacgtcggtatggaagcaccgaaggatattgaaaattggcgccaggatcctgacgtactggacacgtggttttccagtgctttgtggccattttccacaatgggctggccgaataccgatgcgccggattataagcggtattatccgacgaacaccttggtcacaggctacgacattatcccattttgggttgcccgcatgatcttccaaggattacacttcaccggcgagcgaccattccaatacacgctgattcacggcctgatgcgggacgaacaaggccgcaagatgagcaagtcgctaggaaacgggattgacccaatggacgtcattgaaaaatatggcgccgatgccctgcggtggttcctgatcacaggtaataagccggggcaggatacgcggtttagttacaaacaggttgaagctgcctggaatttcatcaacaagatttggaatatttcacgcttcgtgatgatgaatctaggcgatctggacaagccgcagcagcctgatccaagcacatttgacttatccgataagtggcttttttcgcaattaaacgaaaccattaagcaggttaccgatctgtctgaacggtttgaatttggcgaaatgggtcggaccctttacaactttacctggaatgtctttgcggactggtatgttgaaatgagcaaggaagtcctctacggtgacgatgaaaaggccaaggcagctaaacgggttaatctggcttatgcccttgatcagattctgcggcttttgcacccagtgatgccgtttgtgaccgagaagttgtggttggctttgccgcactccggcaagtccatcgtaaccgccagctaccctgtggaaaacactgcgtttgaaaatgccgacgcaaccagtgcgatggatgctattattgcgcttatccgcggcgttcgcagtattcgtaaagaagcaggcgcaccgcttaaaaccaaggttgatattatcgtgaagttgacggatcctgctttgaagccgatttttgaccagaacttcgatttcatcgatcggtttgttaacagcaaggaattcaccgtcggaaccgatgtagcagagccgaaaatggctggcagcgccgtcattaccggagcaacaatctttgttccgctcaatgaattagtcgatctggacgaagaaagggccaagctaaccaaagatgctaagaagcttgaacaggaaattgcccgaattgacaagaaactcaacaatcaaggtttcctgtccaaagcgcctgaagcggttgtcgccgaacaacgcaccaagcgcagcgacttcgccgaccaactcagcagcacccagcagcggcttgagcagttgcagcaggcataagagatcgaagcccggtcttgcaggtaaaatgttcgtccgtcaacctcaagcggtgtgggtgacatagcttaactagatttccgagaggctgggtcataatctatagccacaatacagaagcggacatactccaactataactggagtatgtccgcttctagttttcctaggagaattcgttggattattaagacgttagtgccaaagcggagcaatctccggccagatggggctggaacgctgtgggcacgactttgagcctcagcaaagcccgctgagtctcaaagctcggccttgtactacgccgggaagatcgcccggctagtacaatctcacagctgagccccatctggcctccgattgcggagtttggcacggtctcacagctgagccccatctggcctccgattgcggagtttggcacggtgacaaactaattgcctgagattttctactatacgaataggcgtagatccgtgtattcctcatgaattgagcaaaatttccgttatcagcggcttagccgaccagcattttctggtatgattaagccatattgaggcgctgcaaaggcggtgtctgcatggatgtcacgattgaaggaagttaacgatgaactactctgaaagtgttgcttatattcattcttttccgcgtttagccaaaaccggcgatcatcgtcgtattctgacgttgttacacgcgctcggtgacccgcagaaagaaggtcactatattcatatcactggcacgaacgggaagggatcgacggctaacgccattgctcatgtgctggaagctagcgggctgaaagtgggcttgtttacttcgccgtttattatgcacttcaatgaacgcatgatgattgaccatgtgccgatcctcgatgatgaactggtacaggcggttgcggtcgcccgggcagcacttgatgacttgcgcaccactcagcctgactttaatgtaaccgagtttgaatttgtcaccgccttagcgttttggtattttcgtcagcgccgcgttgatgtggcggttatcgaagtcggcattggcggagataccgattcaaccaatgtcatcacgccggttgtgagtgtgctgacggaggtggcgctggatcatcagaaattgttaggcaataccatcacggcgattgcgacgcataaggctggtattatcaagcccggagttccggtcgttaccggtgacttggtacccgatgcagcggcagtggtagcggccaaaacgcagtccaccggtagtcagtggtttcgcttcggtcgggatttcactgttcccaaagccaagctgcacggctggggacagcggttgacgtaccaggatgaagacggatcgttagcggatctgaccgtgccattagtcggggactatcaacagcgtaatatggcgattgcaattaaaaccgctaaaatttatgcacaggtaaccgactggccgttgacggcgcgcgatattcgccaaggacttgcggccagtcgctggccggcgcggcttgagaagattagcgattcgccgtttattgtgctggatggtgcgcataatccggacggtatcaagggtctggtcactgcgttgcatgaactgttttccggaccggttacggtgattgccggtattttggccgataaggattatgcatcgatggcagatatgctgacacgggcatttgcgactgtttacctcgtgccagtgccggggacgccacgtgcattacctgaagccgggtaccaaaggcttcatgaaggacagttaaaagactcatggcaggcggcattagcagccagcttggataatgacccggaacaaccgattgtgatcactgggtccttgtatcttgctgctgccgtgcgtcaaactttattggagggaaagtcatgacaacaaccgtgatttttgatctggacggaaccttggttgataccgaagcaatttatcttcaaagcaacgtgcgcgccgcagctgagttgggattgaagcgaaccgaagatgattttcgcccgttagtcggttcggcggggccaaacgaagccaagattattgcagatcttgttgggtcggaaaatgctgcgtggtttcaagaattttcgaccaaggatgtgttggatcggattcgcaatggtgccgattttgtgttgcctggagctgatgaagccttgagaacgctgcgggctgctcgttatcggctggcattggcaaccagtagcgctcagcattatgttgatgtggttttggcagcagccggttggcaagactggtttgacccgattttgaccggcagtgatgtcaaggcgcataagccggatcccgaagtgtatcaggtcatgaaaaggcatttaggcgctggcccggcgatcgtcatcgaagacacgcacgtcggggtggcggccgcagagggagctggcctgcctgtggtcatgattcccggtattgcccagcaaccggatgagaaagcgaccgctattttatcatctatcaccgaactgccggactggctgcaaaagcatggcacatttgcgtaatcttcctagtgagtcatgaattggctcaaaatcgcagcgcgcaaccaggacattcaatcagcatcagctcgaaacgcaatgtgggaattgaactgatgcgacctgtacgtgtgctaccagggggaaaacgatggcagatgcaactgaacaaccacgcgaacggttattggcgcacggaccggcagcactgacagatgcggaattgctacaactgattgtgcgggcgggaaaccagcattatccggtcaaagagatcgtgagtgaggtgttggcaacctatccggcattgcaaggtctggcggaaggcgatggtgactcattggatcacattcgcggcttaggtgccgccaaacgcgccagtattttggcaggggtggaattgggtcgccgggtgatgcgccgacaatccgttcgttatgggcagattaaaaatagcgaacagctaggcaagaacatggtttcgcgttttgccggtgctaatcaggagtccatgctgattttgtttttagatgtcaaaaatcagattattaccgagcaaactgtggcgattggtacggtcgattctgcattggccgatccgcgggtggtatttcgtgaagccttaaaattgagtgccacaaatctcattatggttcacaatcatccgagcggcgatccggcgccgagtcaggcagatcgcgatacgacaacccgttttcagttagcggcggcgttgctagggatgaatttgctggatcatttgattatcggcgggaaggcgttttattcttttgcccgagacgatcctgactttaattaattcaagaaaattgtaaggttttttgaaattggcggtaaggtgccaaaatcaggcggtttcacattttgtcacagaaataaatatgctataatgcatggagttaatacgaaatgagtcagcataaggagagaacgtcttgtttggatttggatcaaagaatatcgggatcgatcttggcaccgcaaataccttagtttacgtcgacggcaagggcattgtcttaaatgagccttccgtggtcgcgaagaatacccagacggaagaagtcattgccgttggtgaagaagcccgcgacatgatcggtcgtaccccgaccaatatcgtggcgatccgaccaatgaaagatggggtcatcgctgactacgacacgactgcggccatgttgaaatacttcatgcaaaaagcattgggtaatggcagccatccgcaggtgatgatttgcgtaccaagtggggttaccgaagttgaaaagcgtgccgtcattgatgcggctaaagtagctggtgcacgggatgcgtttgtgattgaagaaccatacgccgcggcgatcggtgccggcttgccggttatggacccgacaggcagtatggtcgttgacatcggtggcggcacaaccgatgttgccacgatttcattaggcggcatcgtttcgagtcgctccattcgagtggctggcgataagtttgacgaagccattatcaatcatttgcgacagaattttaatttattaatcggcgaacgaactgctgaagcgatgaagattcaaatcgggtcggcatcggttgaaaaagccgctgacatcgacgggatgacggttcgcggccgagatttattaagtggtctgcctaagacgattgacatttcggcgacggacattgcctcggcgattcatgagaacgtgcttgacatcatcacggctattaaagagacgctggaagaaacgtctccggaaattgcggctgatgtgatcgatcacggtatcgtgctaactggtggcggggcgcttttgaagcatctgccggatgtcatttccgatgaaaccaaagtaccggtctttatcgcccaggacccgctggattgcgttgcgatcggaactggcgaatcgctgaagaatattgacgttttaaagaaacgttaacagcccataaatgaagatgctttgcgtgtggcaagaggctgggatgaaggatcctggcctcttttcgcgagtgtgacggaggaaccaatgcagaaattcttttccaataaaaaattgatcgccctcatgatcgctttgctggtcagtattggtctggtcgctgggtcgatttatgcgagcaacaatcgcaataccccgccgtttattcagcggattgccaatgatgttgttggcatcggtggccggttggttgccttaccaggggattttgcccgcaacgggttggatgacgtgcatagcctgatggatacgttccaggagaatcaacacctgaaacaacagctagatagtctggcccagaccaaagtacaggttcaaaccctgaaacgcgaaaacaaacagctgaaacaacagttgaaattgaacggtactttgactgattactcgcagatcagcgccgccgttattttgcgaacaccgagtgattggcggaacatggtggtgattaaccaaggcagcgcggcaggggttaaaaaaggcatgccggtgatggccggatccggattggtcgggcggatcgttgaagtcaatcgaaccagttcaaaagtcgaaatgctatcgactgccaataagtccagtgatcgcgtcgctgccgccgttgaaacgagtgaggataaagaagttaacgggatcatcactggctatgacgaaaagtcgggtgacttggttcttggcgaactgaacagcgagcatgcgattaaaaaaggcgataaagtcgtgaccagcggcttgggcggcatgacccctaaaggcttgcttatcggagaagtcactagtgttaaaaaagatgactatgggcttgccaataccgtttatctgtcaccggctgcgaatctcaatgatgtaacggttgtgacggtcatttcgcggacaatcaagggtgactgatatatgttgaacgaaaaacactttacagggcattggtggattatttcaatcctgcttttgctgttattaattgatggcagtctggcatccgtattagcccagtggattatgcggccgagttttatgggtacgccgcagctgactttgttaggcttggttatggtgaccctgctagttccggaagagaagtacacgacctggattgccgccttgatcgggttgatttttgacagcttttacaccggcatattaggcgtcaatgctttattgttcgcgttagtgatttatatcgtgcgtcagattcggccgtacattccgcacaccgcggtttttgtcgggatggtgtatatcattgcgctattgctgtatggtgtcgccaattattttgtgaatcattttattggttatggcagttccagtgtagtgatgctgattgccaatcatttggggccggggttgacggtcaatctgattcttttcgtcattgtgtatggcccattgcatcgggtattgattaacttagcggaagaatagtttggggtgatgatgtggacagtgtggtcttaaaaggtcgaaacgacagtctggcactgcagcttcaagatacggcggattttatgcagatcatcgggacgctgaaaacgttactggggaagctgtatgaagaaacgccgactggtgaagtcagttatcgcttggaaaccggtaatcgtttgttgactgaagagcagcttgcccaaattcaatcggttttcgccgattatccgcgtttttcaatcaacggcattaccagtgcggtcgttgacaaagatgtggtggcagatatggtcacggccaaaatgacgcatcgtattggtggggtgattcggtctggccaaacgattgacatcatgggtgatgtgctgttcttgggcgatctgcattccggtgcgactttatgtgcttccgggaatgtttttgtgatgggtaaggtcagcggcgtggtgcaggctggcagccaaggggatacacgcgccgttgtggttggtgatcttgaaggggccagccaggtgcgaattgccgatgtgatcgagattgtcgctgatcactatgatccgctcaagccagtcgcttatttaagtgagttacatacaatgacacacgccaaaatggctgaactggcgaatcttcggccgcgattattcaagcaaatggaggcaatgtagatgggtacagcgttagtggttacttccggtaaaggtggtgttggtaaaacgaccacctcggccaacatcggcaccgcattggctttgcagggcaagcgggtggttttattggaccttgatattggcttgcgtaatttggacgtggtcatggggctatctaatcggattatttatgacattgtcgatgtcgctaccggccgggctaaattgcatcaagctttgatcaaagacaaacgctttgatgaccttttatacttattgccagcggcgcaaaatgctgaaaaggatgccatagagcccgagcaggttgtcgaaattgttgaacagttgcggccggattttgactatatcattcttgattcgcctgccggtattgagcaaggctttcgcaatgcgacgggcgctgccgatggggcgattgtggtgaccacaccggaaatttcggcagtcagtgatgccgatcgggtggttggtttgcttgaacagcgggatatgccgcttaaaccgcgattgatcatcaaccgtattcggcaaaatatgctggcagatggccgctcgatggacattgacgaaatcaccagtcatctgggactcgatttgctgggcattatcgttgatgatgacggtgtgattgagagctcaaacaaaggtgaagcgattgtgatggatccggatgatttggccagcaaaggttaccgcaatattgcccggcgactgttgggcgacagcgtgccgttaatggacattcgccttaaaaagcaaggcttctggtcaaaactttttcatcggcataactaattaagccacacggtgtggtgcgtcgacgcgggaattcggccatcacttttccgacgaaaagctgcacgaatttttaggaatagttgactttcgatgattttcggtgtaatttagtgacaattcattaaagcgttgagtggaatcgatgagcggtcatgacttcaagcgagtccgggttgatgggaaccgggcagtcatccgttgatcacacatccatgagtgggcgattgaaccttagtaggtcgtctcggttgggctcgttatcgccgtggttgaaataactacatgagactgattgtgtgagcaattggtaaatctgaggtggaaccgcggtttaagccgtcctcttacagcaacttgctgtaagaggatttttttatgactgcgatttcgaatgatgattatgaagttgatttcaaccacatgaggtcgactgtgtgaacagtcggcaaattgaggtggtaccgcgcaaaaaagcgtcctcttgcttgatgcaagaggacgcttttttgcattatcagtcggtcaccggttgcggcccgccaaccacaaaacgcgtttaataaaatgaacagaaaccatggcagtaaagttgtcacggatttgaaggaggaagcaccatgacttatatttttcagattttaccggccttattatctggtgtgaaaatgactttggggatttttgccatcacgttggttggcgccattccacttggcttgattttgtcagtgggactcattcccaaacctaaatcaattctgggtaaggcaggaaaaagccttttggaaggttacgtttgggtctttcggggaacgccattgttgttgcaattgatgtttatcttttatggtttaccgattatcgggattgtttttgatcggttctcggcggctttagttgcctttattctaaattacgctgcctacttcgcagaaatcttccgtggcggctttggggccgttgatgaaggccaatttgaagctagcaccgttttaaacatgacgcgctggcaggcattgcggtatgtcgttatcccgcaagtcgttaaaatcgtgttgccgtccatcggtaacgaagtcatcaaccttgtgaaggattccagcttggtttatgtcatcggcttgggcgatctgctgcgggccgggaatattgccagtgcccgcgatgtcaccttgttgccgcttgtcttggttggggtgatctacctgttgctgacgctgatcctgacgttcctgcaaaaacggatcgaagcagcattttcatactatcgctaggaggcgtcgaacatgttagaactgaaaaatatcaacaaatcttttaacggccgaccggttttgaaaaatgtcacagtgaccattgaagatggtaaaaccctagcgatcgtgggtcccagtggtgccggaaaaacgacactgctgcggattatcagcggactggagcaggctgattcaggtaccatgatctggaacggcgagccgacaaccgcgcaggccatgcgtaaacaagggatcatcggggttgtctttcaaaactttgagctttttccgaatctgtccgtgatgcggaatattacgttggctccaacgttgcaaggggttgaccagcaacaggctgatgcgactgccaagaaattattggatcaattggcgttaagcgatcaggctcaggcatatccgtattcactttccggtgggcaaaaacaacgggtcgcgatcgcgcgggcgttggcgttgaatccacaaattcttttgtatgatgaaccgaccagcgcactggatccgttgttgcgggagaacgtggctgagatggttaatcagtttaaggcttccggaatgacgcaggtcgtggtgacccatgatatggactttgccaagagtgttgcggacacgacttatcacgttggcaaaggcggtgatggccaatgaaacggcgaattttattagccgtcatggtcgttttggccatggcaggctttatcatcagcggctgtgcgcgcgaaaccgtcaacaattcctggccgcggattgagcgcactaaaaaagtcgtgattggtttagacgatacgttcgtgccgatgggctttcgccaaaagaatggtcagcttgccggatatgacattgatttggcaaaggccgtctttaagcgctatggcatcaaagccgattttcagacgattgactggtccatgaaagaaaccgaactgaaaaatcaaaccattgacttgatttggaacggctattccgtcacgccggaacgcaaagaaaaagttgccttttccgacaactacctgattaatcatcagattctggttaccaaaaccaagagtcagattcattcactgaaggatatgaaagggaaaaccctaggcgtgcagacgggatcaagcggtgcgtttgacctggacgcgcaaccgaaaattttaaagaatatgattgccaacaaaaccccgattctctacgatacgttcaatgacgcctttattgacttagacgcggggcggattcaggggattttgatggatgaagtttatgcacgttattacattgcccacaaagcggacccgtcaagctatcacattgttaacgatccgtttccgccagaagattttgctgtggggatgcggaaatccgaccatgtcttgcgcggcaaaatcaacgctggcttgaaggcattgaaggccgatggcaccatcgcaaaactgcaaaagaagtggttcggtaaagttgaagagtgattggcgattgcgaccggatgagtttttggttagtgacgtgtcatcactgatcaatcgtctataaacgctgagaaaaatgctgcggcaggcactgattcatctgaccgtagcatttctcctggcgtttttattgtcagaagatggcgttagggcaccgatctttaggaagaaaatgcagcgagaatgagccgtcgttacgtcagcaccactggacttttacgctgccttgtcggtaaagtagagtataatcattgccatgtgattggctggcaagcattctgatatggcatcatttagcgtgaatctggcgaggaggcaagtttatgtggcttgggttgatttttggcgggctttatcttgtgaatgcgttgattgcgattgtgacggtttttcgctcgcatcgtgacatctccgcagtatgggcatggctgttggtattgatgctgctgccgtttgtgggttttatcatttattttgtgtttggccgtaagttgcgggctaatcgcatgcaagacttgatgacgcaacggcttttaggcatcaatgacttggtcgttcagcagcaagaagcccttgcagccggccagccgttaattggcacccctggtagcggcggcgtttctgagctggttcgcacattactgcgggccgatgatgctttggtgaccacccataatgaggttcaggttttggcgttacgcgaagcttttttcaagcaactgtttgaagacatcgggttagcgaccgagcacattcatattgaagcttacacgattcagccggatgcagtgggccggcagttacgggatttattaattgaaaaggcgcatgccggtgttaccgtacgcgttttgtacgacacttttggttctcatggcttgccgatcagtttttggaaaggattgaccgatgcaggtggccaggttgagcggtttgtggcgacgaaacttgggcggtggaatccgcgaattaactttcggaatcaccgtaagctgattgtcatcgatgggcatctggcatacttggggggctttaatttaggaaaagagcatcatggcttgcccacgttacgcgatacccagctgcggattcagggtaaggcagttgccgtgattcaagcgcgttttctgatggactggaatggtaccagccgaaagcaacaggttaaaaatgttgacgttcttttccgcgaaccggttgtcactggtaatacaacgatgcaggtggttgctggaggaccggagcagcaggttgaggcaattaaactgggttatctgggtctcatcaatcaggctaagcgcagtatctggatcgagtcgccgtatttcgtgccggatgacagcttgctggatgcgttgacgatcgcggccaatgctggtgtcgatgtccgcattatgattccgaagaaaaccaatcaggaactgatggccaaagcttctcagttttacctgaaccaagtcgtggctaacggtgggcaagcgttcttgtatgaagaaggtttcttgcatgccaaaacgattgtggtcgatggtaaatacgtttctaccggaaccgccaactttgacattcgctcctttaaactgaactttgaaattgccgcgtttatttatgatcatcggatcggcaaaacatttcagaaacttttccttgccgacatggaacgagcaataccgtacacgcaaaaagttatcgatgccaaaaagcggcctgcccgactaggagaggaactctcacggctattggcgccgattctgtgacgcgaccgctgtgagcgcaagaaaaaaggcctaacgacagacgagttgtcgctgggtctttttttgcaagtcattccactaaggttcctaggtgatcggtttagataagttgcaaactagcgagggcaccgagaacgacgccgagcacagtaatgataatcatcacccaagcgctgatgatcgtcattttttgaaatttagactttttctttttctgcaccgaaaacaccacctttgttattctgctggctctcattgtactggtttttgcaaggatcggcaactgagatgctggggggattttgaaaaagttgccattttttaacggttcgcaaagttctactttgtgatgaatgacagtagcgttgaaattgttcggcatgagttggcactgcaatggtgcatctttcaactaaatcaagcttgacgcttatcctcgctttgggtagggttaattagaatagtatcaatagacagcgcttcaggcggctgcctccagggggacttatcatggtgttgctcgcgttgggattgccgattttagtgtggtgcatggttgtcgcggcagtcgtgtactttgattttcatggcggttcttggttcttcttattgacagtggttaatttttgggcgatttttcagctgacttttacgaaaaccccgaattttatttgggtgattttgtttacagccatggtgattgctttgatcctggttatctggcaggtcgttcgtgaatatgatctcattatccaccgttattggcgtatgttgacccgaatcctctcattggccaccacttgttggtggtttggcggcatattgatctactttttgggataagtccccactttctacccacgttttaaaaaagtccgtgatccttgtgatcacggacttttttgcgtcttaaaggttttttaaaacataaaataactaaattttgtttcaattgtggttagatgtggagaagagtggggcgttgtggtagactaaaaatcgtagggaggtgccagctatgctcatgggtgaatttgaacgcagtatcgacgctaaagggcgtctgattattccagccaaattccgtgagcaactgggggcatcgtttgtgttaacccgtggtatggacggctgccttttcggttatccaatagctgaatgggacaagcttcaggccaaactggcaacgttaccgttagccaaaaaagatgcccgtacctttacccgctttcttttttcggccgcaactgagtgtgagattgacaagcaggggcggattaacattcctaagtcactgtttaaacacgccgcattgaagaaggaatgtgtgcttgtcggcgtcaatactcgcattgaagtttgggatgccgagcgctggcaggaatttgctgacacggctgaagaaaactttgatgatatttcggaaaacttaacggactttgggttgtagtgatgacagaattcaaacatgaaacggttctattaaaagaagcaacggcagctttagccgtgaaaccggatggcatctatgtcgatgctacgctgggtcgcggcggccatacccgtcagattttaaagcaactgacaacaggacgcttgatcgcgtttgatcaggacgaagccgccattgctgctgtgaccgctagctttggcaatttaccgccgcaactgacgctggttcaccgtaactttcgggaactaacgacggcactggctgaattgaacattagccatgtagacggtattttgtatgatctcggcgtctcatcaccgcaatttgatgattccaagcgcggcttttcctaccgtttcgatgcaccgctggacatgcgtatggatcagcggcagaagctcgacgccaagaccattgtgaatgaatggccctatgctgagctggttcgcatcttctcgcgctatggggaggagcatttttccaaacagattgcgcggcggatcgagcaagcccgggctgagggaccgattaccacaacctttcagctcgtcgatttgattaaggcggggattcctgccaaggctcggcgcaccggtggccaccccgccaaaaaagtgtttcaggcgattcgcattgcggtcaatgacgaattgtcagcactggaatcatcgttggagcaggcattgaagctactcaatgtcaatggacggatcagcgtgattacctttcaatcgttagaagatcgactagtcaagaccatgtttaaggaagtttcgtcagttcaagacgttccacgcggtttgccggttgttccggcgtctgcccagccgcactatcgcttggtcacgcgcaagccgatcttaccaagcgctgatgagttggccgaaaaccaccgtgcacatagcgctaagctcagagttatcgaaaaaattcgcaactagggggtacaataaatgcttgagagtacagcaagacctttggtgcagcaaccggcgcctaaaccggtacataaaacagttaacgaacccgcgccacaaacacatatcgcttttagcggattcgaaaaaaccttgatgttcgcctgtggtgttttggccacggttgtttgtgtggtctgtctgttcatgcaaaaccgcctgagcaatacccagcgccaatacgaagatttacaagcgcgcattatgaagcaatcgcaggcaaccgcgaatctcaagcaggaaattggtgagctctctaattcggaacgactcgatgctttcgcaaaagcacatgggtttaaaatcattaatggcaatataaagcgtgttgataatcaatgaaacttttcaaatcaaaacgatcaacgaatgcacatccagcccggaatcgtaagttatttggtatcggactgatcgggtttacgctcctgattctcggtggcttcgttcttcgtttttcttttgttgccacagttggcgaagtggattctaacaacctggccaagcagcggcaaaaacaatatcgtacggatacggttctacaagcccagcgcggggctattttggatcgcactggcaatgtgattgccgaggattcaaatacttatacaatttatgcgatcctcgacaaacagaacaagaatggcgacaagccagattacgtcacggataaggcaaaaacggctaaagtattgagccgttatttggcgatcagtgaagacaaaattctggcgcgtttgaacccgactaaaaagcatgtcttccaagtcgagtttgggactcccggcaccaaattgagtctggcaattaaaaagcaaattgacgcggaaaaactgccggggatccattttcgggaaaccccgtcgcgtctgtatcctaacggcgtctttgcaagccatgtgattggcattgcccaagctcaggataaaggcagcgggctgaccggcgtcatgggactggaaaagcaattcaacacggttcttgcgggggacaacggttatcgccgcagcgaaaccgatgcttatgggtacaagctgcccaatgccaaaaccaagttaaaaacgccggttaatggtggaacggtttacaccacgctggacagtggccttcaatcctatttggaaacgctgatgacggatgtccaaaccaaatatgaaccaaaagggttgacggcggttttgatgagtgccaaaaccggcaaaattctggcggccagtcagcgaccgacattcgatgcctcaaccggtgaaggcttaggcgatatgtggcgggattccttggttgaagacaattacgaaccgggatccgttatgaaaatcgtcacactggcatcagccatccagagcggcaagtatcacccaaatgaatattaccaatccggttccgtgaagcttgacggcggaacggtcaatgactggcgcagtggcggctggggctcgattccgctgagcaaagcttttccattgtcaagtaatgtcggcatggtgaaaatcgaacaggaaatgggtgccggtgtctggaagagttatttagataaatttaaatttggccaaaaaaccggcatcacgttaccaggtgaaaccaacgggcgtatcagttttgcccagccattggaccaggcgatcacttcgtttgggcaaggcattgaagtgaatgtcatgcaaatgatgcaggccattagtgcggtctcaaatgacggtaaaatgctgaagccacaaattgtgtccaaggtcgtgcacaagaatggcaaagaaacggtctataaacctgaagttgtcggtcagcccatttccaaagaaaccgccgctcaggtcattgacgccatgcgacacgtggttaacgatgaagatggtaccggggttgcgtataaaatgccaggcgtggatttagctgttaaaaccggtaccggacaaattgccagtgcccaaggcggttacctcaccggtgattctaactacatctttagtgtggccggtattgcaccggcgtcggatccgaaatatgtgctctatgtcaccatgaaacaaccacagaaaatgacggagccggctgaaacaattttggccagcattttcaaaccgatgatgcaacgggcgcttgataccaccgccaacggcaccgtcgccaaagacactaatacggctgatgttcctgcggtgacgaatgctgcgttaaccaccgcacaggataccgtgaaaaaggccggctttgacgttgccacaattggcacaggcaataaagttgttcaacaattaccagcgagtggaaccaaggcactgcgcgattcgcgtgtgctgcttttgaccaatggtgctatgaccatgcctgatcttactggttggtcgaaatccgatgtgttaaaatttgtacaattgaccggtaagaaattcaaacttgtcggtgacggctttgttgttcaacaaagtattgccaaaggaactcttttaggcgataccagcggaacaatcgagttcaaacaacaatagaattggggatagtcatgcaacttgctcagatgctcattccgatggtttcggcatttgccattacaattatgtttatgccgctatttatcgggtacatgcgttacaaaaaagaaggccaggtgattcgcgaagaagggccgagttggcacgagaagaaatcagggacaccaacaatgggcggcctgattttcattgccgcgatgattatttcggctatttgggttagcctttggcaacaccaactgacgctgagtgtctggatttctttgtttattttggttctatacggcctactgggcttttatgatgattttgaaaaactggttcatcatcgtaacgaagggctgaaggcttggcaaaagctggcaggtcagattctgggcgccgtgatttttctgatcgcgtattttcatgaagggttcgatcataccttatgggtaccggtgatcggcaatatcagtgccacatggttctacgttgtttttgtcattttttggctagttggttttagcaatgcagttaatttaaccgatggcttagacgggttggttgctgggcagacgacgatttcgtttggtacctatgccatcatcgctgcccgcgaaggccggacggatgtgctgattatctgccttgtcacggtcggcgccatgcttggttttttgatgttcaaccataaaccagcacagatttttatgggcgacctaggttccttggcgctgggcggcatgctggcagtcgtggccattttacttcatcgcgaatggtcgctattactgattggaatcatttatgtcattgaaactgctagtgtcatcctgcaggtggcgtcgtttaagttaaccggcaaacgaatcttcctgatgtcgccgattcatcatcattttgagataaaaggttggtccgagtggcggattgatttgacgttctggctggtcgggctaatcgctagcggcatttatctggtattttttctttaaagtcatgctataaaaagaaggatcaattgtgaaaaatatttcggattatcgtaataaaaaggtgctcgtgttaggtctggcaaagagcggtgtcaacgctgctcgcttactacataaattaggtgccttggtgacggttaatgacaagcagaaattcgataacaataaggatgcgcaggaattgttagcagacgggatgcgggtgattaccggccggcatccggtcgaattgctggatgaacattttgaattgatggtcaaaaatcccggcattccatacagtaatcctatggtaaagcgagcgcaggagctagggttaccgattattaccgagccggagttggcttatcaggtatccgaagccgaatggatcggaatcacgggtacgaatggcaaaaccaccacaaccacattaattggcttgatgttgaatcagcagcggccacaccatgcgtttgatgccggcaatatcggcattcccgtcagtcaggtcgcccaaaaggccggcaaagacgatacgattgtggcggagttgtcgagttttcagctgtgcggtatcaaaaccctgcatccccacatcgcggttctgaccaatatttatgaagcgcatttggattggcatggcagccgcgccaattatgtcgcagccaaaatgcggatcacgatgaaccaaacaccggatgactatttcattatgaattgggatcttccggaaatgcataagctcgccaagcaaagtaacgcccagattgtgccgttttcgcgtaagcaggcacccggtgcacgtgcttcgctgattgatggctggctgacgtttgatggcgataaaatcatgcaagccagtgagatgcagatcccaggtctgcacaacattgaaaacgcgctggcagcgattgccgcagccaagttaaaaggggtcgaagatgacgcgattcgcgaggtgttgcggaccttttccggggtcaaacatcgaattcagtatttggaaacgctggaaggacgccggatttataacgactccaaggcaaccaacgtcgaagctgcgaccgttgctttgaatgcttttcatcagccgatcgtttggttggcaggcggactggatcgcggattgccgatggatgcgttaacgccgctggtcaaggaacatgtgaagagcatggttgtttttgggcagacagcaccactgatggccaaaatcgctaaggatgccggggtgccagttcaaaaaaccgacaatgtcatgactgcggtgccgttagcttatgaagccagtcgaccgggggatgtcattttgctatcaccggcagcggccagttgggatcaatatccaaattttgaagtccgtggcgatgatttcatcaaagcggttcatcagttgcaacaaacggtcgaaagcgagggcaattaaatgcggctggttatttccggtggcggtactggcggccatatttatccggccttggcgttaatcgaggcgttgaaggcggaaggtaaactcgatgatgtcctttatgtcggcaccgagcatggcttggaaagtcggattgtgccggcaaccggcctgaaatttgcgacactcgacctgcaaggcttcaagcgcagcctttccttaagcaatatgacaacggtcagaaagttcatcggcagtttgggtcaggcaaaaaagttgttgcgtgatttcaaaccagatatcgtagttggcacgggtggttatgtctctggcgcgattttatttgctgccgcgcggatgcacattcctaccgtgattcatgaatcaaactcggttgctggcgtgacaaacaagtttctcagccattttgtcgatcgcgtcgccattgtttttcctgaagtggcttcagcgtttccggcaaaaaaagtggtggtaaccggcaatccccgagcgcagcaggttgccgggttaaaaccgaatgaccgtctaaaggatttcggacttgatcctcacaagcgtactttattggttttcggcggttcacgcggagcacccaagatcaatgaggcggttttagcagcattgccgatttggggcaaagcggatttccaagtgctatttgcaactggacgcagccactatgatacgatcaaaaaatctctgccaccgttgccgtcttcgattaaggtggtgccatatattgatgatatgccgtcaatcttaccggatatcggtttgttgattagccgggccggggcgacgacgcttgcggagatcacggcattgggcattccggccatcctgattccgagtcctaacgtaacccaccaccatcaatatttaaatgcacagagtttaaccaaacaaggtgcggcgctgacgattaccgaacctgaattaggtcaagattttccccagcgggtcgtgaccctcatggaagatgatgccaaacgtgccgccatggcgcaagcatcaaagaaactaggcgtaccggatgccagtgatcagctgatcgctgtgatgacaacactcctttcgaaacgtaggtgatgactttggcttggctccgaaaaaaagaacagcaatctgatccgctgacaccgtggcagcaatatcaagcgcgtcagcaacagaagccgcgacatgatcggcgccgaaagccgaagctggatgttgagctgccgaagattcaaaatttgcggcgacgtaaactgatcaagaaccttgcgttgatcctgctccccctgctatttttgctgggggtttttggctattttgctagtccgctttctaaagtcggattggtaagcgtccaaggtgtcacaacggtacctgatcagcaagtgatcaatgcgactaaactgtcggataacgatttaatgctcagtgtgttggtgcataaaaatgacattgcgcaacgggtgcagaaatctttaccggaaattaaagaagccagcctaactataaaagggttcaaccggattatcattcgtaccagtgaatatcagacgattggctatgtgtatcggaatcacgcttaccataagattctggtcactggcaaagtgctgaaggccggcacgcaaacgccggttgacacgtacccagttttttctggattcactgccaaggaattacctaaaatgattgagttactgaatcagtttcctgatgcgattcgtcatgacatttcggaaatcgatgcaagccgcggtgacgccaatcccaaccagattgctttaaacatgagcgatggttatcggatcatagccgattcgcgtaccattgccaaaaaaatcaagtactatccggcaattgtttcacaggtcaagaaaaaaggcgtcgttgatttagaagtcggtgctttctggcggccatattcaagtggtgaaaagtcgtcaaatgactgattttgtaaggtttgttttctcatcagaaaatgagtgtgttacactgatgatggcaccgttttaatatgaaaattaagttgattaaaaagttacacaaggaggttcccgatacatggataatcaaggtatttacgttggacttgatatcggaaccacctcaataaaagtcattgttgccgaagcagtacagggacaaatgaatgttattggtgtgggaagtcagcggtctgaaggcgttagtcgtggggtgatcgttgacatcgataaggcagtcgcagtcatccaggcggccgttgcccaagctgaagacaaggcaaatatcaagatcgatcgggttgtggctggcatccctgccaatatgctgcagattgaacaggtttcggggatgattgccgttggtgaggagaacaaagagatctctgacaacgatgtccgcagtgttgctgcggctgcattggttcgcaacctgccgcctgagcgtgaaacattgtcactggttccgaccgaatttatcgttgacgggtttgacgatatcaaggatccacgtgggatgttgggcgttcggcttgagatgcgcggcattatgctaacggttcccaaaaccgtgattcataacacgaaaaaagccattgaaaaagctgggttacgggttggcggactggtcatttcaccactggcgattggccggttggcgttgacggatggtgaacaagactttgggacggtcttgatcgatatgggtggcggccaaagcacagcggctgttatccacgatcgcaagctcaagtttacgtcggtcgatcaagaaggcggcgaatatatcaccaaagatatttccgtcgtgttgaacacgagttttacggatgcagaaaagttaaaacgcgaatacggcaatgcagattcgctagccaccagcgaagaagaaaccttccccgtgaccgttgtcggtaaacatgaaccggcgatgatttcggaaaaatacttatcggaaattatcgaagcgcgggtcgcgcaaatcttcaagcgcctgaaaaaagcactcgatgccgttaacgcacttgagctgccgggtggcgttgtgatcaccggtggcacgacggcattgccaggggttactgaattagcacaggatatttttgattgcccggtcaagcgctttattcccgatgacatgggccttcgccatccttcatttacagaaggactggcactgatcaaatatgccgctcaaatgaccgatatcgaaatgctggtttccagtgttctgccgacgccgtttatggttgacggcgcccagacaccatcatcgtcaccatcaccggcaccgcaaaaacagccggaacaaaccgctgcttcggaaggccagcgtctcgtcaagcgcaagcccgacaagcagacagacaaaaccaagtctaaggagccatctgccttgcgccggttctttggtaatttctttgaataaatctcgattctaggaggaacacgaatggattttcaaatggacgcacagagtgaaaaaggcgccaacatcaaagttatcggtgttggcggtgcgggtggcaatgccattaatcgcatgattgccgaagacgttaaaggcgttgaatttatcgctgccaataccgatttacaggcgctgaatgccagcaacgcagaaaccaagatccagcttggaccgaaattgacgcgcggcttgggcgccggttccaatccggaaatcgggcagaaggctgcggaagaaagtgaagaggcgattggtgccgcattacaaggtgccgatatgatctttgtcacggcgggcatgggtggcggctccggtaccggtgccgcgccgatcgtggctaagatcgccaaagaccaaggtgccttgacggtaggggttgttacccgcccattcacgtttgaagggcctaagcgggctaaaaacgccactgaaggcattgcccagttaaaggaacatgtcgatacgttggtcattattgccaataaccgactgctcgagattgtggacaaaaagaccccgatgcttgaagcattccatgcagcggacaatgttttgcgccaaggggttcagggcatctccgatctgatcaccagtcctggatacgtcaacctcgattttgccgatgttaaaaccgtgatggccaaccaaggttccgccttgatgggaatcggcagtgccaccggcgaaaaccggacggtcgaagcgacgaaaaaggcgatttccagtccgttactggaagtcaatatcagcggggccaaacaggtgttgctgaatattacaggcggaccggacctcagtttgtttgaagcacaggatgcttcccaaattgttgccgatgctgccaaagacgacgttaacatcattttcggaacgtccatcaatgaagagcttggtgatgaagtcgttgtgaccgtcattgccactgggattgaagaagaagaccagcgtcgggaaagctcccgccgcccagctgctcaaacacgcggtgccgatcacgacaaaggtaatgacacttatcgtccggcatttgcgggtaacgatcagcatgacgatcagtcagcacaaagtgacgatccatttggtaactgggatttgcggcgcgagccaagcaaacgacaaacaccgagttccgatgacatgaacaatgtgaagaaaaaagattttgatatttttgaaaatcaaaccaatgcagacgatgccggaagcgacgaccagccgccgttctttaagcgtcggcgtcaatagtcaggaggtcatggaacatggcgtttggtaagttaggcgaaaaattcaacaacttctttgccatggatgatgatgaagatgattatcaggaccaagaagacgaacagacgcaggcagcgcagccggaggatcggaatgtgaatcactaccgtagtaacaaagttgtcgctatgggggcaccgaccggtaaagctgccaagatcgtggtgtttgagcctagaatttactcggacgccaaggagattgggtcgcatttgctgaataatcgagcggtggtcattaattttgatcgcattggcgcagatgatgccaggcggatcgtcgatttcttgaccgggactgtctacgcgatcaacggcgagattaagcggatcggtgagtcgattttcctggttacaccagccaattttgaaattgacggctccttagccagcaccattgattctgacggtttgaatctttcatcacaacactaaacgaggtgtcaagtgttcaattttctttatgcattataccgagtcggtgactgggcgatttacttatacatgatcatggtgtttgtttacattctgatttcatggtttcctaacgctcaagggacggcgattgatcgcttcctggaacggtgggttgatccgtttttaagtattttccggcggttcattcccgcaattgccgggttggatctttctccgatcctggcgttcttcgtgctttcgctgattaagttcggctggtcgcgtttattcttgatactcgttcaattaattgggtgacaaatcatggacgccatctatcaacattttcgaaaagacgaagcagcactgatcgaccatttcgctgaattagtcgaaacggctcggaccgagtatcgcgctgttttgactgattttaccgatccccgacagcgtttaatcgctgacagtctgatcagtgcccacgatgacatgaaactcatgcattttggcgggtatccgcatgccgagcgccaacggttgatttttgcgccggattattatgaagcacaaccggatgattttgatattcgcctgttgcagattgtgtatccggaaaaatttgccgagatgcatcatagtacgattcaaggaacattattaaacgccggactggatcgcgatgtttttggcgatatcattacagacgggcaaacgtggcaattctttgtggccgcccacatggaagactgggtcatgagcaatatctcgaaaattggccgtgtcggcgttcactttaccgactatccgttagatcaggcggtcactcccgagaatgactgggaaccgattgacttttcaatcagtgcgttgcgactcgatacggttgtggcgcatggtttcaatatgtcgcggcaacgcgccaagattttgattcaaggcggaaaagtacggttgaatttcggtgaaaccgaggcgccggatgctgaagttgcgacgtcggatatcatctcggttcgcggtttcggccgcttgcgattggatgcgattcttggtgaaaccaaaaaaggtaagttgcgtgtgtcggcggcggttattcataaatgaggatgagcgcgagctggcgcggttagaagccggagtgtaagtggtcatggacgtgatggctgggctttgccattgcgaccaaggtccttacacgcaggcttctgcgccagggagcgcgttacggtaagcgtgagctggtgcaagaaccaagctcacgctcatcctagtagaggaggactaatttcatggctttaagtccactggacattcataataaagaatttagcagcaaaatgcgcggttatgacaaggatgaagtgaatgattttcttgcccagatcgttaaagattacagcagtctgattaaggacaatgaaggacttaagaaggaactggcagatgccaaggaaaaggttcggtatttcacggacatgaaggaagccctgaaccagtcaatcattgtggcgcaagagagtgctgagaaagtcaaaaatagtgcgcatcaggaagctgatttgatcaagcagcaagcacaacaggatgcccaggcgattttgaatcgggccaaatccgatgcggatcaaaagatgcaccaggcacaggcgcaaacggagcagacgttgcatgatgcggaactgaaacggcaaaatatttccgttcagaccgaggatcttaaacgccaaagtcgggttttccgtcagcgattgcaggtcatgttagaatcgcagcttgaagttgtgaagagtccggagtggaaagaattgctttccagctcacctgaagcaccggataccacggacccgagtcaagaatcgcttgacaattcgccagctggtttcgtaaactctaagggagcagcttccggtgccgatgcctacacggagattattttcccagatgatcaaagtgcaacctcaagctcagccaacgctgaagcaacaccggctgattcggcgactgctgagtcggaatcggaatcaagtgagtcgaacagtgacgattctgatgcgacaaccgatcaaaatgtttaaaaacgtatgaacacgcgtcgtttagcggtcccctttgcagcgagccaggaattaggtgtgagcctggcaagtaccgcttgatgatatcagttcgcagttgtctcgccgagtcaataagcgggaccggttgatcaccgttaagcaatcactgagggggacttgttccctgaagttaggtggtaccacgtttgctcgtcctaatatagggcgggcttttttcattcaatcaacaaaaggagctggacacgtgaaaattaaagatacgttgaatatggggaagacgactttcccgatgcgcgccggattgccaaagaacgagccggtttggcaaaagaagtgggacgaagaccatgtttatgagcagcggcagaagttaaacgaaggcaaaccgaccttcatgttgcatgatggcccaccatttgctaacggcaatattcatatggggcatgctttgaataagatcagcaaggatattatcgttcggtataagtccatgaacggtttccgggcaccatatgttcctggctgggatactcatggactgccgatcgaacagcaattggccaaacaaggggtcaagcgcaaggaaatgtcgatgaccgattatcgggaactgtgtcggcaatttgccatgaaggaaattgataagcagcggactgatttcaagcgtttaggcgtcatgggtgactgggaacatccatacattacactgcatcatgcttatgaggccagcgagatccgggtcttcggggcaatggcgaaaaaaggctacatttaccatggcttgaagccggtttattggtcatggtcatctgaatcgacgttggccgaagccgaaatcgaatatcacgatgataaatcaccgtcgatttatgttgcgtttccggtagttgatggcaagggcttgttggatcaggatacatcgctggttatctggaccaccacgccttggaccattccggctaactacggcattgcggttaatccgaagtttgattacgttcaggttcaagttggcgaccacaagtatgttgtggcagccgaactgcttgatcaggtggctgaagaaattggctgggatcagcctaagattctcaaaactttcaaaggcacggccatggacaaaatgacggccaagcatcctctgtatgatcgtacaagcttggttatggaagctgaccatgtcacgcttgatgccgggaccggcctggttcataccgctcctggacatggggaagatgactacaaagtcggcatgaaatatggcttgcccgtgatttcggtcgttgacgccaagggctacatgaacgaaaatgcgccgggatttgaaggggtcttttatgatgatgccaataagctcatcaccaaagccttaactgaaaagggcgcactgttgaaactggatttcttcacccatagttacccgcatgattggcgtaccaaaaagccggtcattttccgagccacaacgcaatggtttgcctcaattgaagctttccgtgatcagattttgaaggcgattgatacagtcgactttaagcctagttggggtaagacccgtctgtacaatatgattcgtgatcgtggtgactgggtcatttcccgccaacgtgcatggggggttccgctcccgattttctacgctgaagacggcgaaccgattatcgaagaagaaaccattaaccatgtcgccgacttatttggcaaatatggctccaatgtctggtttgaacgcgaggctaaggatcttttgccggaagggtacacgaacccgcatagcccgcatggtcaattcaccaaagaaaaagatatcatggatgtctggtttgactcaggttcatcacatcaggcagtcttggctcagcgtccggaattgagtttcccggctgatctgtacctggaaggatccgaccagtatcgtggttggtttaactccagcttgattaccagtgttgccgcaaccggtgtcgccccatatcgtggcatcctgtctcaaggcttcacgcttgatggcaagggtcggaaaatgagtaaaagtctaggcaataccattgtgcctgccacaattgaaaagcaatttggcgccgagatcattcggctgtgggtcgcaaccgtggactcctcgtctgatgtccgggtttcggttgacaattttgcccagacgtctgaggcttatcgtaaaattcgcaatacgttgcggtttatggtggctaataccggtgactttgatccgcaaaaggatgccattgcttatgacgacctcggctccgttgatcgctatctcatggttcgtctgaatcaggtcattgctaaggtcaaggcggcctatgatgtctatgattttgccacggttgaaaaaaccattagcagtttcctggttaacgatctgagtgccttttatctcgatgttgccaaggatgtggtttatatcgaggcccaaaacgatcctaagcggcggagcatgcagacagtgatgtataccgctttgctagatctgacgaagttgctgacgccgattttgccgcatacagcggaagaagtttggccgtatctgaaacaggatactgcttacgctgccttgtctgacatgccggacgttacgcattttgacgacgaggatcagttactcgacatctggtcagcattcatggatttccgttccgaagtgcaaaaggcgcttgaagttgcgcgggacaacaaggtgatcggcaagtccatggaagcagccgttacggtgtatccatccggaccggttcgtgacatgttggatgatgttgaagcgaacgtgatgcaactgttgatcaccagtcactttgaagttgcgccaagcgatgccaaagcgccggcagatgccgaacagttcgaagatatggcagtggttgtgacccacgctaaaggggaagtatgcccacgttgccggatggttcgcactgacattgggactgatccaaaattacctgaattgtgcagtcgctgtgccgccatcgttgaagccaattaccctgaggctgtcgcaaacggttttgataaataagcaggtgacaggatgcaaggacgagttaagaatttcaatgtcgacaaaggctacggttttatcgaagccgatgggcagccggatattttcgttcatttctcggcgattaatgaacccgggtttaaaagtctgacgccgggcgaactggttgactttgttatcgttgaaggtccccgtggtcctcaggctgccaatgtgacggttcatcatgaggcggatcattcagacgatcaatgaactggcagatataaaggtgccacaatcattcaattaaaagaatcggcatgataaaaaaccgtgatcacagttgatcgcggtttttgtatacagcctatttatatgctagaaatatggagcaggttacttgttgacttcttcgattttgccgtcgtacgtgcgggcaacggtcattttggtgatggggatgtaacccagcttaggaaccagcgtcttttgaacattctttgattgaatgtagttgatgaatgcagcggttgatgcgttaggcttacccttggtgtacatgtgctcgtaagcccagatcttccaggtgttggtcgtcacatttttgtcagttggttgcaccttgtccagtgcgagcttttggacgccatctttaattgccgagaaggctagatagctaatcgcaccgggcgttgaggaaaccatctgataaacggtaccgcttgaatcctgttcctgactggtcttgactttgtcggtcttgataccgaactgttcaaaggtggcacgggtaccggaaccttgcgcacgattaatcaaaacaatttgttgatctttaccgccaacgtctttccagttggtgatcttgccttggaagatatcgaccagctgctgggttgtaatgttcttaacaccggcatctttgttaacaactggggcaatggcaactaccgcgacctgatgatcaaccaggtcgctggccttcaagtctttcttttcctgagcgaaaatgtctgaattgccgatggtgactgatccagccgccacctgacttaatccggcaccggaaccgccgccttgaacggtgatttcggccttaggattgtcggtttgatattgcttagcggcctgctcaacaagcggctgcagggctgtggacccaacggcaaggattttactttgcttcgctggtgccgagcttgccgagcttgaactgctggcggatttcgacccgcaacccgttaataccaaagtggcagttaaggccacggtcaaaccgactaacaacttcgaatgcttcattacttttccctccaatacttgaataacttaaggataaagaatgagtgtaaagacttcgccactttgatgtaaagaatgcgttttgcttttgtaaataaggtgtaggttcctttgaaaaagtaacaagattcggcgtataatggtacagctaggcgttttagaaggagcggaaaatgtgaaaaattacattgataaccaaaaagtccagaaaaaccggtggtggatcatcacggccatcgggatgtttaccatcatgtcgacgctggacgggtctattgtcaatattgcgttgccggtgatgagtcgagatttgaaaattccgatgaatcaggccgagtgggttgtatccatttatctgatgatgatctgtggattgcttttatttttcggaaaattaggcgattcgattggcaagatcaaagtatttcgtatcgggatggtgctgtttctcatcggttctctttttgccgggtttaacaatagtttggcgttgttgttggcggcacgaattgtgcaggcaacgggcgcatccatgacgatggctaataacaacgggatcgtgaccgaaatctttccaatgaatgaacgcgggcgagccttgggtctcattgggtcgtttgtttctattggcgcaattgccggacccgggattggcgggttgattctgggtcaactgccgtggggctacattttttggatcaatattccgattggcattgtggcgttgattctcggatcgattgttttaccgaaggatttacccagcaagcgggttccgattgactggtcaggcttcattagctttttagggtttattctgaccttgttcatgggtattttcctgggtcaggaacgtggctttacagatccggtgattcttgcactgttcgtcatcgccttgatcgcattggctgtctttgttcggattgaaaatcataaaaccgatccgttagtcagctttaagttatttcggaatagcgcgtttacgttaagtttgttatcggctttctttatttttgtgacgaacttcttctttaatgtgatctcgccattttatttacaaaatgcgcgcggcttatcaccggaaaaagctggctatctactgatgattttcccgattgtccaggtgattgtggcgccggtggctggttcaattgccgatcgcatcggaccttaccggattaccatggtggggttgttgttcatcgtgggcagccaagtcggctatgcgttattcaatttgcagacgtcatttgttttcgtggcattgatgattggcttagtcgggtttggtaatggcctgttccaggcgccgaataatacggtcgtgatgtcgagtgtcgcgccgcaggatctcgggattgcaggcggcttgaatgctttggcccgtaacttaggtatggttgtcggcatttcgacggcgacgacagttttgttctcctcgatgagtcacaccgccgggcggaaggtaacgacttatttaaacggtcgtcctgatgtctttatcgcagggatgcatgtatccttttgggtcgcgaccggtttgtgcctcttagccttggcattgacaggttatcggatgtggcaaattcgtgatgttgccgatgcttaatctgggaaggcgacgtcactgaggatccgctggaagtgagtcaaaaaaagtccgcgatgacgaagatcgcgggcttttgacattattcaaagtttaactggaagcttaggctcgttaaacatgcggcgtgacgtctttaggattttgaccattcatatcgccgtgggtataatttagcaattgttgcttaagttcgccttccatttgtacaagctgtttttcggcattctgacgcttgacgcggccatcttgctgaatttgcaaagtctgtttcaaggtatcgatcagatcgttttgtgtctgcgtcagcgtctcgatatcgacaacgccgcgttcattttctttggcggtttcaatcgaactgatcttcagcatctcactgttcttcttcagcaaatcgttggttgtttccgaaacttgacgctgtgcggtgaccgcatttttttgacgcaaaagggtgagggcgatagccacctggtttttccatagaggaatggcagtgttgacactggcttggattttttctgccagcgcctgattggtgttttggatcaagcgaatctgcggcgcttgctgaatggtaatttgccgcgctaattgcagatcatacgcccgtttttccaaacggctggcgaactgccgcagatcgttgacttgctgaatcgccatttggtcattagctgcttcggcggccttggctgcttcagggatcgttttatcatttaattcggccagcttcaggttcgccgcttcaatgtaaatattcaaggcatcaaaatacgccttgttttggtcataaagctcgtctaaaagcttgttgtcgtttaacaaaccctgttgtgatgtttcgagccggttggcaatcgtgtcgatttgagcaccgattttttggtactttgcggtgatttcataaatagatcgcttgacacggccaaaaattttgcggaaaatattgttattttctgctttgagttcgtcaggattggcttcatttagacgcgtcatcaggctggttaaagcgtcaccaacggcaccggtgtcttggctttgcaccttcgtcagcatgttttgagagaagaccccaagctgcttttgggcatcggcaccgtagtttaagacagtttcgcctttagtgacatcaattttgctggccaagtcctgcgctttggcttcctgttccggggtcagtttcggcttggctgttgctgcctcggagattttgggcgcggtatcgcttgcgccggatgaggtgctgaagggatccgctaataggtcatcggtcaaatttgtttgtttatcgtcgctcacgttggtcactccgtttcatgcatcttattaggatcaagatgtttcttggcaaggcggacatcgctatccaggtcatccaagtcatctttaatgaaggtttgataatcggtgcggatcttacccgccatcccggtcatcgtttcaaaggccttatctaacgtttcgtaggtgtcagccgttttgacttcatggtgtgtgatttgggcatatttctgcattagatccaacagattcgggacctgttgatagacaaaggtgccggcgtctgtcagccgctgcggagcttgcaccagtgcctcgaaataagcgtgcagcaaatcgatcaaatcggtattaagtgtgagcgcacgaagctttggcacctctttggtcaatgcttcaatggtccgaatttgatcggcaagttcagccatggtctttctaaaaagtttgatttcttcatcacttaatccggaagccgcatagtgttcagccatttttggatccaaacttggcagactggtggattttggcttcggtcggcttagttcaccgataaagcgagcgaaggcaaacacaacgccgacaaaaacagcgattgcccaacgcccggataaggcacctaataccgcacccatggcggcccagagtatgattcgccaaatgcgaatacgtttgcttgtggccacgagatcacttcctctttcgtttgagtttagtttagcacagtcctataggttgactatcagccggaagttggatattcgcaaattttttgttaagatcaagcattgcatcgtttgctggtgtaagctgatgacatgatctttcataaaagtggtgtttggcaacgttttgagtcggttaacgattcgttgattgacggcttggtacttgtgactaaataggacgaggaggcggctgcgatggaggaaaaaccgattgcacaacaacgggtatttacgggtgaattggtagcagtagatgaactgacggttaaactggccgatgatcagacagctaagcgggaaatcgtgcgtgcacagccggctgcgggcattttggcgttgagaagacaccaagccatgtttgtcagtcaattccggtcaactgttggccaggcaacgctggaaattccagcaggtaagatccaccaaggcgagatgccactggctgctgcccaacgcgaattaaatgaagaaaccggtttaaaagcgttgaattggcagccgcttgccagttattttcaatcacttggcttttcggatgcgaccatggcactttttttggctcgcgaattgacccccgctgatcagcgcctgccgcaagatgccgatgaatttgtgaacagtcattggctaacctttgatgaagcccaacaagcagtcgatgatggccgaatttgtgacagtaagacgttgttagccttgttttattggcagcagcaggaggaacagcatggcagaagttaacacgcgtaaagcctaccgtgaagcccagaagaaaaagaagcaagaagctcgtgatcgcgaagccaaacgggttgaagtggaaaaagaatacgcccggcagacgcgcgacaagccagaggttaaggcggcacgttttgatgaaatcacatttcgtaaagtgaatagcctcaagaagcggctgaattgggcgatcggcattgtctttgggttgattgtgattgtctttttggttctttattttggctaagggatgtatcgaacctacgaggcgtaaaaatagcgtcataattaatagagaaaacgaggggattttttgattaaagtcggtgtgatttgtgcgatggaagaggaaattcgcacgttgttggcgcggcaaacccagcaaaaagagacggttattgccagtcaacattattttgaaggcaagattggcgatgtcgatgtgattttggtacaatccggcatcggcaaggtgcaagccgcgatgacagcggcattgctgttggcgacttataaacctgacgttgtcattaataccggtagtgccggtgggattggccacgggctggcgatcggtgatgtggttatttccagtggcgtggcttatcatgatgtggatgctacggcctttggctacttgccggggcaacttccgcaacagccgcagatttttgaagcaggtatgtcttatgtgacgcaaattcaaacagcggctgcggcaactggtttgacgcccaaagtaggcttgattgtatcaggggaccaatttattaacgggaaagaagctattgcccgtattttgaaaacctatccgcaggcacttgccagtgaaatggaaggtgcggcagtcggccaagttgccaaagagttccacaccccatttgtcgtgattcgcgccatgagtgacgtggccgatgagcaatccggggttgattttgacaagtttgtgattaaagcaggtgagcaaagtgccgcaatgttgttgcagttctttgcccatttacaggcatctcagcatgattaggagctgatttttttatgcaacatatttatcttgataatgccgcaacaacgccaatggcacctgaagttattcagacgatgacggatcaaatgcagcatgactttggtaacgcgagctcgactcactggtttggacgggaagcacataccgtaatggacaaaagtcgaaaaattctggccgattcaattcatgcccagcccggcgagatggtcatcaccagtggcgccaccgaaagcaacaatacggccattacccagacggcgcatgcccgcgctgctttggggaagcacatcattacaactgcgattgaacatccttcagtcttgcagccactgaaggccctggaaaaagagggctttcgggtcacctatctgccggttgacgaaaatgggcggattctgttggcggattttgacgcagccttggatgatgacacgattctggtcacgatcatgatgggcaacaacgaggtcggtagccgcatgccaatcactgaaatcggcgaacggctggtggatcatcaagcctggttccacaccgatgccactcaagcgtatggattactggatattgatgtcaaaacccagcacattgatatgttgagtgtgtccgcgcacaaaatcaacggaccaaaggggatcggcttcttatatcgcgatcccaaagtgcaatttccatcgttgctaaaaggcggcgagcaggaactcaaacgccgtgcaggcaccgaaaacattgccggtattgccggttttgcaacggccgttgagctgatcacttctgaagaaaaggcaaagcgccagaccaaatatcttggcttcaagaaacaaatcatgaacgccttagatgatgccgatattccttacgcaattaatggcgacatcagacctgataacgttaatcacgtcttcaacttgtggctgaagggcatttccacctatgccttacaaaccaacctcgatttggctggtgtggctgtttcaggcggatctgcctgcacggctgggtcgctggagccatcacatgtcttgaccgcaatgtttggtgcggacagcccgcggttaggtgaatcgattcgcctttcatttggggcacaaaccactcaggaagacattcaggccttcattgatacgctgttgccgattgtccaacggctgaccgttaaacaagccgcacagtagcctcatgatatgctaaacttaatgatagtaaagcgtgttcatgaggaggatgtttcacaatggcattagcacccacaggatctgcgcaaggcgatcctaagacttatcgaattggttcagagttgaaacggttcacgttgattgatcttggctttgttcagaccaagaatggcaattttcagttgcaacggtctctggatcctaactcaccgtatacgacggcgaataagctgaaaatgacggtagctaagaacttggacaagtttcaacttgatgtaaccactgggaacggcttaaaggcgattaacatttttaaaaacgaccgcaccaaagaaaatgttgaacagtatcagtactgggttaacaatttaattgaacgcggcgttattgagcctaagtaatcgggtttgaaactagcagtaatcttcttgtgtgtgaggagattgctgcttttttctttgagcatgaacgattgattcgccgtgatggggtcatacttgaaaagtaaaagtgctaagctggtattattaagaattttttagcgtaagccggcgcgttgtggtgaacgcgcgtcagcaagcacacgaatggttagggggacgctggatgttcgagcacggttttatcgaagtgcataacgccaatcagaataatctgcaacatgtgaatattaaagttccaaagtacgcgatttccgttttcgtcggccgttctgggtcaggcaagtcgtcgttggtctttgataccatcgcggctgaatcgcggcgggaactcaatgaaacctttcccagctttacccagcaatatctgcccaagtatggccaacctgatgtgggctcaattgaccatttgcctgtcgccatcgtggtcgagcaaaaacgaatcgggaaaaatgcccggtcaaccctagctacctataccgggatttattcacttttacggctgctgttttcccgaatcggcaaaccctttatcggctattcggacactttttcattcaatctaccgcaggggatgtgccaaacgtgtcagggactcggctatgtcgatgatattgatgttaaaaagttgatcgatccgaacaaatcgttaaacgaaggcgccatcacgttcgtcagttttgggcccgatacttggcggtggcggcgctatgcctatagtgggctgtttgacaatgataagccgttgcgggattatacgccggaagaaatgaaactattgctgtacgcgccgcaacagacactcgagcatgcacctgccaagtggccgcgaacggctctgtatgaaggggttgtgccgcgcatcaagcgatcgattattggcaaaaaagaagcggagcaccacaaagcggcacttgccgaaatcgtgacgcgcaagccctgtcctgcatgccatggcacccgcctgcgtccggaagtgttgacctgcctcatcaatcagaccaacattgcgcaggtattaaaaatggatctggtcaatgtgcgggagtttttgaagaaaattcaggtcccattggcgcaagatgtgattcgcgaactgttgcggaaaatcgatgctttaattgatatcgggttaggttacctttcgttggatcggccgacagaaacactttcaggtggcgagacccagcgcatcaaaatcgctaagtttctgaccagcgccttggtcgacatggtttatattcttgatgagccaagcgtcggcctccatccgcatgacatcgaattgattaagcgggcactggtgcggttaaagcaaaaaggtaatacgattttgattgtcgaacacaatccggcgttaattgcattaggtgattacattgtcgaagtcggtcccggtgccggcacaaccggtggccatatcacgttcaccggcacttatccacagttgctggctagccaagcgttgactggccgtctgcttaaacagcgactgacgtttcgtcaaccgcggccagccaagacgacgcttgatctgcctcacattaagcggcacaacttgaaagatgtccatgccgtcattcccttgggcatcgaaaccgtgatttccggagttgctggctcaggtaaaagtacgctggtcagcgcattacgcgatcatttgacggtgccatatattgacctggcacaggccgacatcggtgccaacattcgctcaacgccggcaacttacctgaaaattctggacccgattcgcaaagtttttgcccacgcgaaccatgtaggcagcagttggtttagctacaacggcagcggcgcttgcccacgctgcaaaggtaaaggggtgacgatcacgaacatggccttcatggatccggttgtctccgtctgcgaacagtgccacgggcggcgttataacgatcaggcactgagttacacctatcacgggcaaaatattgccgacgtgttacaaatgccgattgctaaggcgcaaacctttttcgctgaaacaagtgagattgccaagccgctacggaatatggcgcgggtggggcttgattacttaacactcggccagccgctgaccacgttgtcaggtggggaaaagcagcgtctcaagctggcggttgaattaaatcgcacgggcgaagtttacctactagatgaaccgacagccggcctccacttacaggacatcaccaaattgttgcgcttgtttgacgatttggtggacgccggaaattcactgatcattgtcgaacacaatctgcaagtcatcagtcaggccgattggttaattgatatgggtcctgatgccggcatttatggtgggcggattttatacgccggaaccccggaagctagcatgcaggtcaagcaatcccgaaccggccaggcattgcgacaatataacgaagccccggaacggcgggcataatgccagaagcagggtaatcggcgccgcttaaccgtcacagcacgtctagtcgatttaaaaaacttggtccactttaacccaaaagtcggaaaaggcttgtacagagctgtgcttgctatctttttgtggcctgctataataacacttactggaattcgaccttcaaatcggatatctccagaatctgatgaaatgatggtgattgttttggacaattccaacacccgggttgttgtcggcatgtctggcggcgttgactccagtgtcacggcgcttttgctgaagcaacagggatatgatgttgtcggtgtcttcatgaaaaattgggacgacaccgatgaaaatggtgtttgtacggcgaccacggattacgaggacgttgctaaggtagcaagtgaaatcgggatcccttattactcgatcaatttcgaaaaagagtactgggaccgggtttttcagtatttcctagacgaatataaagccggccggacaccgaatcccgatgttatgtgcaacaaggaaattaagttcaaggcatttttggactatgctgagcagttaaatgcggactacattgcgatgggccattatgcgcaagtgaagaccgatgaggatggcgtgactcacatgttgcgtggggctgatggtaataaagaccagacatatttcttgagtcagctttcccaggatcagcttaagaagtcgatgtttccgattggccacctgcagaagccggaagtacgtaagattgcggctgctgcgggacttgctacagcgaaaaagaaggattcgaccggtatttgctttatcggtgagcggaacttcaagcagtttctaagtacctatctgccagcgcagcccggtaaaatgatgaccgttgatggtgtcgagatgggcacccatgacgggctgatgtattatacgatcggtcagcgtcaaggccttggcatcggcggcaattcgcaaaattctgagccttggtttgttgttggcaaagatttagacaagaatatcctttacgtgggccaaggttttgataatcctgccttgatggccacgagtctcagtgcgtcaaaccttaactggacaaccggagaggcgcctgcagaaggcacccacatgacagcaaagttccgctatcgtcagcgtgacacgggcgttacgattcactatcatgcggacggtacagccacggttgattttgacgagccggttcgtgccatcactcccggtcaggccgttgtcttttatgacggcgacgagtgcttaggcggcggcaccattgatgcagcttatgcccacacgaatgagttacagtacgtttagtaacaaataatgaccgattacaaaagcttcagccttggagatgcttgtcgtctctagggctgattttttttgagcgtgagccgactcctgcgccggcgaaagcgttataggtaccacttgtcagttttgatccatccctgagtgtgcttgatatttatggcgaaaatactgataatgaaaaggttaagacgtaaaaggagagcggcttgtgaccaaattatattttgtacgccatggcaaaaccgaatggaataatcaaggacgttatcaaggcgcaaatggggactccccgttgcttccggaaagttttgagcaaatcaaggcattggccgactatttgcgtggtatgcattttgcccacgcctatgtgagtccgcttaaacgtgcgcgggtgacggcgcagactttaatcaaagatttggatgaaacaattccgttaacggttatgccagcgttgcgggaatttaacctaggaaaaatggaaggcatgacgttcagtgatgttgccaagcattttccggcagagctccatgcttttcgccatgaaccggctgcttatgacccgcgaaaaattcatggcgagtcgttttcccagctgatcaatcgcgccattccggccatcgttgcaacagttgcgatggatcggagcggtgaggctaatttgttgtacgtcagtcatggcgccgcgttggctgcagtcattcagagcttgctggggacgccattagccgagattcgcaaagacggtggccttacaaacagcagcgtgacgattttacaggcagatggaccaagcctgccgtttaaattaatcgactggaacgagaccggctttttaccggaacccccaaaaccaaccgacaccatttgatttttgggacagcatgaccacgatatgagtaaagaggttgttatggattcagatattttaaccgcatttaatcaaggaaaacacgaagaggccatacgtgcagccgtcaaagccattgatgctgcgccgaaagatcctaagcgctatgccatgttggcaacaatgctcatcagcttgaaggccttggaccaggcgggtgaactgctcgccaaagcgcgcaaccttttcccgactgatattgaactccaatatacagccggcttatttgcctatgcacaggcggattatccagccgcagcagcctggtttgccaaatgtcgcaaggacaagcacctcaaaaacgatgccacttacatgttggcgttgagttatcaacaggcaggtcaaaccaaaaaagccctcgcatttgctctcaccgcccacgaattggcacctaaacaaaccgacgcggctttgcttgcagctgatttgttgttggcagcgcaggcatttgacgcggcagcggacattttgaagccattgcttgacgccaaacaaccgcaaattctgtttacttatggcatggcgttaagtgccgctggcaaagatggtagtcattatctggatgaagccaagcgactcgatccaaagggctatgatcaaaaggccagcgcggtcgccgacatcaaccggtttttaaagctgcaggagggtcacgatggacaggcatgaggatagtgtcaccggccgggtcaaaagcattttctttcagaatccgacgaatttttttaaaattctcctgattgacattaccgccacgacgatcacctggaccgagccggacattgtcgtgaccggcacgtttggtgatatcaaagaagacgaaacttacacgtttaccggtcacgtaatcgaccatcccaagtatggtcaacagtttcaagcagataattatcatgttgatcagccaaccaacaaaaccggtttgatcaattacctcagttcggataagtttccgggtatcgggccaaaaactgccgagaagatcattggtaagcttggggtagatgcgattaatcagattctcgatgatccggcatcgcttgaaggacttggcatcaccgctgcaaagcgaaaaatgctggttgacaatcttaagacgaatcaaggcatggaacgcgtcatcatcggactgaatgattacggcttcaccagtaacatggcggggcggatttatcagcaataccaaaatgacgcgcttgaagtgattaagcaaaatccatatcaactcatcaatgatattgccggcatcgggtttacccgtgcggatcaaattgccgccaaattgaatatcgcaccggattcgcaattgcgtctcggcggagccgtcatggacacgttgcaacgcctgaccgatggcgaaggggacacttttgtcgaactgcgcacgctcgttacccagacacttgatttgttagagcgggcacggaatattgccgttaagccagatgacgttggtcaggccattgtgacccttgctaaagataatgagctggtcgctgaggacaaacggatctttcctaaacggctctatgattcggagtggcagattgctcgtcagttgaagggattagccgaagcaggcgcgaaggctgaagaacctgagctgccagatattgaaaaaacgttagccgaagtacaggcagacaccggcattgcctacgatgatgtccaaaaaaaagcaattgtgacggcgttgcgatccccgatttttctattgacgggcggtcctggtaccggaaaaacgaccgtgacagatgggatcgtccgcacttatgcgcgactacatgatctttcgttagatgccaatcagtataactcggatgatccatttccaatcatgctggcagcgccgactggccgtgcagctaagcgaattagcgagacgacgcaattaccggccagtaccattcatcggttattgggactaggtgtggatacgcaggattttgcgcctaatgatctgccggacgggctgttgattattgacgaaatgtcgatggtcgatacgtatttatttcgcacgctgttgaccgcgcttcatcctggcatgcagattgtgctagtgggagataaggatcagcttcctagcgtcggtccgggacaggtttttgcggatcttttacgcagcggtgcattgccccaagccgcattaacccatattcatcgccaagacgccgatagttcgatcattccgttagcccatgcggtgaacgccggcaaacttcctgacgatttcacgcaaccacaagtggatcgcagttttttggcatgcgcgcccaaccaagtgccggaggtcgtaggtcaagttgtgaagcgggcggccgtcaagcaattttcgatcgccgacattcaggtgttagcaccaatgtatcgcggaaccgcgggaattgatcgcctcaacccaatgttgcagaatattttgaatcctaaacgcagcgcgcggaccaaaaccgttcattttggcgacaccgagtatcgaatcggtgataaaatcctgcagctggtcaatgatcctaaccagaatgtgtttaatggcgaaatcggccagattgtcgggatcacgttagccaaagaagcacccagcaaaaccgatgagctgacgattgactttgacggcaatgagatcacgtataagcgtagcgattttagcaaaatcacgctggcctatgcgacgtcgatccacaaagctcaagggagcgaattcccgatggtgattttgccgctaaccttgcaaagtcggcgaatgttgcggcgaaacttgctttataccgccattacccgagcaaagtcatttctgattttggtgggtgaacttgcagcttttgaaacggcggttggtgaagtggcagtgaatcggcatactgggttggttcagcggttgcagcaggtgtttgacatcgaaggatcgcaaacggctgtcgaagaagctacggtaccacaaccagcgttgccgcaagaacccacgcaaattgacacaaatggttccgactcggataatgaagttaggcctgccaaaacggcgccgcaccagttaacgccggcattagcagcctcacagaaaattgatccgatgattggaatggatggtataaccccgcaaatgtttatgacgaaggagaattaattttgtatggaggacaacatacgcaagtcactggtcattaagccagtgacgcctaaggatcttgagcagttcaatgatcttttgacttatgtgtttcaggttacgcaaaaagacttagaacaatccggctatgaagaaggcgagttggagcgggccaagcgtccggttttggaaaaatcagatgtgctggggtggttccataaagatgagcttgttagctcgcttgctatttatccttgcacggtgaacattcatgggacgttgtatcaaatggccggactaaccggcgtcgggacttatccggaatacgcgggtcatggactgatgcacgatttagttaagttgggcttggagcatatgcgcagccacaaacaatggatttcgtatctgtatccctacagcattccgttttatcgcaaaaaaggctgggagatcatgtcggatcatctcacgtttgacgtcaaagatacccagctgccgaaacaggttaatgttcctggccacgttgaacgtttggaaattgatgatcctgacgtgattgagacatacaaccgtttcgccatgaaaaatcacggtgccatgatccgcaaccagttaaactgggacgagtactggcgctgggaaaatgaagaagaacggactgcaggtgtgtactatgatgccgacgatcaacctcaaggctatgttctgtattggattgcggacgaagtttttcatgtgaaggaaatgatctacaccaatcaggaagcccgcgtcgggttgtggaacttcatcagtgcccatttttcgatggtgacgcatgttaaaggcaacatttacaaaaatgagccgttgcattttctcttggatgacggggatatctatcaaaccattaaaccttacttcatggcgcggattgtggatgtcaaagccttcttggcacaatacccgtttgcaaccgagacaacggaaccattccactttattgtgagtgatccgttagcgccatggaacaacggcacctttggggtttattgggatgaaaatcagcaggtgcacattaccgatcggccggttggtgaagccattacgactgacattcagacactgacaaccatgctcatgagttatcggcggccttcttatttggctcaaatcgaacggctttcggcaagtaaacacgccattaaattgttggaaaatgccgtgccaatggaagagccttacttttcggattatttctgattggattttggtagcacaatttaagtaaccggtttagcgcacgctgatcaatacgaacactgaatagcgtgaaaaggcaccgcagtttgtgaaatttcacaaactgcggtgcctttttgtcattcatttaaatactgcggtcaatccaaaagcgttggctggctaccgaaaagtctatttcaaatggtcgcgttcccatctcttcaccatccatctggccgaattccagggagctggtctcgaccgttagtttattcgcatgaaaaaggtgaacggctttgctggtcggtgttttgccgcgcagcaattgtagcatcgccaaggcccaggagacgatattgaaccattccacgatcactaggtctaactggccatcagtcggatcggcgggtttgtaaagccggatgccgccgccgaagtaaggaatattcgtggtggtacaaatataagcatggtgaaaaaaatggcggacacctttttcataaactgccactggaaaagggcggcgggtcagtaacatgccgagaacatggaataagtaggttaacttgccgaggtggaatttgtttaacagttgcttactgtcgctgtgattggcggcattgacgacggctgcatcaaacccaatgccgatattgttgacaaaataaccggattcatcgcgagttcgttcgtggtagcgaccgatatcaattgtaaccggtttagaggcttgcagaatctgttctagcgcatgcatcgggtcctctgacataccgatgccccgcgcgaagtcattgcccgatccggctggtacataggcaaccgggatatcatgttgacgagtgccgattaatccattgatagcctgattcaacgtgccatcgccgccgatcaccaacaaaaccggatgttcatgcgtgttgaagttaccgatctgtttggtaataacgttggtatggccaggataacgcgaggttttgatcgcgtaaggcaactggcgctgatccaagacggccttaacctgtttaaaaatcgggatggccgcaccgccaccagccgccgggttatagataagataataaaaaacagccgccatcaactttcctcctaatcagacacgcaatcaattataccgaaaaactgaagaaaaacaatgcaatgacgtcctctccagaagccaaaaaaaataccgtactgccggcaacaatgcggcagtacggccatgatcgacattttgaacaacgattgtttttgacaagtcggctttaaagtaaaatcaacatcggcaaaataactggatgtcgttcggttttatcgaacagaaattcctgcaagttactgataatcgcgtcttttaaacttgcctcggttactttttcattattggaaaaagtggatttgatcgtgcgataaacccgccgttgtgcttggttgattaattcacctgattcacgcatgtagatgaacccgcgtgagagcaaatccgggccagccaaaacagcttgcttctgcatgttgatggttgcgactacgacgaccaaaccttcttctgacaacatgcggcgatcgcggataaccgcattgccgatgtcgccaacgccgctgccatcgatgtaaacgtcgccagcagggaagtggcccgcgatccgcgcacttttttccgtgagcgccaatacgtcaccattttccatgatgaagcaattcttttccggaaccccgcattgttgggcaagttcacagtgaatcttttgcatccgatattcaccatggcaggccatgaagaatttcggtttgatcaggcgcaacatcaatttctgatcttcttgaccaccgtggccggaagtatggacgttgttgactttgccatgaatcacttcggcaccggcttcgctcagctggttaatcacgtggttaacgctgactgtgttgcccggaatcggattactggagaagattaccgtgtcaccgggctgaatgctgatttggcgatgggtaccattcgcaatccggctcaacgcagccattggttcaccttgcgaacccgtgcacagaatcataaccttatcggcaggcagtgaattcaactggtgggcgtcaattaaaacatcgtccgggatgttcagataacctagctcacggccattgaccatcgcggtttccatcgaacggccaaagaccgcaatcttgcggccatgtgccatggcggcatcagcagcctgggcaattcgcgagatgttggacgcaaatgtcgcgaagataatgcgcccatcaattcgatcaaaaatatggcgaatcgacttaccgacaaagcgctctgatttggtaaacgtcgggatctcggcattggtcgaatcagacattaagactaggacgccttcttcggcgaaacgacacattttttgaaaattcggtgaaggttggtcaccaaccggcgtcagatcaaacttaaagtcaccggtctgaatgacaattccctgtggcgtgtggacggcaatacccaatgtatccgggatactgtgggtggtgcggaaaaattcaacactcagttttttaaactttaaaacggtgtcttcattgatctccgtcagctttgttgtgcgtaacaagccgtgttcctccagcttgccgcgaatcaaggcagctgctaacggcccagcataaatcgggacgtttggaacctgcttaaggaagtagggaataccgccgatatgatcttcgtggccatgggtaatgaccaaagccttgatcttgtctttgttctgaactaaataggaataatcggaaatgacataatcaatcccaagcagatcatcttcaggaaatttgatccccgcatcgatgacgatgatttcatcttggaattgaaccccgtacatgttcttcccgatttcacctaaaccgccgacagcaaagacagcggtttcgttatttttaatatttaatttcatatgattagaaggtggtcagcttaaagttggctgacttttcctcatactccaggaaatttccggagagttcctggataaattcaatgttgtaaggcgtgttcgcttctacaagtgcacgcgcttcaaccgcagatggcgcctcgaggtaaagcgtctgggttgtttcccgccgcggattttggaccttgtctttttgatataagactttgtagatcatgattggactccttccgtggtacaaaaagaaaggaagtgtgacaaaatggcttccgaaaaaagggacacaccaccgagataacgaaccataaaaaaacatggtcgatctccttgaaatggccgatatttcgcaccgcttgaaccgcaaaatggcaacaaagcacccttgctgtggttcatttcttgccacaactcctaaaacctttatgaccgatcgatttgttgtgaatacaacagctagcaatagtttagcataatcaagaaggaatgaacagagaacgcattttgaagagggcagttacatgttgaacagcaggattggacggtgcgtagcggattttagcgattaccattaccacttttacacgtcaacttccgcgttaacactcacgattgcgagttaaaaaatgagtcagcacttttcagaattttagattaacggcgatgactgccaaatgtttttgtcggattagcgagttgcgactggttttaggtataataatgatagaagaaacaaaagtgttctctagaagggggtggacgtcatagcatggtttttagtcgtcctgttactggttgtcgtggcaattctcttagcatttaggaaacgctggcggcgcaacaaagccattcaaatattactccatcacagccaacgattaacagatcaaacaatggcggcagctttacagacactgaactttcccgtcgctaagccgttggtgtcaaaaccgatggcagacatatggggacatggcatcatggcattttcatatcaattaccgttgcaaacaaaaaccctcaaacagcagccccttgaaaaagctttgcagaacgcagccgaagaattggacattgcaagttcggatcctgcattgccgccttttgtgattaccgatttttttgtattggacggccaattgcatgtcgatgtcgcgttcatcaccaaccaagcaaccattgagtatgtccgtgatgtcaatcgcgtggcgtgagagaatgatgtagaaggtgcagtacacagtcattgttgttgcgaaaatcatcctttgcagggaccaagcggttaaaaggctggaccataacttatagctaaaagaaagcatgtgcgaaggtaaaatttccaactccccagaaacttcaaaaatgaaaggaaccgattcaaggctgaaaaatagtcttggatcggttcttctttaacgccattatactttttaacatcgagcgggttccgcactaagataataagtaacaacacgaaccagagaaaatgggaacaacaacatggccattaagcgtacagaaaattaagcgctttttttgaatactgcctttgtcgtacaagatgtacagatgtgttgaaattataggaggaaatgtacatatgaaaatcgagaacatcaaagtcacagatccgttctggaccaagtacaggaccatcgtcaaagacaagctgattccttaccagtggtcagtcattaacgacgacaaggccatcacaattgagaaagaaaacgctggggcatacgacgccgtgaaaaagagccatgctgtcgagaacctaaaaatcgctgccggtttggccaagggacacttttatggtttctggttccaagattccgacgtctacaaatggttggaagccgtggcgtatactcttcgatatgcaccggacaagagattagaaggtatcgccaacaacgtcatcgacatcattagccaggctcaggagccggatgggtatctagacacatacattcagattgaagcgccggagcataaatttacccacgtgtccctgagccatgagctgtacgtcatgggccattacattgaagccggggttgcctactatcagacgacacattatcggaaggcattggacatcgccaagaaaatgggtgactgcatcgatgccaactttggacccgaagataaaaagatgcacggttatcccgggcacccggaaattgagttggcgctggccaaactggccgacgaaaccggcgacgtcaagtacacccgggtggcaaagtacatgatcgaccagcgaggcacccggcctaataatttcttcgaggaacagcttaagaacgttcaagctaagaagattgaggacccctactatagcgatgccagccagtcggatccagaaccatcttacttccaaaatgacgtgcctgttcgagaaatgaccagtgtggagggccacgccgtccggatggtctatctgctcaccggtatggcccacgtggctcggcagaccggggatgaaagtctctttgctgccagccagcgtctatggaaggacgttacccgccggcagatgtatattaccggcggcgtgggctcgtctgcacccaagggcgaagccttcaccttcgattacgatttgcccaacgacacagcctatgccgagacctgtgcttcttgtgcgatgtccttctttgctaagcagatgcgggatacttaccaggatgccgattatggtgatgtgttggagcgggaactatacaatggtacgatttcgggcatgtccctggatggaaagcatttcttctatgtgaatcctttggaagtggatcccaaggccagcaaggaagatcccatgaagtcccatgttaaagtgcagcgtgccgcttggtttggctgcgcttgctgcccgccgaacctcgcccgactggtggcgtcggtagatcagtacatctacaccgtgacggaggatgctatttatgcggatcagttcatcggcaatgagaccactttcgataacgggctaaccattgagcagaccggtaattttccctggtctggtaatgtgcagtttgccatcacggcaaagaaaacggtgaaaacgactgtggcaattcgaattcctgcttggagtcgtgatcattacgcggtgaccgtcaatggtcaaccgctggctgtggaactggatcaaggctacctgaggattaagagaaattggtcgggtacaacgcagatcgcagtcacgctagacatgagcgtgcaaatggtccacgccgacccccgagttaaggacgatgtgggcaaaactgccatccagcgcgggccggtggtctacacgctagaacaagcagataatggctgtcagctccaggccaataccctgccggtaaccccggcgttcaccgtcacccccgatgatcaaacctttgcggtgccgatagtgaagattaccacgacggccctgcacacggacgccgccacgccgattggcaacctctacggtacaccagcaaccacgctgacacataagaagcagcttactttcatcccgtactttgcatgggcgaatcgaaccccaggagaaatgatggtctgggtgcaccagatgtaagggtgattcgcgatacctaatgatttggttcctctggttggctgggtgaggtgtaattttgctgtaacacaatcaacatttcaaatgcttaccaaaactaactggaacgtgggggacggcaataattgcctggggtcacttatgctccgatttctaagggttctttcatgctttgcttttcacacttgcagcggtgtgctaatctagtaaaagaaatgaacggaggtacggatcttgtatttaatgaaggatatcactcgtgacggcgctaaagttttgcgtgaaagagctaagccagtaacgtttcctctttctgatgaagacaaaaaattggctcacgacatgatggcctatctggtgattagtcaagatgaagagcaaaacgaaaaataccatttgcgccccggcgttggtttggcagcaccgcaagtcggccagagcaaagcgatggctgcggttctcgtgcccggagaaaataacgaaatccttttcaaggaagttttgatcaatccgcggatcatcagcaacagcgtacagcacgctgctcttgctgaaggtgaaggctgcttgtctgttgataaagatattcccggttatgtcgtacgcgccgatcgcatcacgattgcttatcaaaacgaggccggagaacataaaaaagtccgccttaagaactatcctgccattgtgtgtcagcacgagattgaccacttgaatggtgttttgttttacgaccacatcaataaggaacatcccttctcaatcgatccaaatgctgttttgattcattaaaacagctgaattttcattgcggtcggcacaattgtggaagagggtgcgtgttattgttgacatccctcttttcatcggctactatagattacggtaaataaatacggtgctttccgttaggtgaggctcctatacgaacaatgttgctgctcagaaacatcgagagatgccaattgagtcaactgcgtttgcccattaaggcttacgctaacgcaactgaagctcgcttctaggcgtatagtgctaaaactaaacgattgggatgctatttctgcacgtcctcaatcggcgtgcagtttttttatctgagggaaagtagaaaaggtggtgagcataatggaacaatcttcaaagagtagcggtagtagcagcgatttagcggatcccggaaggcccattatgctgccgctacgatctcttaagtgaaattaatggatttggcagcatcgcggctcttttcgggatatacggaaaggagtttgtcgatgttgatgatgatatcaagcggcctgacacgctatgaagcgcaaagggctcaaaaagcagtgacaccccaccagaattcgatcagcaagacaaaactctttttgcctttgctggcggtactggctggtgtgagcagcctaattagctttgtcagtcacagctggcttttaactgctattattgcgatactgcttggttttttgattgctgtggttgtttatttgatcacagcgttgactcggcatcaaagtaatccccaacaatcagtgttggtcgtgcgtgaaggactggttcgtcaggttcaggcgcaagaccttgtcgttggcgacgttttgatgctgacagcgggagaaaaactgcctgttgatgttgcattgtctcctgaagtgcacgcaaccttgccaagtgacatggccgggatgctggttttgttgaatcagcaggtgcctgcaggaatgggcgtggctggtgccgtgatggcaaccgacgcccaagcaacggtgactgcagtttggcataatggtctactggaccgtgcgttaatgcagcttgcgaatcaatccacaaatctagcgtcaacttcacttgtaatgagtgcggttaccgctataacacttgcgttgaaacagatttgctgtgtggctcgcatgactgtatcaattctccctgcagaattgttcaaaagcaaacaaataaatcgtgcagtgcaaattcagctggatatggattttgcacgccacgccaccttggttggcgccatgaaacatcacagtaaaaccagtgatttctggcacaaccaagatccggtctcgtgatgcacggacaatgttttgatgatgaagaggcacgcgattgtgaaacgacgtgctttttttgtgtcttaataaaaggggccgcctgttatagtctgacaatgacataacgggcggctttttttcgtaaaaagtacttcttgtgtaccttgaaataaaacgcttgcaacgacaattttgcaatgttacgctttgtttgtaaagattttcattagtacagttttcctgggttaataactacaggaatggaaagaggttctgattatggcaaaacagcatgctgcagttgattttaaacgactgctagacaatcaagatgccgattttaagccgacgatccagattctggatgaggttggcaaagtcgtcaatcctgatatcatgcccgatctcagtgatgatcagttggttgatttgatgtccaagatggtttggcaacgggtgcttgatcaacgggcaacagcgctaaaccggcaaggacgtttaggattttatgcgccgagtgcaggcgaagaggccagcatgattggcagtcatgcggcaatgaaaaaagaagattggctgctgccagcctaccgtgatttaccgcagctgatccaacatggcctgccactggacaaggcatttttgtggtcgcgtggtcatgtcgcaggtaacgaatatccagaagattttcatgcactgccaccacaaatcattattggtgcgcagtatgtgcagactgctggtgttgcgcttggcttgaagaaaaatggcagcgatgaagtcgcctttacgtataccggtgatggtggtacgtcacagggggatttctatgaaggcgttaactttgccggacactttaaagcaccagcactcttcatcgttcaagacaacggcttcgcgatttccgttccgcgtgccaatcagacggcggccaagacgctggctcaaaaagcagtggctgccggggttcccggcgtgcaggttgacggtatggacgcactggccgtttatgaagttaccaaggaagccagagcttgggctgcggccggcaatggtccggttttgattgaaacactgacttatcggtatggtccgcatacgttgtcaggcgatgatccgacacgctaccgttcaaaggaaaccgatgaattgtggcagaaacgtgatccgttgattcgaatgcgtaacttcctaaccgataaaggtctctgggacaaggacaaggaagacgccttgatcgaaaaggttaaagacgatattaagaatgccattaacgaagccgataaggcaccacagcaaacggtatcgcggttcctgaaagatacctatgaagagtcacctcagaatgtggcggaacaactggcagaatttcaaggaaaggagtcgaagtaaccatggcacaaaaaacaatgatccaagccatcactgatgcgcttgatgttgagttggcgaacgaccctaaaaccttggtattcggcgaagatgttggtaaaaacggtggggtcttccgggcaacggatggcttgcaggctaaacacggtgaggatcgtgtctttgatacgccacttgccgagtcaggcattagtggtttggccattggattggcattaaccggctggcggccgattccggaaatccagttctttgggttcgtttttgaaaccatggatagtattggcggtcagatgtcgcggatgcggtatcggatgggtggtacgcggtccatgccgattaccattcgggcaccatttggcggtggggttcatacaccggaaatgcacagtgataactttgaaggcttgatcgcccagttcccgggcatgcgggttgttattccaagcaacccatatgatgctaaaggtttgctgattagttccattcgcagcaatgacccagtgttattccttgaacacatgaaactttaccggtcgttccgtcaggatgttccagaagggacttacacggtgccgctggataaggcagcggtaacgcgtgaaggaaccgacgtgtcgatcatcacttatggtgcgatggttcgtgaagcgctcaaggcggctgataatctagccaaagatggcatcaatgcagaaattgttgatctacgaactattgccccgcttgatgttgagaccatcattgcatcggttaagaaaacgcataaggcagtggtcgttcaggaagcccagcggatggccggtgttgccgccaacgttatcagtgaaatttctgaacgggcaattctgtcacttgaggcaccgatcggtcgggttgcggctcctgatacgccgttcccatttggtcaagccgaaaatatttggctgccaaatgccaaggatattgaagctaaagttcgggaaaccgttaatttctagagagaagaggtgccaacatggcttttgaattcaaactgccagaacttggcgaaggtttggcagaaggtgaaatcgtcaagtgggacgttaaacctggtgatgaaatcaaggaggatgacacccttcttgaagttcagagtgataaaagtgtcgaagaaattccgtcgccagtatccgggaaaattttaaaaattttagtaccggaaggcgaaacagcttcggtcggtgatttgttggttgaaatcgatgatggctcaggcgcgcctgcacagtcggcagcaccagcagcttcaaccgctgcaccggctgcacctgcaccggccgcagctaagtcggtatatcagtttaagcttccggaattaggcgaaggcttggcagaaggtgaaattgtcaagtgggacgtgaaggctggcgatgaaatcaaggaggatgacacccttcttgaagttcaaagcgataagagtgtcgaagaaattccatctccggttaccggaacagttgtcaagattctggttcctgaaggggaaacggcatctgttggcgacgccttggttgatattgatgctccgggccataacgatacgccagttgccggtgaaccggcagctacaccggcaacgagtactgctggggcagagactgcttctgcaccaagcccggcggcaggtgccgtaccggcaataacagatccaaatcgcgaaattttggcaatgccttctgttcggcaatacgcgcgtgaacaaggcgttgatatttcgcaagtgcctgcaaccggtaagcacggccgcattaccaaagctgacgttgatgcgtttaaggcaggcggttcaacttcagcagcagctccggcacaaccagcgcaagcggcagctaagtctgctccggctcaagcagcaccggcagcaccaaagccgcaacctgttgcaccatatgtttcaagcggcagcgaagccgaacttgagacacgtgaaaagatgaccccaacgcgtaaggcaattgcgaaggcaatgctgtcatccaagcagcggagcccacatgtcacgagctttgatgaagtcgaagtttctaagttgatggctcatcgtaagaaatacaagcagtatgcggctgataaaggcattaagctgaccttcttgccatacatcgtcaaggcactggtcaccgtcttgcgtgagtatcctgaatttaatgcgtctattgacgataccaccgatgaaattgtctacaagcattacttcaacatcgggattgcaaccaacacggatcatggcttgtatgtgccggttatcaagaacgccgatgcgaagagtatgtttgaaattgccaaagagatcagtgacaatgcgcagaaagcctatgacagcaaattgaagccagatgaaatgcgtggcggttccatgaccatcagtaatgtcggatcaattggcggcggctggttcacaccggttattaatcagccggaagttgcaattcttggtgttggtaaaattgccaaggaaccatacgtcaatgctgataacgaaattgttgtcggtaatctgctgaagctgagtttgagttatgatcaccgtctaattgatggtgcgctggcgcaaacagcattgaatctgatggacaaattgttggcagatcctgatctgctgttgatggagggataagtatggttgtaggcgattttgcaatcgatttggatactgttgtgattggctccggccccggcggctatgttgctgccattcgggctgctgaaatgggccagaaagttaccgtgatcgaaagtactttcatcggcggtgtttgtttgaatgttggctgtattccatcaaaagcgttgattaatgctgggcatcgttatcaagatgctttggacgccagcacattcggcattaacgctaaaggtgcggatcttgactttaagaagacacaggactggaagcaaaataaggttgttcacaccttaaccagcggtgtttcaatgttgttcaagaagcacaagattgattcaatcatgggtactgctttcttaaaggatgatcatagtttacgggtcatgcaaaaggattcagcccaaacgtacactttcaaaaacttgattatcgcaaccggcagtcggccgattgaaattaagggctttaaattcggtaaacgaattcttgattcgaccggtggcttgaatttaccagaggttccaaaagaattcgttgttatcggtggtggctacatcggttctgaattggcaagcgcttatgcaaacttaggtgcacatgtcacgatccttgaagggaccagttcgattctgccgaactttgaaaaggatatggttcagttggtattgaactcctttaagaagcgcggtgtcacggttatcacgaatgcgatggccaaagaagctgaagataccggtaacggtgtcaaggtcacttataccgctgatggcaaagaacagacgctggccgctgactatgtcatggtcactgtcggacgtcggccaaatacggatgatttaggactggacattgtcggcattgaaacgactgatcgcggtttgatcaaggttgatgcgcaaggccgcactaacaaaccaaacatctacgcaattggcgatgttgttccgggtgcagcgttagcccataaggcgagctacgaaggtaaggtagctgctgaagcgatcagcggcaaagcgagtgcggttgactataaagcaatgccggctgtttgtttcacagatcctgagcttgcaacgactggcatgacgcttgcagaagccaaagccaagggcatcaaagccaaggcaagcaagttcccattcgctgctaatggccgcgccttgagtttggcccaaacagaaggctttgtccgtcttgtcaccaatgaagacggcacggttattggtggtcaggtagccggcgccggcgccagtgatttgatttccgagctgactgtggctgtcgaaggcggtctgaacgtcgaggatttggcgctgaccattcacccgcatccgaccttaagcgaaacgatcatggacgatgccgaagttgcattaggcttaccaatcaatatttagcagctggatcggtcattgtcagaattagttttagtttcgggtcacaatttctaggatcactaagcagacactggattttcaccagtgtctttttttgtgcacactttttttcttttttaaaagactaatcttgctaactttgaaaattcagggcaagttatgaccaccagcctgaagataacaacggtattttcatatgagaaggcgttaatatttcagttagttaacaattgcacctaaagtcctttttaattttgtcttaagattgcgcttccgctagaatataggtaacgcaactgaggggaaggggtttcatgcaaagagtcgtcgttcacggagccagttgtagtacacaagcacttttgcaaacgttaattgcgtcaccacttgatctggaaattggttgctacgagccggatgcggcattggtggatgtcgccggtttgacggcactgagtcaaatttgccacaatacgtttatcaaggtaaccccgaaagttctcaaaacggcggatgtgttgattctaactgataccggaacgccggatgatgaaaactttgtggcgaccaacattgcctcaattcgtaaggttctgaattcagcgatggcagcaggctttacgggtcgggttgtcgtggcgatgacgcatgatgaacgcttcacttattttgcccagcggttctccgggctgaataaacggcaggttgtcggattagggactttcggtgcgacgtggcgctttgaacaattcttagcggatcgactggctgtcccggccaaacaagtaacggcttatgtcgttggcaccagccaatcaccggtattgatctggagtcgggcctatgtcggggcaacgccaatattgcggttactaaatgatgaccaagccgtttttaccgaagcggcttcggctgttcatgcctttttggcaagcgccttgaccgttttggtgggtcggcttgtagaaccgattctggctgcgtttgctggcgaaaagctcattgggacattcgcacatctgcgagattctgacgatgaaaccggacaagttgacagctcaccgattttgttggacgaacgtggcgtggtcacactggcgacagttgcggggtccgatgatgaagaggcggctttgagcacagcaattcaagctgttcaagccgaaatcgaagcaatcgaacaaggagcagataaaaatgaaacctaattacagctatccactagaccttgactggacaactgacgaaaaaattaaagtgacgactttctttgcactcattgaagatgcgtatgagcatggcgtcgatcgggataacctgttggcagcctaccgtggattcaaacaggtggtgccagataaaggcactgaacgtcaactggatcgggagtttgaagcactgtccggctattccatgtatactgttgtacagatggcgcgccaaggtgtgagccaaaagattaaggtgaaggtgagttaagtatgacgcaagatccagaaaaactacggcagaccctgatcagctggtttgcggaaagtcgaaagcaaattttagcggaaatggcgaaaccattagatgtcgcgcgtaaaagtaatcgcaatgatttggtcaccaatgtcgataaagctaaccagcaatttctaattgatcacatcaaagccgagtatccgacagcacggattatcggcgaggaaggccatgcccatgatgatacggatctcaacggattggtcttttttgtcgatccgattgacggtacgatgaattttgtcaaacagcaggctcatttcgcgatcatgattggtgtttatcgtgacggacaaccggttgtcggggcaattatggacgtcatgcgtaatgaggtgcttagtggcggaccggaaatccctgttacgtttgcgggacgaacattgacaaaattaccggatttgcaactgaaagacgggttgttgggtgtgaccggtccaatgacgatcaagaatcggctacatttaggtgatattgcgttggcaagttccgggccgagaatgagtggcagtgctggcatggagtttatcgaaatcgcgttaggccgacaacttggctacgtttcatatttgcagccttgggatgtggcggccggcatggcgattacaaagggtctgggtgttcaattcagtcgcgaagatggttcaccgattgatctgcgtcaaccaggcgtcgttgtggctgccacaccgcaagcgcatcacacgattcttacaatgatggctggcaagtgatttcaagccacaataagtagcgctcacaaacgagcaacgatgaccggcgattaatggagacgccggtttttcgtctatttattagcctaacagcggttcttttacgaaaattcagctaaaatggctgcgtgaagcaattcacttttcagaaaatccagacagattgggtagagtgtgttataattcaaaatcgtataactgtgtcagttgctggcacttttttaatgtggtaagcggcctgtagtgccagcagaaaggaagtagaaacgtgaaaacacgtgacgatattcgcaatattgcgatcattgcccacgttgaccatggtaagacaactttggttaacgagatgcttaaacaatcggatacacttgatcaacacattcaattacaagatcgggcgatggataccaacgccattgaaaaggaacgtggtatcaccatcctgagtaaaaacacggcggtgaagtatggcgatacaacgatcaacattcttgataccccaggacatgccgactttggcggtgaagtagaacgggttatgaagatggttgacggggttttgctggttgtcgacgcctttgagggcccgatgccgcaaacgcgctttgttttgaagaaggcgcttgaacagcatttgacgccaatcgtagttatcaacaaggttgaccgtccgggtgctcgtccagaagaagtcgtcgacgaagtacttgaattgttcatcgaattaggtgccgatgatgcgcagttggaatttcctgtggtctatgcttccgccgttaacgggacttccagtatggattccgacctgtcaacgcaaaagcacacgatgaacccgctttttgataccattatcaaaacaattcctgcgccaatcgataatagtgacgaaccgttgcaattccaggtggccatgctggattataacgattatgtcggccgaatcggtattggccggattttccgcggcaagattaaaatcggcgacaatgttaccgttatgaaattggatggttcgcaaaagaacttccgcgtgacgaaattatttggtttcttcgggttaacccggactgaaatcaattccgccaaagccggtgatctgattgccgtttccgggatggatgacatctttgtcggtgaaaccgtgacggctgccgacacaccggaagcgttaccgattttgcggattgacgaaccgacgctgcaaatgatgtttgtggccaatgatagcccgtttgctggtcgcgaaggtaaaaatgtcaccgcgcgtaaattggaagaacgtttgaaatcccagctgcagactgatgtttcgttacgtgttgacgataccgatcaggccggtgcctggatggtttccggtcgtggggaactgcatctgtccattttggttgaagaaatgcggcgtgaaggtttcgagcttcaactcggccggccagaagttatctatcgcgatatcgatggcgtgatgatggaaccgtttgaaaacgtgcagatcgatacgccggaacaatataccggtacggttatcgatgcgatgagccaacgtaaaggcgaaatgcagaacatggaaaatgaaggcaacgggcaaactcgcctcactttcctggcaccttctcgtggcttaatcggctactcgactgaatttctatcttccactggcggttacgggatcatgaaccacacctttgaaaagtatgcgccggttatcaaaaactgggaacctggtcgtactcaaggcgctttggtttcgatcaacgccggtactgctaccacttatagcttgcagtcggttgaagatcgtgggcaattgttcatcaatgccggaaccgaagtttatgaaggcatgattgttggccaaaactcccgcgaaaatgacattgctgtcaatgtcaccaaggggaagaacctgactaatacacgtgctgccgggaaagaccacgcagctgcgatcaagacgccaaagaaaatgacgcttgaagaatccattgaattcttgaatgatgatgaatactgcgaagtaacgccaaagaacattcgcttgcgtaagaagatcctgaacacaggcgaacgtcaaaaggcagccaagcgtaagaagattgctgcatctaaatagtttattttctgaaaaccgccgattttggcggttttttctttgggcataaacaggcgcatgaggctgctcaaaaaggcaaatttgaaatgaccagcagcgagaccgacaaaccggctgtttacgaaccgtttcgttgtgctaagtcagtaggaatagctaccgattgtcaccctcagtttgcgtaaatttaagttaaaaccgtctaaacttagcgataagtgttttcaaagcgccttggcgggtgtagtcggtatgctataataaatccaatcattgcttgaaaggccgcgtttttcttgaggaaaaaattacgccatgtggattacttcattttggtaccctatctgattctgtgtgccatcgggatcgtgatggtctattccgctagcgcttattgggtgcagcggcaatatggtgctgcagaaactaaatacttattgcaacaaattgtttttgtggtgctcgggatcggaaccgtgttcttctttgacaatatggcccttaagattttgcgtaatcgctgggtgctatttgtcttgatgtcgggtttgtttgtcatgttggtgtacctaatcatacacggacgggcggttaacggggccgctgcatggatttccattggcagttttcgcttgcaaccgtctgaatttgccaaaatgattttgattttttatctggcgcatatgttgacgtcgcgcgaagatagctttcggcaggaaaatttccgcctgcgtcagatgtggcagccgctatttattgccggcatgatgatgttgctggttttcgtcgaaccggatactggcggtttcgccattctctttttgatcacgctggtggtggtgatgtctagcgggattccaatgcgctatggcttactttggctggttgcactgattgccacaggtattttggggtactacattgtgtcgcattatcacttcccgggtctggaacataactatgcttatcagcggctggttgccgcgattcatccttttgaaaaggcaaacgcggccggtaatcaggtggttaattcgctttatgccattaatcacggcggcttgtttggcgtcgggttggggatgagcagtcaaaaactggggtatctacctgagccttatactgatttcattttggctgtcattgccgaagaactgggcttagtcggcacagtggtcgtactgggcttactgtttttcctggtgatgcggttttatctgattggcattcgttccaaaaatacttatcacactctgattgcttacggcattgcgacgatgatgtttgtccaaacggttttcaatgtcggtgccgtcgccggtgtgttacctgttaccggggtcacgttgccgtttatcagttatggcggctcaagtatgattgttttgtcgatggcagtcgggattatgctcaatatcagttatcatagcgaacgtacgcaacgaaaggtagagaaaacgcatgcataaagttttagtcgcgaatcgtggcgaaatcgccattcggattttccgtgcctgtgaggagctgggcctcaagaccgttggcatttttgccaaggaagatgccttgtcgattcaccggttcaaagctcaagaaagttaccaagtaggcgcaggcaaggcacccattgccgcttatctggatatggatgatatcattcgcattgccaaacaaagcggggcggatgcgatccatcccggctatgggttgctttctgaaaacgcaacgtttgcccgtaaagttcgggctgcgggtttaacgtttgttggccctcgctcggagttgcttgatgtgtttggcgataaagtggcagcgaaagaagcagcccataaggccgggttggcgacgattccggggacaccggagccaacacgtgacttcagcgaaattcaggattttaccgcaacgcacggtttcccggtgatgcttaaagcagccagcggtggtggcggcaaagggatgcgtattgttcactccgaagctgagctggaagctgtgtatcaaaatgcggttaatgaagccaaggctagttttggtgatgatcgcatgtacgttgaaaagtacatcgcttcggctaaacacgtcgaagttcaggtgttaggcgatgagcacggacatcttttgcatctttttgaacgtgactgctcagtccagcgccgccagcaaaaagtcgttgaaattgcgccggcagttgctttgccggtcgctttgcgtgcgaagatctgccaaagtgccgtggacttgatggcaagtctgcattatgaaaacgccgggactgtagaatttctggttgacggcgatcagtattactttattgaagttaatccccgcgttcaggtggaacatacaattacggaactcatcacaggtgtcgatattgttcagtcgcaattgcggattgctgccggagcggatttgtttgccgatctgcacttgccgcagcaagatgagctgcgtgaaaatggcgctgcgattcagtgccggattacgaccgaagatccagaaaacaacttcatgccggataccggaaccatcaatacttatcgttctccgggtggctttggtattcggctggatgtcggcaatgcatacgccggcgccgtcgtcagcccttattttgactctttattggtaaaagctagcgttcatgcaccaaattttccggcagcagtggccaaaatgcagcgtgccttacacgaatttcaaattaccggtgttaaaaccaacgtcgctttcttagagcatctattggctactaaaaccttccggacaggtgaggcagagacagcattcattgacgcccatcccgaattgttgcaggtgcaagctaaaccggatctggcttcccggctgttatggtatatcggcgatgtgacgatcaacgggtttaaaggcgttgagcgccaaacgcaaaagtattatcctgagctacaatacgatagccattttccaacaaccaagccgcagactgatttagtggcactgcttaaagacaagggtgcaaatggcgttactgattgggtaaaagaccacaaatcgctgttgctgacggatacgacttttcgtgatgcccaccagagtttatttgctacccgcatgcggactcgcgatatgctgacggttgccaaggatatgggcaacggcttgcctaatctgttttcgatggaagtatggggtggtgcgacgtttgatgtggcgtaccggttcttgaatgaagatccgtgggtccgattgaaaaaactgcgcgcagcattaccgcatacgttgttacagatgctgtttcgtggcagtaatgccgttggttatcagaactaccctgacaatgtgattaaagctttcattcaacaagcggctgatgatggcgttgacgtttttcgaatatttgacagtctgaactggctgccgcaaatgacgctgagtattgatacggtcaaacaaaccggtaagcttgcggaagcaacgatgtgttacactggcgatattttaagcgatgcccatccaaaatatcaattggcttattatgtggcgctggccaagcaacttgttgacgccggcgcggatatgattgccattaaagatatggcgggattgcttaaaccacaagcggcttcagtcttgattggcgcgttaaaagacgctgtttcggtaccgattcatttgcatacccacgatacaaccggcaacggcattgctacttacttggcagcgacgcatgctggggtcgacattgttgatgttgcccaaagtagcttttcggggacgaccagtcagccaagtctggaaagtctttactatgctctgagtggcgatcagcgtcaacccgaagtggcgattgaaaaagcccagtcgttggatcgttattttcaggcaatccggccttactatgccgactttggcaacggcgtgaccgggccgctaaccgatatttacactgttcagatgccaggtggccagtacagcaatttgcaacagcaagctcgcagtatgggcattacagacttcgaagccgttaaagccatgtatgcgcaagtcaacactttgttcggcgatatcattaaggtaaccccgtcgtcaaaagtggtcggtgacatggcgctgtttatgctgcagaatcacttgacaccggaaatggtcaaggaccatggtgaacaatatgattttccggcatcagtggttgcctttttcaaaggcgatttaggtcaaccggttggcggttttcctaaagatttacagaaaaaaatcctcaaagggcaaaaaccgctgactgtcagaccgggccaactggctaagccggtcgatttcgccgctgttcggcaggacttgatcgcggcgggcgtggctgaaccaagcactgaagaagttttaagcgccattttatatccggatgttttcaaggcctttgttcgcaagcagaagcagatcggaccggtcaccaaacttgactcgccttcttatttccagggcatgcggattggcgaaaccgtttcggtgccaatcaaggctggtaaaacgctgattattcagttaaatgcgatcgggacggcggatgccagtggcatgaagacgctttatttcacggttgacgggcagaaacaggagatccagattcgcgatgcccaccaaaagagtgccggattgcagcatcagttggcagaaccgactgacaagaaccaaatcggcgcaccaatggccggcaaaattgtttcagtcgcaatcaaacaagggcagcaggttgcaaaaggcgatgctctgtttgtcatcgaagccatgaaaatggaaacaaccgtccacgcgccgtttgccggcaccgtcacccacttgtatgttgaggcaggcgcgttaattaaaagtcaggaactgttggccaagcttcagcccggtgccgccaagcagtgagtttagaaggtgaaagcatgttttcaatgaaacagcggcagggcctagttgtttgggtgtattcacttaagcaacttaagacgctgcggcgttacggcaccattatgtatgtttcgcggcgcatgaaatatgtttatttgtatatggatcgcgacgaaattacggcagcgagcaataaattaagtaagttgcggtttgtcaaacgtgtcgaaccgtcgcatcgtccggaattaaaaaccgagttcggcagcgatatcggtaaatccaaaccgacagaagaagatctggaaaccaaagcaaaacagcggcggcgcgaccggatgacaattgacaagccaaaaggggatcatcatgcgagtcattagcggggcctttcgcggcttgcggctgaacgcggttccgggtaaccagacgcgaccgacagccgataaagttaaagaatccatgtttaatatgctcggaccatattttgatggcggtcatgcccttgatttatatgcaggcaccggggcactgggaatcgaagcggtgtcacgcgggatgcacgatgccgtgttagtggatcgtcaatacgcggcgatcaaaacgatcaacgccaatgtggcactcaccaaacattccgaaaattttacggtcttaaagatgtcggttaacaaagcaattgaacattttactgccgcgggtcagtcgtttgatctcattttgatggatccgccttatgcgcaacaacatgtgatcgcccagttagctgcgtttgtcagtggtgatctcttggtacccggaggccgggtcttggttgaaaccggactggatgtcgtttatcctgaggtcattcccggatacaccaaactgcggcgccagacttatggcgtggcacaggttttgattttagagcgaaacgaggaagatcatgactaaaaaaatcgcagtatttcctggcagctttgatccgtttacgaatggtcatttggataccgttttgcgggctagtcgcttgtttgatgaagtggtcgtagcggcgatgacgaataccagcaagaaggcacttttctcaagtgatgaaaaattggcattgatcgcggttagtactgccgacttgccaaatgtcaaagcagtagcggcacctaggcgtttgacagttgaatttgccaaatcaattggtgcccagtttattattcgcggcattcgcaacgttgcggacttcggctatgaggctgatattgccacggtcaatcatgacttggacagtcagattgaaacagtctttttgctcgcggataagcaatacgacgccttgtccagtacgattatcaaggaagtcgcggcgtttggtggcgacattcatcggtttgtgccggcgccagttgaaaaagccttatacaagaaactaggtgagcctcatcaagccaattaatcggttaaaacagaaaaaacgctggcggtggctcattggtattttggttggcgttatcgtgctagctgcgcttcttttcttcccgaccaactattatctggaagtaccgggctcggcggagtcgttgaagccttatgttaaggtcaccggcagtaaagacaatgccaagggaagttacatgttaacgacggtgggcgtggtcggtcccgcctcacccgcgttattactgtttagcaaaacgcaggcccacaccgatattgtctccaagcaagatttaatgggcaatgacagtagcgccgaatatgatcaattgcaggcctattatatgaaaagtgctgccaataatgcggttgcagcagcgttcaaagctgccaagaaaccgtatcagattcaccatcgcggcatttatgtgatgtcgattttaccgcagtcacccttcaaggggaaattggctctcggtgacaccattaccaaattaaatggtaaatcatataaaactgccgacgcttatgtgaacgcaattaaatcgcaaaaagtgggcacggccattacgctgacgtatcaacatcaaggtaagaccaaacaggccacggcgaagttgattcgcttgccacagacaaagcgcgccggcattggcattacgctgaccgaaaacacagcagtcacgagtgatcctaaggttaagattgatgcggggaatatcggcggcccgagtgccggcaccatgtttgccttgcagatctatacgcagatcacccatcagaatttgcgccgcggacacgtgattgccggaaccggcaccatcgatccagctggtcacgttggccaaatcggcggcattgataagaaagtggtcgccgcggatgccaaggggtccaaagttttctttgctccgaatcagcctgccaccaaaaagttgaagcactatgatccaaattatgtcaacaactatacggaagcggtgcagacggctaagcaaattaagaccaagatgaaaatcgtaccggtcaagactttaagcgatgtgattcggtatatggaaaattattcgaaaaccgccaagtaacgtcatgattttaaaacgagaactgtcagtttggcagttcttttttaatggcttgcgtaatgtgttgtcgaggtgagaaaaatgacgacactgacgtattggctcaaaacatattggtacgcgcctttgattatcgtcattggcggcttctttttttggcaacaggctcaaggtagttcggctaaccaaccgctgtccgagagtgggcgtgctagcggcagttcgcaggtgatgatgtcccggtcttccggtagtgcaagcagtcgcagtcggccatcgcaaggatttgtgcatctcaaaggggcagtcttgcggcctggtatttatccggttagggaaaacacacggtgggacgaggtcgttaaagctgccggcggactgaccgccaatgccgatatgcaacaggttaatttagccaaaattgccagtgatcaggaaagcctgcatgtaccggaaaaaggggagacggttgctgcaccggtcgctacggcaacttccggggttgcttcaagcggcgaagcgaaggctcaagccgctggtggcggcggtgctgttgatctcaataaagcagatgcgacccagctgcaaacgattagcgggatcggaccgaaaaaagccgctgatattattaattatcgggatagtcatggcggtttcaaagagattgccgagctcaaggaagtgccgggaatcggcgataaaacgtttgaaactttggctccgcagtttacgctggggccatgagcggccggcttattttggtgacagttgctttacttgccggtatcatgggcggaatcgggttttggtgggtgacggggttattggtcatttggctgattattaaaacggatcgaacgatttctatttgtgttggtttgtttttcgtgattgggttgggacgcggcgttatggatgtccttcagtggcgccatccgccccagccacatggcagtatcgctattccggcttcggctattaaacttaaagaggggtatgttagttttatcggtcgggcggctaacggcgtcagtgtcagcggtcgtggtacggtctcccaagcggtcgccagcaaattggcaacgaatgaccagcccgtgcggctagagggtgcttacgaagtgacacgcctagctccggcgcgcaatcaatatgaatttgattatgcaacttacgcgtggcagagtcggcaacttgcttatgaattagttaaaccaaccttagatttttcgtttcagcaaaaacagcaactgcaggatgttattgacgggtggcgtgtcaagatctttgcttattttgcccagttgccgcctaaggtacgccaatatgccaagggactattgctaggacaaatggatgatgactttatgacccagcggcaggcgtttgtcgatttaggtgttttccaccttttttccatatccggattacatctgttcgcattagtcgccgcgctatactggtttgctgcccggcttcggatacctcagggcgttgttgatttggcgctgatgggcttgttgccgcttttattgctcttgttgccattgggggcaggcttgtggcgtgctgtctggatgcgactagccgggatcgttaatcgctatcttcagttaggctttaccggtctagatttatttggcatggtgctgatggtgaatttaatctggcagccgcgaattttaatgacgatgggtgggcagctgacttatttaatgaccggtttactcattagtttgccgaccatgcgtaaatggcaactgaattggcggttggttctggccggcatgccggttattgcctggcatacgtttagctttaatgtgctgacagtgatttttaattggttattgatgccaatttttgaattggcgattatgcccggtttggttgtggctttggcattgccacattcgggggtgacacgccttttcaatgatgccctccagctgttagaaaccgtgttgatcggactgagccgactgccgggacaaatgatcatcggtgcttttcctagttggttagctgttgccggtgtgcttgtgatggccattgttattactcggctgaagtggccactcgccattagctggtttttggttgtgctggcgtggtgctggtatcaaccgaattatcgggtcgtgatgtttgatgtggggcaaggggacgctattttaatcgaagcgccttttcgccgtggcgtgatgttgattgatactggcggacgaatctttggccaaaccagtcatccacctgttagccgagcaattgttccctacctgcatgcgcgcggatatgcgcgtttaaatacattggtcgtgacccatccgcatatggatcatctgggggatgccccgttactggcgcaactcatgccgatcagtcgcctaattacgacgccaaccgcgcagagccatcccatgattcgtaaggttcgacagcgggtgggaacgatgcaggttgttacggctgatcagcagcttcaggtgggcccgttacaatttcaggtgctctggccgacggtagatgcgcgccccaatccgcaagataagaacgccgattcgattgtgctctatggtaaaataggcaaaagtaactggttgtttaccggtgatgctgatcagacgattgaaaggtcacaagttttaccgcgccaacttaaggccgattttttaaaagcagggcatcacggttcaaaaacttccagtgatcccgcggttgttgcaagtttagatttaaaggcagcgttaatttctgcaggagttgccaatcgctatggtcacccgcatcgggagacacttgagacgtttgccaaggccggcgtgccagtggtaagcacgcatgagcaggggatgatatgggttgaatcaagcccctatcgccaagaagacgaattattcggttggttaaaaataaaggagtccaagtcacatgcaggtccgtgattttatcaaacatctaaaaaatggtgatcgtccgccactgacgcttattcttggcgaagaacaggcactgcgcgaacaggcccaacaagcaattgccaacatgattcccgaagatcaaaaggcaatgaattttggccgttacgatatgcatcagacacctgttggcgtggctttagacgacgctacttcgatgccgtttttcggggactatcgagaagtagtgattgacgcgccttactttttaaccggcgagaagagtacggataaaattgatcatgaccttgccggattacagacctattttgaaaatcctgtcccgtcaaccatgatggtattggtggcaccttacaaaaagttggatgaacgtaagcgactgacgaaagcactgaaaaagtcggcattgatcgttgatgcggcgccacttgatgaacacgctgcccgcatggcactggcgcaaattttcaagcaacataaagttagcattgaagctccggcactggacacacttgtgcagcgcacgaatggccaatattccatcatgatgggagaagtgcgcaaacttttgacctacgccagcgatggtagcccgctaactgttgcggcggtctcggcactcgtacccaagcaactcaatgaccgagtctttgatttggtaacggatgtgttacgcaaacatgcagcggatgctttggcattgtaccgggatctgcttgcccagcgagaagagccgattcggttgaatgccttgatgcttggccaatttcgtttattactgcaagttaagctgttggctcaaaaagggtatggccaggggaacattgccacaacgcttaaggcgcatccttatcgcgtcaagttggcgttgcgacaagttgatcgattgccttaccaacagctaacgcaggcttatagtggtttggttgataccgagacagctatgaaaaccggaaccattgataaggaattggcgtttgaactttttatgcttaaatatacgggacagtcatcggctgggcatcgtggtaatcagcgtcaatcagtacgttaaccgggcgatgagtggtcgctaaataccgcggcttgtttgttagggtaatggtcgtcatcagttggtcaaatacttggacatcaaaaaacagctaccacgtgtcgcaaaacacgcggtagctgttttaaattggcttaacgccttgattacttgttgagtagggctgaaagacggctcttatcgcggccggccttgttctttttgatgaggcccttgctgtttgccatgtcgatggcacgagttgctgccttgtaaagatcctgactgttgtcagcattttgttcggttgcactcttgaacttcttaacagcagtacgcattgcgttcaactgagcgatgttgcgttcgcgagcggcttcttgtgtcttaacacgcttgattgcagatttgatttgtggcatgagatgttcacctccaacagtggattatgataaaactgcataagtttcaacagacgctattatacagaagccaagcagccaatgcaataaaaacttgtaaaggaaaattgcttgatagctaaaatgacttgcaatcgccggtcaactccggtaaagttagacagtactttgaacccgatacttagttttgcgatccaccgacgctttactcagtttcaggcaatattcagaaaggtggtacacaacattggcaattgaccaaactcaaaagaacgaaatcattaagcaatatgcacgacatgatggtgacactggttcaccagaggttcagatcgcggttttgacagcagaaattctggcattaaacgatcacttgtccgttcacaagaaagatcatcacagctacgtcggcctgatgaagaaaatcggccatcgtcgtaacttgctggcttacctgcgtaacaaagatatcatccgctaccgtgacttaatcaagtcattaggcctgcgtcgttaagctattcaccaaaggtcgcctgttgaggcggccttttttggtgtgagcgtgaaccagcccggttagaaaccggagcataagcggcctcgaaccttaatggctgggctttgccattaaggttcgaggtccttatgtgcaggtttctgggctggtgaacgcgttatggtagtagcaagggaaagtgcggttttggccatttagccttgaggtccttacacgcaggctcctgcgtcagtgaacgcgttatagagagcagaagaagggtatcgtaccaggccttgaatagaacacttttccccgatggcagtttttgaccattgcgcccaagatcctcacacgcaggctcctgcacccataagcgcctgatatcatcttggatattcctaggtcaaaatgctataaccaacgtaacggctagacaaactacctaaggggatgggcgaatatgtatgaggagtaccgtcagcgctaccaaaatcaactattacgggtcaccgttttgggggtcactccaaacagtgcttgggtacttgcgggcataagcggcaaatgggcatttgttgccgtgactcgagatgagccggatcaagttatcacgtcccaaattgatccggcaattgtgcaattaatccggctgatcgctaaacgcttgctcggatttgacgtgaacacgtctatactgccaggctcgcttaaagcaatggtaacgtcgttttcatctgatgatgtcaaccggccacgcaagactttcccgttgactttaattcgcaaacctgctggcacatctctggacttttggtccttgggcgaagcggcgtttttaacggtgcctgatcaaaaaatacaaccagctgacttgcgcacttggttagttaatctgctgccgcatgctcacggtgtcgggtttggcccagtaaccgatcgcgcggctttggcagtcatggcgcttgatcatgggcaacaatttgctgctggcagttcgcctgaagttgccgtggttttagcgaatggccgcgaagtcgccgagtaccatttggatgccgcacaaactagcgatgccggttaccaggctgcacttgaaacggccaagcaaaatcaggcaactgtccgcaggttctttgccgacgaagtgtgaatggatggcagtacaagcaactaaaaacgaccattgaaaaaagaacgctactagtcacgttacatgcctgttcgaataaatccgtcttatgcagctcgctgacttgctaccagctcatcaaacgttgctaggccggcagtttagggaggcattttgcattcaaacatcattggatcaggtgccggcaatgtcggttctataggttttcaacgcttcgtgtgttacactggtagcagaatttattcggcggaagcatgttgcaacgcacggttgtcaacgatgcttccataatttaaccacgaggtgaaaccatgacgaagatcaatctggtcgctcttggtggggtacgtgaaaacggaaaaaacatgtacgccgtcgaagttgacgaccaaatttttgtatgcgattttggattgaaatatcctgataatgagttactgggaattgatgttgtcattcccgattttagctacttaaccgaaaatgctgaccgtattgccggtattttcctgagtcacgggcatgcagatgctgttggggcgctgccgtattttctggtagatcatccggttccggtttttggatcggaattgacgattgccatggccaaagtctttatgcagcatgacagtcaggccaagaaatttaaggattttcatgtcattgacgaaaagtccgtgatcgattttggcgatgtgtctgtgtcgttctttaagactacgcatagtattccgggttcattggggattgatattgaaaccagcgaaggccagattgtctacactggggactttaagtttgaccctagtgcgacgccgatgtatcaaacggactggtcacggctggcacaaattggcaacaagaaggttctcgcgttgctgtcagactcagccaatgcggaatcgccttatccgaatgccaatgagcatgaaatatacgaccatatcaaagaaacatttgaatatcaggatggccggattattgtggcaggggttgccagcaacattcagcggattcagcaagtcattaatgccgccgcatcactcggtcgccgggttgtcttgaccgggcgcgatgtcgaaaaggtggttaagacggctattcgcttaggctatatcaagctgcctaatgacgatattttagcaaaaaccaaggaattaaaggcgttagcgccagaaaaaaccgtcattcttgaaactggccggatgggcgaaccgatgaagtcgctgcaacgaatggcaacatcacgccaccgtctcatccacattcatgacggcgatctcgtcttcatcacgacaaccattgctcatgcgatggaaaccatggcagcgcggacaaaagatatgatttatcgcgctggtggtgacgttaaggttttgggcgatgatattcattcctccggccatgcttataagaacgatcttcaattgatgatcgacctgctgaagccggaatatctgataccggtgcaaggcgagtatcggctgttggcggcgcatgctgaaatcgcgcatgaagccggaatcccgttagcaaatatctttattgtcggcatgggggatattttacgctatgaaaaaggccagatgaatgcttccggtcatgtcaatgccggcaacaccatgatcgatggcattggcgttggcgacattggtaacatcgtcctgcgcgatcgtaaaatgcttgccgaagatggcatttttattgccgtcgtcacgattgaccgcaagaaaaagcgggttgtttccacgcctaaagtaaccagtcggggattcgtttatctgaaaaccagccgtgatttgcttgcagaaagtggcactttggtcacagaaacggttcaaaagaatctcgataacaaggagtttgattggactcatcttaaacaggatgttcgcgataagctcagccgcttcttgtttgagcaaaccaagcgacgtcccgtgattttaccggtgatcatggaagttaaccaaaatagtgccaagcgccaatagctaagtaaaaaaattcggaacgatatccggatttttttgtttagcttagagacaagtgattatcggcaagataggaggatcgtatggcaaagatggtatcattaccggataacgaaaatcgccactttgttattggtgagaaagctctgcaaaaaggcaactttgcctcggcagccgcacatcttgaaaaggcctatgaggtggaacagaattttgccactgcccggccattagcggccagtctgaacggacttaagcaatatcatgaaagtctcaatgtgatcctgccgcattacaagacatttttagaaaccgatgcagacactcaactggcactggatgcctggctgggtacattgaatttcgtcatggcgcggacgatgttgcgggagctggagccggagcggcggcaacattttctgaaacaaatcgaaaaggctgaagaagtggtcttaaagcagcgaggcgaacaaattgcagacttggtgagaaaactaagccatttgggcggcttttcacggcaagaacaacaagatctgttcagccagatcggacttctgccaaaagcaaagctgattgaagccgcggtacctgatctgacggacctgtcagtgccggttgccatgcgcgtctcgttgttagatttgctgacaaatgtcgggtatgatcagccggtgcagtatcaagcctacgatcggcaggagacactgattcccagtgaactaccgggaatggcggaggaaaaagcgggaccgcaaattctggcgcggcttcaggatgcactgggcgacgacgatcaggaattaggcaaggcgcttgtccagatggcgcgagtgcaagtcgcttttttgtatccggatatcgaacgtttgattccggatcaggcggcttttgtgcaggcgtatcttgatcatcatcagggaaaagcaaccaactttgacaaacttttcgcttggcaagcggccgaaacagcgaaattgtctgaataggcgaaatgacacgttttcactgtaaatgaaagaaacttgacgctatctgtttacaaagtgaaaatgaccatgtatactcattgctggaattcatttccagcgtagatatttgttttggtatttacgctcaaatgtagtacacttaaacgtaaaggattatcagggtacacaaacgtatcctgtattcttacgaaaaatacaggaggttcgttttttcatggctgaaaaagaacactatgaacgcacaaagccccacgtaaacattggtacgatcgggcacgttgaccacggtaaaacaacattgaccgcggctattaccaaagtattggcggagaaaggccttgccaaagcgcaggactatgcttcgattgatgctgcaccagaagaaaaagaacgtggcatcaccatcaacaccgcccacgttgaatatgaaacggaaaagcgccactatgcacatatcgatgcaccagggcatgctgactacgttaagaacatgatcaccggtgctgcgcagatggacggtgcgattctggtcgttgccgcaactgatggtccaatgccacaaacacgtgaacacattctgttggcacgtcaggttggtgttgattacatcgttgtattcctgaacaagactgacttggttgatgatccagaattgatcgacttggttgaaatggaagttcgggaactcctcagcgaatacgattatcctggtgatgatattcctgtcctccgtggttctgccttgaaagcacttgaaggcgataaggaacaggaaaaggttatcatggaattgatggataccatcgacgaatatattccaaccccagttcgtgaaaccgacaagccattcttgatgcctgtcgaagatgtcttcaccatcactggtcgtggtactgttgcttctggccgtatcgatcgtggtaccgttaaggtcggcgacgaagttgaaatcatcggcttgaagccagatgttctcaagtccaccgttacgggtcttgaaatgttccgtaagaccttggatcttggtgaagccggcgataacgttggtgttctgcttcgtgggatcaaccgtgaccaagttgaacgtggtcaggttctggcaaagccaggttccatccagttgcacaacaagttcaagggtgaagtttatatcctgacaaaagaagaaggtggccgtcatacgccattcttctccaactatcgtccacagttctacttccacaccaccgatgttaccggtgtgatcgaattgccagaaggcgttgaaatggttatgcctggcgataacgttactttcgaagttgacctgattgctccggttgctatcgaaaaaggtaccaagttcaccgttcgtgaaggcggtcgtactgttggcgccggcgttgtttccgaaattcttgactaatttctgaataaacgtttaaagtccgcaagcttgcttgtgggcttttttgtttgagcgtgaaccagcccggttagaaaccggagtgtaagcggccttggacgtgatggcgtttttggccattgcgcccaaggtccttacacgcaggctcctgcgccagtgagcgcgttatagaaagcgcacgtaagatacttaattgcctcaaacagaatagctccttttaacgtatctatggacgtgacgcccacaagccttcacacgcaaactcttacgctagcgaaaaaatgcctatttcaaacaaccaaaaaaatctcaagccgagtaagacttgagattttttaatacgattgattggctgccactgctcatagaggacgacttgctcaaatccccgaagttagtcagattacctttaggcagactgcttcgtttcgctaggctccgccaatgtgatctgcgttttttcaggttcgattttatcagcttccaaaatggttttaccgatagaatgtgcccgaatactgccactgcctggatttttgacactgataatatcggagcaaatatccgcatcaatattggtgctgtattcaaaaaccagatcggaatggagcagcgcgcagttcttcatggttaaatgatcgatataacacaatccctgattgctctcgatggtgcagttgatgagtgtcaggttcttggcattccagccgaggtaattgccgttgatggtggagtcgtaaatggtgacattttcagagttccaaaacgcatctttagccacaagtgtggaatgatgcatctcgacgtttttggcaccatcaaaggcgtaatcaccaatcaaattgagatggtcggcgacgatgttcgagctgttcatgccgaaatagttgccacttgcctgcacatggtcgaggctgatgtgatcgcagttccacaaactttcacttgcatcggaaaaatggacgttttttagacgaatatcctgactccggcgaaaagttttcggagcctggatctcactatccgaaaccgcgatgtcaaccgtataccagatgcctgatcgagccatggtttcaaaaatggtgttcgtcactgcaatgtgctggctgtaccacagaggatacttatattgaaaaattgattgatttaacttgatatggcggctttctttcagaggggactcgccttttccaaaagttgtaccaacgatggtggcatgttcctgaccgaataagggacgttcaccatgaaaaaattgattgttgtaattcaccatgataggttcgcttctttctttgtggttccagaaaatgatttgatgcatgcggcatttttcagaccgttaacacaatgatctgagacttttcaagctacgatgctactgagaatctcagcagctttaccagataaataaacagtgtttggctctgccaggttttccatagagactcgggatgcattgatgacgattttggggcaacccaaccgaaaacctgaggcggattgacgcgtgccaatgattaataataggtccgcttgtgctagcatttgctggccgtgccgaatttcgtctggataagttgccaagtgccttagaacgaaatccggtaaaataagtccgccacagttagggcaaatcgggagggcagcggtcggcgttttttgccagtcactggggcgatggcaaatcgtgcaatgattacgccggacatcaccccagtattccgcaatattgtgggttccggctttttgatgtagatagtcaacattcatcgtcacaacaccgagcagcttttttgcctgttcgagttgtactaacgctttatgggcattattgggacgtgcctgcggttggcaaaatgtctgccggtacatttggtaaaaagcatgtggatcggcgatcgcctctttcgggtcaagaaagcgaaagacattaccggcaaatttatgcgatctttttaagatttgatcaatcccatccaaatccgggattcccgattcagtcgagataccggcacccgtaaatgcaacgattcggtgatgttgacgaatcagcgctgctgcctgttgcaaacgttgcttttggctcatggcgctcatctggtttcgaaaacgcgccgcgcaacagttaagccattgagtacccgagggaagccgatatagggaatgcaatgaatcatagtttcgacaatttcggttttggtcaaaccaacgttgagcgcgccattgagatggacttgtagttgatcggcagtgtcaccttggataagcagcgcggtcagggtaatcatttcccgttgctttaaatccaacccgggacgattgtaaatgtcgctaaaagcaaactccaaaatatacttcccaacatcaggcgcaatatctgctagcgaatgcatgacgttggcagccgctgcaccatcaacttgagcaagcgtttcctgaccattttctaatcgtgttttttctgacatgttcataacctctttcatttaggatgtctttaccctaaatgctggagttaactccatgtcaatcatttttttaaattcttttctagcaattttgcttttagctgatgatacgtcgcaattttattttccaagaatgcaatatgggcatcaatttcctgtcgttgcgccgttaagcgggctttttgggtgaatagcaactccagacgctcgtcaatcgtgctattaccttgataacgtaaacgtgcatacgttttgatttccttaatgggcatgccggtagcctttaaccgcttgatgaaggcaatccagcgttggtcggcgtctgtgtaggttcggcgattattttgatcgcggtcgggaacaattaagtgttctttttcgtagtagcgtaacgtatcaattgacagtgaaaccatttttgaaaatttaccaatcgagtagcccatcagtgaagccttctttcatagatcatgttgggttgtatgatgagactttccgtaagattagtcaacacttatataaaagcctgagcattttaatcgcttaattaaaattattgttatatgataaagcttcggaaaaggggggcattcatttggcgaaatcaacaacttggcgaatgatcgcatttttctggcgccagctggcggatatgaaacgtaaattgttacgtatcattgtggcattagttggcgtagccgtggcttcgtatctggttccgcgaataacgcaatatgtcattgatcaggtgattccccaacgcgccatggggacgctgcttggcgcgattgccttggcgttattgctgacggcggtggccggcttgctaagcgggctcagcacttattggatcgggcaggtcagtttacatgcgattgcccgcatgcgtgatgacttgtttcggcacacgttaggcttggatatgcggtatttcgagacgagccagaccggtgatctgatggtggtgctcacgagcgacgtgaatacgctgcagcggctaatttcgagtaatacgctgggattatttggcagtctgctcagttttgtcgtggtgctggttctgatgatcgttcaggattggcaactgaccggactgattttgttgacctttccggttttatttgttctgaacaatattttcgtgcgcagcattcgggctgcttatcgtcaggtgcgggcaagctccgggatgatgaataatcaaattcagcaggctttaaccagcattggattgattaaaagttttacaaccgaggaaatgacagcaaccacgtttcaacacgccaatgcgcgcaaccgtgactatcagcttaaagcaaccaaactcagtgcaaccttttcgccgttaaccgacttcgttaactatttaggaacggcgattatcttgggctttggtgctattcaggtcatgcatggccagttcacggtcggcttgatcgttgcttataccgcttatcttggcattttacaggcgccgattcgtcagttgaccggactcattcaacaattgcaacaggcgacggtgtcatttgagcgaattgaggcattgcaggccgcttcaccgcaaatcgtgtcgccgccaaacgccgtgcgcttaccgcgatttcagaaacaaattcggtttgatcacgttgacttcagttacgatgaggatgtgccggtgttgcacgacatcaactttgccatcaataaagaagaagtggtagcgctagtgggttcttccggcgcagggaaaacgacgattacgaatttattggcgcggttttatgatcctactggcgggcgaattctgatggatggcatcgatttgcgccaggcggatctgatgagtttacgccaacagattgccatcgtttcgcaagatgtgattctgctcgatggcactattcaggagaatcttgaatatgggacgccatctgccagcgaggcggcgatttggcaggctgccgaagcggctaacattgccgattttatacgcagtttgccccaaggcttggcgactcaggtaggcgagcgcgggattcgattatctggcggccagaagcaacgaattgcaattgccagggtctttttgaaaaatgccccggttgtcatcctagatgaggcgacggcagctttggacaatgagtcggagcgttttgtacaagccagcttcgatcggttaatggccgaccggacgtcgttagtgattgcgcacaggctttcaaccgtgcgacacgctgataaaattcttgtgttagagcatggtcaaattgtggaagctggtaatcacgaacagttaatggcgcaaaacggtcgttacaaagaactttatgatttgcagttcaattagtcaggcaaaaccctgatactcaaatgttcacaccaccagtgagatcctcatgtaccagttttaaatgtgaaaaaaaacatctaatgtcgcctttttccggcacaacgtttacattcccactggtttcgggtatcatacattaagtatgcaatgtgaattgcgagactaattgtcggaggtacagcatgtctgcaaaatgggaaaaaaagggcaccaatgatggtgaactcacttttgaaatcgatttaccaaaaattcaacaaggtttagaccaggcgtttcaacgtgttcgtaagaacctgaccgttcctggattccgaaaaggcaaagtaagccgcacggtgttcaagcggatgtacggtgacgcggcattatatgaagacgcgttaaatattttgttaccggatgcgtatgaagcagcggttaaggaatccgggatcgatccagtcgaccagccgaagatcgatgttgagtcgatggacgaaggcaagccttgggttatcaaggcaaatgtcacggttaagcctgaagttaagcttggcgaatataaaggcgttgaagtgcctaagcaagatgttgaggtatctgacgacgatgttaacgctgaactggaaaagcgtcgcgaacaacaagccgaacttgtggtcaaggacgataaagcagccgaaaacggcgacacggttgtcattgactatgtcggcaccatcgatggcaaagaattcgatggcggctcgtccaagaactatagcttggaattaggatccaactcctttattcctggctttgaagaacagcttgtcggccacaagtccggcgatgaagtcacagtaaaagtgaccttcccggatgattacaaagccaccgatcttgctggcaaagccgcagaattcaaaacaacgattcatgaagtcaaggttaaggaattgccagagcttgatgatgactttgccaaggacctcgatgaggatgttgacacccttgatgaattgaagcaaaagatcaagaaggaactgactgatcagcgtaaggaagctgcaaagaatgcggtgcaggaagcggcaatcaagaaagcaaccgagaatgcgacgatcgaagaagtgcctagtgctatgatcgaacaagaagtgcataaccaaatggatcaatatcttggcaatatgcaacgtcaagggatcgacccgaagatgtactatcaactaaccggtacgaccgaagctgatttgcacaagcagtttgaggccgacgccgaaacccgtgttcgtaccaacttggttcttgaagcgattgtaaaagctgaagatattcagccaaccgaggatcaggttaaggaagaggttaagaatcttgcctctgaatacaacatggatgaaaaggctgttcgtcaggctttaagcgaagatatgctgaagcatgatatcggtgttaaagaagccattgatatcattacggataacgccaaagaagttgaaccagccaaggacgaagaagctgacaaggctgattctgatagtgaaaccgataaataggtgtcaatgtcgcgtcaaagagacgatccttgatcgtctcttttgtcgtcttgaggcacgcatctagcaagcatttttgttgacaaagccgaactgtgtcgttgctagtcggtacttgacggttctggtagaataaaggtaacaagaaagggttgaatcagatgtttgacaacgttgaaacaacgggtccggttacttgctctttttgcggcaagtcacaggatcaagtgaagaaaatcgttgctggccctggggtttatatttgtaatgaatgtattgacctctgcaaagagatcattgacgaagaatttaaagaagaagcctatcaaaatctgctagaagtaccgaagccaattgagatcatgaagacccttaacgactatgttatcggtcaggatgctgccaagaaggcgctctcggttgccgtttataaccactacaagcgggttaatcagatgcagacggcaacgaaagacgataccgaactccaaaagagcaacattgcgctgatcgggccaaccggttcagggaagacgttcctggcacagacattggccaagattctcaacgtgccgtttgccatcgcggatgcgacaacgttgaccgaagccggttatgtcggtgaagatgtcgagaacattttgcttaaattgttgcaaaatgccgattacgacgttgaacgggcagaaaaagggatcgtctacattgacgaaatcgataagatcgccaaaaaggccgagaacgtttcaattacccgggatgtctcaggtgaaggcgttcaacaggcacttctaaagattttggaaggtaccattgccaatgttccgccgcagggtgggcgtaagcatccccagcaggaattcattcaaatcgatacgaccaatatcctctttattgttggtggtgcttttgacggcattgaaagtatcgtgaagaatcgaatcggggagaagaccatcggctttggcacggactccaacaatcaggttgatccggataaatccttgatgcagcagattattccagaagacttgatgcagtttgggattattcctgaattcattggccgtatcccgattctggcagctttggagaaacttaacgagaatgacttggttcgcattttgacggaacctaagaatgcattggttaagcagtatcaaaaactgttgagtctggatgataccgatctggaattcacacctaacgcgctgaaggccattgctcatcaggcaattgtccgtgacaccggtgcgcgtggattgcggtcgatcatggaagccattatgcaggataccatgtttgatctgccaagccgcagcgatgtggataaggtggttgttaccaaggcagccgttgaaggcaaagctaagccacaattggttttaaccaagggccgcgaagcatcttaataatagataggcatgaggaagcatcaggtgcaacagcctggtgcttttttgcgtttgtagcgcatcacttagtggcacgcctgcttatctttatcctgccgatcggtgaggcgagtgcctgcaaagtatgctaaactattgaaggcaacggcgtatttgcgtcgattaaagtgataacaagaaaaggaggccattcaagatggacgtccatgatgtcaaactgacaatcagtgcagtggcagctgcgcaatatcctacagatggtcgtccggagattgcctttctcggacggagcaatgttggaaagtcttcactcattaatagactgatcaagcgcaaagccatggcgcgaacttctagcgtgcctgggaaaacccagacgcttaatttttatgaccttgatagtcggcttttttttgttgacgttcctggctatggctatgctaaggtcagtaaagcggcacgggcgaagtttgctgcgatgatcgagacgtacctgacaacacggcagccgctgcatggtgccgtgttgctggtggatagccggcatgatccgacagccgacgacatcagcatgtatcaatacttaaagtactatcaaattaaaacactggttgtggcgaccaaaatcgataaaacgcctaaaagcaaacggctgcatgtggttaagcaaattaccaaacgcatggacttgaaccaaacggatgtggtaattccgttttcggccgtgacaggtgaaggttatgatgccatttggtcgtggttggagcagacagcgggtgtggagggaagtttgaaatgaattttaatgagtatcaacaaaaagccaatcgcacattggctgggaacgaacatgttttgactaatttgtctttaggcttggcaagtgaaagcggtgaagccattgacttgattaaaaagtatactttccaaggtcaggatctggacaaagaagagctgaaacatgaattaggcgatgtgctgtggtacctttcacagattgctttatgggcagatattgattttgatgatgtcgcgaacgacaatattaagacgttggcaaagcggtatccgcaatcaaagaagtaatcttcatttagggttttcaatcaagtgtgcataaaaaaagattcaagcgccgagggtcagcgcttgaatcttttttgttgttcaccattttttacacagcgtactgaatcacaaagttaatcctttgcttttttctcgtcggttttatgggcttttttagccagtttctcttgatgtttcggatccggcccggttgcctgttccttatcgccaggcaaacttgcgaatttatcgaacatgtcgttcaggttggtttgagtgttgatcttaagtgccatgcacgccacccctttccttggtgaaagtatagcatcaacaatccgaagcgtctaggtccgcggctttagagcgtgagcaggcccagttagaaaccggagcgtaagtggcctcagacctaaatggctgggctttggccatttaggtctgaggtccttatgtgcaggtttctgggcctgcgaacgcgttttggcgcaagaaagccacaggccccagtctttgagtcccttgcacgcagactcctgccccagagaatgcatttagaaaaagagacgtggcttagttgatagtcgctaccgtatcagtcaaggatgccattatctaccaagtaaattgctgaaaatcaaattatgaatattagttgcataaaaatgaattttagcgtatagtacgttcttgtaatcaaggagggtattatgaatcatttgaaacgctggttagtcgctttgttcgcagtttttgccgcggttgtgaccttaaatatgcaaaccgttcacgctgatgacagtctggcaaagattcaacaaaaaggcacaattgtcatggggacaagccccgattatgcaccttatgagtttttggtgaataaacatggtaagaatcaggttgtcggcatggatgtcgaggttgctcgtaaaattgcgaaagatcttggcgtcaagctggtgattaagcagatgaattttagttcattgctggtcgccttgcagtcgggcaaggttgatatggtgcttgctgcgatgtcgccaaccaatgcccgccgtaagtcgattgacttttccaatacgtattataaatcgggccaggatattatcatcaacaaaaccgatgccaagatttataaggaccacaaaagcttcgccaataaaaaagtcggggtccaaaacggaagtcttcaagaaaccttagctaaaagccagatgaaatcaagcacgacgctgggattgacgaaggtgaccgatttgatcttggcgttgaagacgcataaagtggccggcgttgtggccgaaggggcggttgcacaggcgtatacgtccaatgacgattcacttgtcgaaatccccggacattttaatctctccagtgacacgatggggacggcgattgggtttgccaaaggatccgattcgctggtggcagcggtgaataaaagtctggcggagatcaaacagaaaaagctgattccgcaatatcttaaaaccgctggcagttacatgaagacgaataccgaggatacgagcatgttgcactactggacttatttccttaaaggggttgagtataccttactcatcagtgcaattggggcgttcttcggggtcttgctcggtacgatttttgccttattgcggttgagcaaacaccgcctgccacatctcatcggggttgcttacatcgaatttgttcgaggcacgccgttgatgattcaggtcatgtttgtctacttcgggatcgggattttcatcgacattccggcactagtcgccggacttatcgcggtatcgcttaattccgctgcgtatgtggccgagattatccgaagcgggatcgatagcattccggtcggccaaaccgaagcagcgcgttcgcttgggttatccgaacgtcaaacgatgacgagtgttgttttaccgcaagccatcaagaatatctggccggcgctggggaatgaatttatctcgctgattaaagaaagttccattgtctccatcattggggtcacggacctgatttatcagctgacagtggttcaaaccgctacgtacaaaggggttcaaccaattctggttgccatggtcctttactttgtcctgacattcgggttgtccaagctcctgagtcattttgaaaggaagatgaatcatgcagcataaacctttaattcaaatcaaccacctgaccaagaagtttggtgacaatgtggttttgaatgacattagcgaaacgatcaatcaaggtgatgtgattgttgtgatcggcgcatccggcggcgggaaaagtacctttttgcgtagcctgaatctgcttaatcggccgacacaaggcgagatcctgtttgaaggcaccaatttggttgatctcagcgaaaagcagcttgacaacgtccgggaaaaaatgggcatggtgttccaaagcttcaaccttttcccgaatatgacggttttggaaaatatcaagttggcgccgttaaaagtcaaaaccgtgacggatgaagaagcaaccaaaacggccaaggaacttctggagcaagttggcttgggtgaaaaagccgatgcctacccagccagtctttccggcggccaacagcagcgggtggccattgcccgggcgctggcgatgcatccggatgtcatgctattcgacgaaccgaccagtgcattggatcccgaaatggtcggcgaggtgctcaaggttatgcaggatcttgccaaaaccggcatgacgatggtggtggtgacccacgaaatgggctttgcccgcagcgtggctgaccaagtatggttcatggacggcggcaaaattcttgaaaaaggcacacctgaagaactgttcgaacaccccaaggaagctcggacacaggatttcctgtccaagattttggcgcaataagttttgcccagtcgaagttgagaagaaactccagttcacaatccaaaagcgaacatgctttgagtgttcgctttttgtgttcctgaaaataattcgttaagtcaatcaatctattagtgccaaagcggagcaatcgtaggccagatggggctcagccgtgcaaacaacacagcgaccgattttgtcgctgatgttgttaggcgactttaagacagcggttttctggctcaaagcgccgtctccgctctagcttcgcgtcgccagcaccatctggccggagattgcggagtttggcacggcaggagactcattgcctaagcttttctgaatcatttggagctctgcgagttaagaacaggtcactagaaatgtggctcaatctcatttgatgccaactgccaagatgtctttacaatcgcagctatgcgcagcaagtgcgtcgcttgcaatctaattttagaatctttataatgttaagcgaacatttgttttataaggagattacgatggcatcagcacacattgagcataaattatcgttgctgccggatctgcccggcagttaccagatgaaagatattaacgggaagattatttatgtcggtaaggccaaaaatctaaagaatcgcgttcgctcttacttcaagagctcacatgatggcaaagtagcagcgatggtggcacaggtggctgattttgactatattgtgacctcgacgaataaagaagcgtttttgcttgaaatcacgttgattcaaaagtaccagccgtattacaacatcaagctcaaaaaggggactggctatccttacatcaagattacgcacgagcgcgatccaaaaattgaaatcaccggcacgattcgcaaagatggcggctactacttcggtccgtatcccaatgtttatgcggcgcaggaaacgatgcactttattcaaaaagtgtacccattacgccggtgcaacgggtatcaaggacggccgtgtctgtattatcacatgggtcagtgtctgggcgcatgttttcgcactgtaccggaaaaagaatatgccgaccagattgctcggatcaaacgtttcctgaatggtaacgtcagcaaagccaaggccagtctgacggcaaaaatggagcgggcagccaaaaatctgcagttcgaacgggcggcggagattcgtgaccagttgtattacattgaacagaccgttgaaaagcaaaagattatttcgaatgacaataccacgcgtgatttgtttaatttctatatggacaaaggctggattagcatccaggtcttcttcattcgtcaggcgcggttgatgaagcgcgaatcgcggctttttccggtcgttaacacggcaaaagaagagttcgagtctttcattttgcagttttatagtcgcaaaaataatgtcaaaccgcatgaagttttggtgccggcagggctggataataaggtgcttgccgatatcttaggtgttccggtgcgtaccccgcaacgaggcgagaaacgtgatctgatggcattagccgcgaagaacagccaaatcaagctcgaagataagtttcgcttaatggaattggataatcgcacaacaatcggggctatgaaggaattgatggcggcgttaaagttaccaatgggccatgtggttgaagcttttgaccacagtcatattcaaggtgccgatccggtttctgcaatggttcaatttgttgacggacagccagccaagaacaactatcgcaaatataagttggatgctgacaaaactcataatggtgcggacgaagcggcgaatacgcgtgaggtcattcggcggcgatatacccggttgttaaaggaacatgcggcactgccggatttaattttgatggatggcggcgaaattgaaatgaatgctgccaaggacgttttagaaaatgaattgaaccttgatattccggttgccgggatggttaagaataacaagcacaaaaccgcagcgcttctgtttggcaatgctgatcaaatgattaatctggatccgaagtcacaagggttttacttgctagaacgcatccaggatgaggttcaccggtttgcaatttcttttcaccgtcaattgcatgccaagaattcactggcatcgcgcctggaaggtatcaagggtgttggtcccaagacccgcctgaagttgttgcgtaagtttaaaacaatcaccaaaatcaaagaagcgccgatcgaagacattcaggagctgggcatttccaaacgcgttgcgcaggcattgaagctttcgttaacggctgatccaacgccagcgcgccgggtttaagtcttactcagaaaaattggatacaaaaaaatcgcagcgatttgtttgtcgctgcgattttttatttgagcatcaattaatggtacaggttgaacctgcgctaaaacgaatcattgattctctttagccaccggacgccagaagccaagaattaacgcggcaatgacagtcccgatgatgagtgacatgacgaaccccagtttctgatttgttagcagcagggccacaatgccgccgtgcggtgccggaacattgacgtgccaaagctgggttaaaccgccggcaatcgcggagccaacaacggaactaccgataatatgcacgggatcggtcgcggcaaatgggatcgcaccttcagtaataaaggtcaacccaagtgcatagttggataagccggcattgcgttcctgcaacgtgaatttctttggaaagaaggtggaggcaaccgcaatggccaacggtggaatcatcccgccgatcatgacagcagccatccagcggccatctttaaagccagatgcctgataaaccccgatggcaaacgtgtaagccgccttgttgaacgggccgcccatatcgatactcatcatggcagccaaaatgacaccgatgagaatggcattaccggttcccataccttcaaggaagctgattaacgcaccgttgatcgcggcgaaaatcgggttgatgatgaagaacatcagcaggcccataatggccaaaccgatgacgggatacagcaggatggtgcgcatgccgtctagtgacttcggcattttggccaaggctttcttcagaccgacgatcatccagccggcagcaaacccggcaaccaaaccgcctaagaaaccagccggattctgggccttcacaactgaagcggaagcgaccgttgccatataaccaccaacgaacccaggcatcaaggccggtcgatcaccgatagattcagcgatatacgccgctagtactgggaccaggaagctaaaagcaaatgtccccagattattagtgaaggtgaaccacatggaagtcttacccagccattgttcaaggatgaatgagatcgccatgataatcccgccgccgacaacgaatggcagcatgttggaaacaccgttcatcaggtctttgtagattcgattccagagtccgccggaagtttcttcagtatcagaactttgcgtgttcgcaccgcttgcgtggaagacctgcccctgacctttaagggtttcttcgattaattcttcaggctttttgatgccatcgatgacaggccggttcagcaacttcttaccgttgaaccgatccatctcgacctttttatcagcagcaacgatgaccccggttgctcggttgatatcgctgtcggttaatttatgcttgatcccttcggagccgttggtttcgactttaatatcgacacccatcttctccgcagtttcttttaacgcagcctccgccatgtacgtgtgggcgatcccggtcgggcaggcagtgacagccacgataaatggtcgctctttacgcttttcttctttgaattcggcttgcttagcggcagcatctttagcttcctgtgctttttccgcttcagcctcttttttatctttagcaactttttcggcttgagccttgccgaataaatccagtacctcgtccggtgttttggcttgcttcaagtccgctaccagttttggattgattaaaagggaagatagggcagccagagcggcaagatgttcattgttggcgccttcaggggcggcaatcatgaagaataagtgtaccggctggccatcgagcgcgttaaagtcaacacccttggcactttttgcaaaaagcacggttgctcgagtaacggcactgtctttggcgtgaggcatcgcaatgccttcaccaatcccagtggtggactcagcttcacgttttaaaatatcctgacgatattcgtcggcatcggttacaatgccttctgcgtgatacttgtcgaccatttcattgatcacagcctctttggtggttcctttgagatccatgatcatgacattttttagtagtaagtcacgaatgtccattttgtcctcctaaacttcagtgatgctgatggtttgtttaacagcagcaattttatcggcagtggcaagatccttggaaaaggcagtcgcagaaccgcacgcgataccgaccttgaaactttccaaggcgtcatgggtttgggcaaacgttccggtaaagcctgccagcatactatcaccggcaccgaccgagttgacggccggctgctttggaactgtcccgagccaagcatgatcgcgttcaatcatcagggccccggcaccagccatcgaaatcaaaacgtgctgtgccccttgatccaataagcggcgaccagccttaataatggcatcattgtcggcatacggcttgtcgttgaataaggctgcgagttcatggtgattgggcttgacgaccagtggatgatccggaagcgtgtccagcagtgcctggccggtagtatcaataacaaaatcggcttgatgctcgtggatggccggaattaagtcacgataaaaagtggccggcagcccttgtggcaaactgccagacatcacgacgacatcgccggctgcgagtttggctagttttgctttaaagttggcaatttcatcattggtaatggttggcccgcttgcgttgagctcggtttccgattcagctttgagtttgacgttaattcgggtatcacctttgatcttcgtgaagtcacaaggcatcgcgatggcatcgagttgttgttgaataaaggtgccggtgaatccgccgagaaatccccaagcagttgtcggcaagccaagtgtctgaagaattcgactgacattaatgcctttaccgcctggcagcttaaccgcgtgagtcaaacgattgacagcaccgagatcaagctgtggtaattcgatgacatagtcaatcgaagggttgagcgtaactgaatagatcaagaatgaacctccttaatattttgaaaccggtggtaacctgctggtagtgcttgcagtgaactggttaagatcgtaacgtcgccgatatcggcaaatttaacgaaactgacctgttcgaatttacttggatccgcaagaatcatcggttgacgcgcttgatgaatcgccaagcgcttgatcacggcttcttccggatcaggtgtggtgttcccaaactcagggtgaataccattcgtgccgataaaggcgatatcgaaacgataatgatgaagtgcttctgcagtggtcgcgccaataagcgctttggttgctgatttaaccatgccaccaagcatcaatgtcggaatttgataatccgccagtaaagaggcattatcaacaccggtcgtgatcaccgtcaccccaaggtcagccagaaaagggatgagttgggctgtcgttgtcccggcatccaggaaaactagatcatcctgttcgacttggtgggctgcggcgcgagcaatagcttgtttggcgcgtaaattttgggtcgacttgctggccacatcgggttcgtcgccaaggccgttaattcgtttggcaccgccgtgaatccgtttaagttcgcccgctgcttcaagttcgtccaaatctcgccgaatggttgattctgacgcatccaaagccgccattaacgctttggatttgacgacagtatgctgttgtaactggctaagaatgtattgtcgccgttcttctgtaagcactttcgtttcacctcgctcttcattatactgatgaaacgttcaaaatcaacctaaagccgttaaaaacattcacaacggtcaaaaacaggcgtgtttcaagggactttgcacttttttcatttgttgtgcttaaagtacttgtcctactgtctgacgtggtaaaatgagaaagacatgcgatctgctatgcggatggcgggttaacgggtataattataaattatgttttttcagaaaggggatcgccaatgtttgtcgatcaggtacaagtagaagttcaggcgggcaaaggcggtgacggcatggtcgcgtttcggcgtgagaaattcgtgccgtttggcggcccggctggaggtgatggtggccgtggtggtagtatcattttatatgtcgatgaagggttgcgaaccttgatggacttcagataccaacgccacttcaaagcgccagctggtggcaatggccagggtaagtccatgtatgggcgggcagctgaagatcggcggattgccgtaccggcaggaaccacagtcaccgatgccgataccggcgaagtcctcggtgacctgacgaagccggggcaggaactgcttgttgccaaaggcggtcgtggcgggcgcggtaatattcattttgtgtcacccaaaaacactgcgccggaaattgccgaaaatggtgaacccggacaacatcgcttcattaaattggagttgaaagtcctcgctgatgtcggcctggttgggttcccgtcagtcggcaagtcaactttattgtcggtggtcacgcaggctaagcccaagattgccgcgtaccagtttacgacattagtgccaaaccttggcatggtccagctagacgacggcaccgattttgtcatggctgatctgccgggtttaattgaaggtgcctcacatggtgtcggccttggtatccagttcttgcggcacgtcgagcggacgcgggttctgttgcatctggttgaaatggatccggaaaacggccgcgagccgctggaagattatgaccagattcgtcgcgaactaggtgcttatgatgagaatatcttaaagcgaccggaattaattgttgcgacgaaaatggatctgccaggcgcagatgaaagatttgctgagtttaaagcagctttgctcaagcgtggcattgacccagccaatatttttgaaatttccagtctgacgcatcgcggggtcatgccgttaatgcatcgcaccgcgcaagtgctgaaaaccgcaccacaatttgaaccgaaacaggaaaccgttaaaaccgccgattacaagtttgctcccgaaccggccttgaaggtgacgcgggatagcgatggcacctttgttttaaccggtgaaaaagtggaacgcgcgtttaagatggcgaatcttgatcacgaagatggcgtcatgcggtttgcgcggcagttacggagtatgggtgttgacgatgcgctgcgcgaagcaggtgcgcaaagcggcgatttagttgcgattgatgattttacctttgaatttgttgaataatctccagtgaactagctgagagcagtaatctttttaaagaatggtggggcctcaattgaaacagacgcgtagacgaaagcgccggtatattcatggatttgacggtttacggacaattggtgtcattggtgttatcctgtatcatttgcgtcccgaattatttcggggtggttacctaggtgtcccgatcttcatggttgtgtccggttatttaattacggatggcttattgatcgagtttaatcgcaatgggcgaattgattttaagagttttttcattcggcgatttaaacgtctttatccggcactcattaccgttttgtttggaactgcagcttatatcacgcttttttcgcaaaatctcctgcacaatctgcatatgatggtgttgaccaatttactttatgtctataattggtggcagattttgaacggtcagtcttattttgcgcgctatgctaacggcgaatcacctttcacgcatttgtggacgctttcaatcgaagggcagtattatctggtatggccatttttggttttaggcttgctgctattagttaaaaaccggcatcagattgccaatattgtcttgattttggcggcagccagcggcgcgtggatggccatcttatatatgatgaccgttgcgcacacgtcacctgctgcctttgatccgagccgattgtactatggtaccgacacacgggcgttttcgattttgctcggtgccgccttagcgttcatttggccaagcggtcggctttcggagcatttaccgcgaaagtgggtggttagtctcgatttaatgggaacggtgagcttcgttggtttattagccatggtcttcacggttgacgcccaaagcagctttctttatgaaggcggcatggtgctgttctccattttgacgacgattctggttgcggttgttgcccatccggcggcgcattttgatcgcctgctgagtaatccattgtttagctatatcggtagtcgcagttatggcttgtacctttaccaatttccagtcatgattttctgggagaatcgtttccgcaacattgccgatcatccggttttgtatccggtgattgaagtcgtcttaatcgtggcgatctccgaggcttcgtatcggtggattgagcagccagcggcgcattttgactatcataaaacctgggcgtttatcaaggggttggccgatccgaagaaacgtatgggcaaggcgcgttggatcagctatgcagcgttggtcattctggcgattggcagtgttggtttagccaaggcaccatcagctaaggcggttggcgacgactcgccgctggccaaacaacttaagaaacgcgcggaatcgcctaaggaaaaggccaagcgtctggaagccatgcgttctagcttagccgaagagcgtaaagaagccaaaaataaaactgaacaaaaatcgcgatcccgtgcacaggagtcgaagtatgcttcgcaagccaaggcccatccggttaaccaagagtatgaacaatatggcttaacccaaatcgaattgcaacgggcccaggatctgggattaaccgcgattggcgactcagtcatgcttgacggacaagagggcctacagaagattttccctaaagcagtgattgatgcggctgtatctcggcaaatgatcaatagtattgatctggttcgcagttatgcggaaaaaggcgtgttagcgaacgttgtgttaatcggtttaggcaccaacggcccattttccgacgaacagcttgctcagatgatgcaggcgattggtccggatcggcaagtcttctggattaatgtgcgggtgccaacgcgggcatggcaaaatgatgtcaatggcaggttggacgctgcgcaaaagcaatataagaatctgacggtgattgactggttccgtaaatctgatggacatcctgattggttctacaaggatatggtgcacatgaatccaacaggtaacccgcagtatgcggcgtttattgccaagaccattttggataaaaccaaacagtcagctgattaacattttattgaagctggcgtcaactaaactgagttccggtaagaggttggaaagccaatcgttcttatcggaactttcttttgcctgtgcgccgctttgccaaagctaagcagcgttatccgcgatcaaacaaggataattctgcaggacttgtggtagactacaaagtgaagtttgacagaataggaagtatggtatggaaattcaatttttgggtacaggcgccggttcgccttccaaagttcgcaatgtcagcagtctggctttaaagctgcttgacgaacgcaatgaggtttggctatttgatgttggcgaaggcacccagcatcagattctgcagaccacgattaaaccgcgaaagattgccaaggtgttcatcacccatttgcatggcgaccacattttcgggttaccggggtttttggcgagtcgcgctaaccaaggcggcactgatccgctcacgatttacgggccgcctggcattgaggattttgttagaaccagtctgaaggtttcccagagtcatttgagttatgccttaaagtttgtgttgctgcggcatccgggaacggtttttgaagatcagacctttaaagtcagtttcgaccgacttgaccatcgcatcaccagttttgggtttcgggttgaggaaaagccacatccgggtgagttgctgattgataaggtccgggcctctaaaattccgtctggaccggtttatgccgagttaaaggcaggtaaacaggtgacgttgcccgatggccggacgtttgacggtaatgattttatcgggccagcacaaccgggccggattgtgactatttttggcgacaccagaaaatgcagtcgcgcgttgccactagcagctggtgcagatgttctggttcacgagagtacttttggcccggacgaaagccagttagccaaacagtactatcattcaaccaatattcaggctgccgagttagccaagcgcgccggtgtcggcaagttgttgctgaatcacatttctgcgcggtatcttggccccggcgttgcgatgttagaaaaaagtgcccagcgtatttttcccaatacccacgtggtgaaggattttgaagaagttaatattccgtttgccagtccccagttgacgtcggcgggatccgttcaataaccggttttgtcagcaagcgacaatggtgattggctgaaaagcagtgcaagcttgaagtgacagtggcttaagcgtgattggaacagcaaagcgtacaaggagggagcagcatcgtgaaacaacacctaacagtagttatttctggcggatcagccggattgggtaaagcaattgggttggaagccgccaaaaaaggggcaacggtggttttcctagcccgtagacgtgacaagttgcgtcaggctcaagcagaggcaagttcactttctggtcggccagcgtttgcttttccggttgatgtggctgatcctgtcgctattgaagccgtcgttgagcgcattcatgccaccgtcggatctgtcgatgtgttagtcaacgcagccggttttggtcattttgagaatgcatttgacacggatatgcacttggttgaacgcatgtttcgcgtgaatgttttgggaaccatgtacttaaccaagctgctgggacgcgacatggcgattcgtggtcagggacacatcatcaatgtctcatcgatggctggtaaaattgccacacccaagtcagctatttattcggcgacaaagtttgcagtggtgggttatagtaacggactgcgactggaattgaagccatttggggtcaatgtgacaaccgttaacccgggaccgattgcaaccgacttcttcaaatcggccggcgcattggactacttggccagcgtttcttggctggtattggatcccgataaactggcgcggcgaattgttgcaacatttaaccatccggtacgggaaatcaatacacctcggttgatgaatctgggtgctgacctgtatactttatttccacatatcggcgattggttagcaggcggtttgctgaacaaaaaataaaggggtggcttgaatgaagggtcaacagcgatttattatcggattggtacttgcattaattttaattatttttgcgttgctaaatggtcaaggcgtttcggttaacttttttgggattcagttggagtggccattgatcgtgatcattgcggtttctgtgttaatcggcgcggtggtcacttggctcatttcaaccagtgccgttgccaatgccaaaaaacagattcgtgaattgcagcagcgcatcactgaattgacgaaggcaaacaaagccgaaaagccagcacctaaaccggttcaggcacctaaggaagagccagttgattcaacgaaaaaataacgacaaaacgcggatgatgcgattcgcgttttttattcgataatgtttgacctttactgaccaatatcgtaaagtggatttgaaaacaataaacagttaatgaacggttatggagggatacgtggatgaatccagataattttacccaagcagttgccgaggctttaggcgctgcgcagcaaattgcccaagtgcggcatcatcaagaaattgacattccgcatgtcatgaaaagtctagtccaacctaatcagttggctgagcagatttatcgtgaagccggcgtgaatgttcaaggactgaatgcagccattgatgcggcccttgaagctgagccagtcgtggaaggcgccagtacttatggccagagtatgtcccaaaacctggcccaattactgacagacgccaacaccgttaaagatgagttcggtgacacttacatttcaaccgaggcactgttacttgcgctttatcagcaacgctataacacgattacccagtacttactcaacgatgctaaagtcgatgccaaaaagttgcgtcaggtgatcgataagatccgtggcggggaaaaagtgactagcaagaatgccgaagccaactacaagagtctggagaaatacggtactgacctcgtcaaagaggctcgtagcggaaaaatggacccgatcatcggtagggatgaggaaatccgcgatgtgatccgaatcctgagtcgtaaaaccaagaacaatccggttttgattggcgaaccgggggtcgggaaaaccgcgatcgttgagggcttggcccaacggattgttaaaaacgatgtgccggacaatttaaaaaataaaacgattatttccttggatatgggcagtctggtagcaggtgccaaataccgtggggaattcgaagaacggttaaagtcggttttgaaagaagtcaaaaaaagtgaaggtcaaatcattctttttattgacgaaattcataacattgtcggtgccggtcgcgctgagggttccatggatgctggcaacttgcttaagccgatgctggcgcgtggtgagttgcatctgatcggggctacaacgcttgatgagtatcgcgaaaacattgaaaaagacaaagccttggagcggcgttttcagcgggttctggtacaggaaccaagcgtcgaagacacgatcagcattctgcgcggcttgaaggaacgatttgaaattttccacaaggtacgaattcatgactcggcgctcgtggcagccgcaaccttgtcgaaccggtatatcacggatcggttcttaccggataaggcgatcgatttagtcgacgaagcgtgcgcaacgatcaatgtcgaaatgaactcccgcccaaccgaactggacgttgctgaacgcaaacagatgcaattggaaatcgaacagcaggcgttgaagaatgaaagtgatccggcaagtaagaagcgcctagagaacgctgatgccgaactggctaacttgaaggaaaaaaccaataagttaaaggcgcagtgggaagcagaaaagaaagatatccggcagctcaacgagaaaaagtcggcgattgacaaggctaagcatgaactagaagatgcccaaagccgttatgatctagaaaccgcggcccgcctacaacacggcacgatcccccaacttgaaaaagagttgcaagctatggaaaacaacgatcggccccagtcctggttagtgcaggaaagtgtgactgaaaatgaaattgcggcagtgatttcaagggaaaccggcattccaattgctaaactggttgaaggtgatcgccaaaagttgctgcatctggcagataatttacacaaacgcgttattggccagaatgaagcagtcaccgcagtttccgatgcggttttgcgttcgcgtgccgggttacaagacccaagccgtccgctgggcagtttccttttcctggggcccacaggtgtcgggaagaccgaacttgccaaagcgttggctgaggatttatttgattcggaaaagcacatggtccgcattgatatgtcagagtatatggaaaaagccagtgtttcaaggttggttggtgccgcgccgggttatgtcggctatgaacaaggcgggcaattgacagaagcggtccggcgtaatccatatacgattgtgttgctggacgaaatcgaaaaagccaatccggatgttttcaatatcttattgcaggtgttagatgacggacgcttaacggatgggcaaggccggacggttgattttaagaacacgattatcattatgacctcgaatctgggttcggagtaccttttggatggggttcaggctgatggcaccgtcagtcagcaggcaaaggatcaagtacgtcaattggtcaacaaggccttcaaaccggaatttttgaaccgaattgatgacattatcatgttccatccactctcactggatgatgttaaacaaattgccgttaaagatttgcatcagttgggaacccggttggccgatcagcagatcactttggatattacgccagaagcccagacctggctggcagacaagggctacgatccggcatttggcgctcggccgctgcaacgtttgattaccagcgccgttgaaacaccattggccaaagagctcattcgcggcaccattgaacccggtcaggaagtcgtgatcactgttgtcgacgatcagttgcaatttaaagcaaagcaggtcgcagccaaggcgtaagcttgtaacaactgaattattctgtaaagacaaacaactgaattattctgtaaagacccttgccttgacgccgcttttcatgtatgattagcgttgctgtgacagaacaagtttctgtccacgcgtgatgatgatcggacttgcattttgatcatcgaccgtataaagtagtttagaaatcttactaaaaaaggggttttccgctcatggcagttccagcacgcagaacgtcaaagaccaagaagcgtatgcgccgcggtcacattaagttgaatgtgcctaacttgcaattcgatgcagcaaccggcgaataccgcgtttcccaccacgtttcacctaagggttattacaagggtgcacaagtggtcaagaagtctgacgataacgcaaatgcataacaaaaagccaacacacatcatcggtgttggcttttttgttgagcgcgaaccggcgcggttggaagccggagcataagtgacctcgccctaaatggctggtctttggccatttaggtgcgaggtccttatgtgcaggcttctgcgccggtgagcgcgttatagaaagcgaaagtcgacgacacatttgcccacaatagaacattgcttcccgttaacgttattttggccatttaggtctgaggcccttacacacaggcttctgcgccggtgatcgcgtaaccaaacgcaagaaccgaaaaaacacatgcatagatagcaccctataaataatcagatctttagaaattaaataaatacaggacaaatagcatagtagatattcaactattgaaccagtgaacatttggttatcaaaactaactgtcatgatataatgtagctaaaacgaggtgcaatatggctgataacaaaaaatttgctgactacctgcgacaacttcaagaagcacagtttccgcgctgggccgatttaccccaatttgatctttacatggatcaggttattcaatatgtgaatgacattgtatcaccgcttggttttggtgagatcacatcgaccatggtgaacaattatgtcaaaaaaggggtgattaaggcgccaatcaagaaaaaatatcgcccagaacaattggcgaatattttagtgattgcgatgttgaaaccggtttttgcattggacatgattgccaaggggatccgctttgccaaagaaggtcggccagtcgctcaagcgtatgacacctttatccttacatttgtcagtgccattgagcaggcaaactcagattttaatgatgccttgaccattaaccgggttaataaaccagacaccacggcgactcagcatgcagtggtgacattagcgattaatgcggttttgcaaaagctcatggttgaaaaaatgctggaacttgaagaagaaccggcgccgaaggaagggaaaaaggcatgaaactcacgatattgtcaaccagcgatacccatggttttgttctgccgactaattatgttaaacgccagcaggacctgcctttctcccttaccaaagccaaaacgattttggatgcgcaaaaagctgctgccccaggtccggttttgacgattgaaaatggcgattggctgcaaggctcgccattagcgtattatgtcgccaagattagtcgccagccggagcagcttacacaaatttacaacgcggttggttatgatgcgggcatcatcggcaaccatgagtttaactatggtgccgactatttacggcaagcgttggcaacgctgaattatccaacgttgaatgcgaatattacccgtgatggtaaacccacttttggtgctccttatcaaatttttgaacgggacggggtcaaaattgctgttcttggcttgacaacttcctatatcccgcactgggaggcacctaaaaatattgccgggcttcaatttcaggatgtaatcacgacggcgaagtattatgtgccgcgtttacgacagcaggcagatgttgtcattgtggcctatcatggcggttttgagcgggatttaagaaccgggcagcctaccgaacgcttaactggtgaaaatgtgggttatgcgttgacgcagattcctggaatcgatgcgttgattacgggccatcaacatcgccagttggccgcaactgttaacggcgttccgattacgcaaccaggctatcgcggcgaagcagtcggtaaaatcactttaaccctgaccccaactgcaactggttatcaggtgaccgatagcaaagcggttttggttaaagccggtgcttcggctgccagcgaagccattgtggacgttgccaagccgctcaatcaagttgtcgagacttggcttgatcagccattggcaaaagtccaaggtgacatgcggattcgggatccgtttgcggcgcgggtgcatgaaaccccttatatcgagtttattcagcgagtacaaatggccagtaccggcgccgacatttccggcaccgccttgtttaataacgaaggccgcggttttggtgcgaccattacgatgcgcgatgtcgtgaccaactatatctatcctaatacactggctgtcttgcgcttgacgggtgcggatcttaaagccgcattagaacaatgtgcgacctacttttcattgactgctgatggtcagttgacagtgacaccgcgattcgagcgtcctaagccgcaacattataattatgatatgtatcagggcatcgattatacgttggatattcgccagccagtcggtcaacgcgtgaccaaactgacgtaccatgggcaaccagtgatagcagcgcaaacttatgatgttgccgtcaaccaataccgggcagccggtggtggtaattttgctatgtttggaccggaaaagattattcgcgaaaatcaaaaagatatgaccgaattgattgctgattatttgaaggttcatccgactttagaagcagtggcagatcataatttcaccgtcttgccgtcaatgtgacactgagtcatattttgcttgtcaagtgcccagtgaacgcttatgctgatggacgtcattaattgagatcaagtgaagggaatgttccgtcatgaagttttggaaatacggtctgattggtctattggcattattgctggtaggctgcggacagcaattaagcaccacaaaaacaacttacggccgtgatgggctagttgcaacggtcaagggcaatgccagtggcgtcaaacgcgtcagttacaccagtgacgctggcaaaggaagcgtgccggttaacagtggcacgtttgtcatcgatgtaccgatcaccgataaggcacagaaggttaacctcaaggcgggttcactcaaaactaatgttactgttaaagcaggcaagtcattggggaattacgccgatattgcaactaaattcaatcagatgctggcagtatcgagtctttcaaaagctgatcaagctaaactgaaacaagggcaggcagcagcggctgcgctccaaaaaaatgcggctggcatgacccctgcagaaaaaatggcagctgcacaacaggcacaggcacttaaaacgctgatggctcaggcaacggccaatacaaaggcaaatcaattgcctacaacggccaaaactggcattcagtccatcttaaaaaccgctgatatcaattatcgcgcgagtgttgcgcatggcaaggcaatgggctttgctgttattgtgccgttagcggttctcaaggacagcaagaagatgcaggccttcgcaactgatttcgggctcctcagtacggcggtcggtgccaatgccaaaaccgttttctctcacttcaagaaactgacaaaagatgccaaatctaagaacaacgccacaacgattagtacgattaagagcaacggtgtgcattttgacgttggctattcaaccaccgctttgtacctttacgtcacaaagtagttcaaccaaaattgttgaatggctggttccacgcgcactgatcatgtagtttggggcccaactgaacatcgaaatttagagatcatgaaaatagcacctgagggcagccaatacgaaggccgtctccaggtgcttttttgggatactgatctgtcaagcgtgttcaattggcacgttgtagtttaatgttctggttttcctgctgacttggcaaagtgctgcataaccggcgggaagaaaaataaaatcacgatgaaaataacactaacgatcgcgcttgttttaggatcgtaactgctgccgctcaaggcgccgaccaggaagccgacaacttggccgaggatcaggccccagacgatggtaggtagataccgcatgaaatccctcttttctgtcgtcatcttaccacgactcttgatgaaatcaactgaaattgtgacaattttcagtataataggggtgaggtggcaagatgacgtttacccaattacaggttcatagcaattataccctattacacagcccattggcactgcctgatttgattcaggcagccaaaacaaggggttacacggccattgccttaaccgacaccaatgtggtttacggtctggtcgagttttatcgccaggcaaaagctgcagggctaaagccgttgctaggcatgcagattgatattgacgatgcccgcttgttagtcattgccgaaaacaatacgggctatcaccaactcttgaaattatcgacgcaaatcatgctggcgaagacaccggttaagtttgctgatttattaccgctgactgggttggccgccattgcgctgccggattcgccatttgcggaggctgttacgacgcatcacgatgagcaggcaatggcgtttttaacggctttaaaagccaagcagccggcgtcggtttatgtcggtgtggatgaggcgcatcttgacagtgctattccggcgtttatcgcagcgcaccagcttgaaccgctggcattgggcaatgttctttatcgtgacccaaccgatgcctttacgcaaaaagtcatggttgccattgatgaaggcagccaattaaactttcgtgatccggttttaaccgatgccggtgaagcttggttaaaaccgccaacagacgctgctgcaccgtttgcagcggctgggctacagacagcggtggatcataccgctgacattgctgcccgtgccgatgtcaccattgactttaaacagcctcagctgccgcattaccagacgccggatcagataccgtcgaaagattatttgaccaaactggctaaatccggtcttgacgctcgttttcatggccagccgattccagaagcctaccagaaacgtttgcaatatgagctgcatgtcattatcgaaatgggctttgccgattattttctggtggtttgggatgtgatgaattatgcgcacaaggtgaacatcatgaccggcgccggacgtggctcggcggctggctcgttagtgagttatgcgctggccattaccgaagtcgatccgattgaatataatctgctgttcgaacgatttttgaatccggcacgggcgcagatgccggatattgatctggatattccagacaaccgccgcggcgagttaattcagtatgtgcacgacaagtatggcgagaatcacatggctcagatcattacttttggaacattcggggccaagcaggcgattcgtgatgttgcgcgggtatttggcttaagtcagtttgaaagtaacacatggagtaaggcaatccctaatttgtttcacattgatttgaagacagcttatgagcaaagccagccgctcaagaatttggttgccgactcacccaaaaaccggatgctttttcagaccgcactggctttagaagggctgccgcggcattactccacgcatgcggcgggtatcgtgctgtcagaagagccattaaccgataccgtggccttgcagcccagtggtgacggactcgaacaaacccaggtccccaaggatgacgttgaagcgttaggcttgttgaaaatggattttctgggactgaagaaccttaacattttggctgctgccagccattttgtggcgcgggataccggcaagccgtttgatcccaagaccattccgctggacgacaaaccgacgttaaacttgtttgcgcgaggcgataccaatggggttttccagttcgagtcgtctggcatcaaaaatgtcttgcgaaaattgcacccgactgcatttgaagacgtcgttgcggttaatgccttgtatcgacccgggccaatggaaaacatcgacactttcattgctcgcaaaaacggccaggagccgatcgcttacccagatccggcgctgaccgaaatcctcaagccgacctatggcgtgctcgtttatcaggagcaggtcatgcaggttgccaacgttatgggcggcttcagtcttggcgaagcggacttgttacgacgagcgatgagcaagaaaaagtccgcagtgctggcggcagagcaggacaagtttatcgaaggtgccgttaagcaaggctttcctgaagaaacagccaaaaccgtttacgcctacattgatcggtttgcaaattatggcttcaaccgttcacatgctgttgcgtatagtaaggttgccttttggctggcttatttaaaagttcattatccggcagcgttttttgccgccttgatgaatgccagcatgaacaatctgccaaaactgcgtacctacgttcaagaagccaaggcccggaaagtcggtttgctaggccctgatattaatgccagcaatggcggttttaaattaagccaaggaaaaattcgttttggcctgttgtccgtcaaagggatgcgccgcgactttagcgaagccatttttaccgcccgtcaaaatggcccgtttaaaaacttacgcgatcttttacaacgattggatcccaagtggttaaaagctgacaactttaaatcattgattcttgccggggcatttgatacgtttgatgcgaatcgggcgcaaacgctagccaatctggacgagttgattaattctgttaaattggcaggcaacgacgtcgggctcttttcgatgttggcgcctaaaacaatcaaagtgccggaaatgtccgccagtgagcggcttgaagccgaagcggaggttcttggggtttatctatccggacatccggttgataaatatgcgccgttgaaaacccaatataccttggtgagcgtcagcgatctggaggaagggcagacggtgaacattttgctgctggtgcggcatatcaaacgaattcggacgaaaacaggtaaaccgatggcctttgtggacggccaggatgcaaccggcaatgtgtcactgacagtttttccgaacctgtatccgacgatcgaagacttaaccacggatatggtggtattcgtgaacgggcgcgtggaaaagcgtcatgatgatttgcagctggtggtaaatcggattcaggatgcacaaccgttattagctagcctgccaagtgccgaattattcattcggctggacgcgaaggatacagctttgcgaaccgatttactgaaaaaattgcaagccgctcatggaacaacacctgttatcactgtggacactgctactcgtgaaagtattttgttagacaagcgttactgggtcaaggctgatacaacattggtagaagccctgaagtcacagttcggcgccaacaatgtggtcctaagaacgcggcaggagtcctagagaaaattgaaaaatgttctcattttcaaggactttgtttcagaaaagtggtaaactcaatgagtatttgtggtaggacatatcgcaaaagaatatgcatgaggtgaaataatgaaacgcattggtattttgaccagtggcggcgatgcaccaggcatgaacgctgcggtccgggctgttgctcgcaaggcgatgcatgaaggccttgaagtatacggcatcaattatggctttgctggattagttgctggcgatatttttaaaatgagcgagtcaactgtcggcgataagattcagcgtggcgggaccatgctgtactcggcacgctatccgcaatttgctcaagaagaaggccagttgcgcggggttgaacagctgaacaagttcgggattgaagcattggttgtcattggcggcgatggttcttatcacggagctttggcattaacccgccacggtttcaatacgatcggcttgccgggaacgattgataacgatattccgtacaccgactttacgatcggttttgatactgcagtcaataccgtggttgaggcggtcgaccggttgcgtgataccgcggcttcccatgaacgtacctttgttgtcgaggttatgggtcgtgaggctggtgacatcgcactttggtccggtgtagccggtggcgctgaagatgtcatcattccggaacacgactttgatgttaaaaagattgcatcgaagttgcaaagttcacgtgaacgcggtcagaagcatgcggttattttgcttgctgaaggcgtgatgcatgccgatcagtttgccaaagaattggcagcatacggcgacttccagttacgtgcaacggttctgggccatattgtccggggcggtgcaccatccgctcgtgatcgcgtattggcttcacaaatgggtgcttacgccgttgaacttttgctggacggcaagggtgcattagcagtcggcattgaaaacaacaagatcacggcgcatgacgtccggaccttgtttgatgctaagcaccacgctgaactttcgctctacaccttggcggaagagttaacattttaatttctgtaaacaaacgacattaacgtctgtttaaataattgcaaggagcgatttcacttatgaaaaaaaccaagatcgtcagcacacttggacctgctagtaacaccactgacatcatcgttaagttgatcgaagcgggcgccaacgttttccgtttcaacttttcccatggtgatcatgaagagcacttggcacggatgaagatggttcacgaggctgaaaagatcacgggcaagaccgttggtatcatgcttgatacgaaaggtgccgaaattcggaccacgcttgaggatacccctgatggcacgatcgaattccacacgggtgataaagttcgcatctccatggatgccagtttgaagggtactaaggaaaaggttgctgttacttatcctggtctttacgatgacacgcatgttggcggccacgttttgttcgatgatggcttgatcgacatgaagatcaccgaaaaagacgagaagaaccgcgagcttgtcactgttgttcaaaacgacggtgttcttggcggtaagaaaggtgtcaatgctccaggcgttgccatcaatttacctggtatcactgaaaaagactccaatgatattcgtttcggtttggatcacgggatcaacttcattgctgcatcctttgttcgtaagcctcaggatgttttagacattcgtgaactccttgaagaaaagaacgcgcttaatgttcagatcttccctaagattgaatctcaagaaggtatcgacaacatcgatgacatcttgaaggtttctgacggtttgatggttgctcgtggcgacatgggtgttgaaattccatttgaacatgtcccgatcgttcaaaaacggttgatcaagaagtgcaatgctttgggcaagccggttattaccgctactcaaatgcttgattccatgcaggaaaaccctcgtcctacccgtgccgaagtaaacgacgttgcgaacgctgtttttgatggtacggatgcaacgatgctttccggtgaatctgctaatggtgattatccggttgaatctgttgctgcaatggcccggatcgacgaatataccgaagcagcgatgatggatcaagatgcatttgccttgaaggaatacagcaacaagaacattaccgaagctgttggccaaagtgttgcacacacggctcgtaatcttggcgttaagaccattgttgctgcaacccaatctggttacactgcacggatgatttccaagtatcgtccgaaggctgacattcttgccattaccttcaacgagaagacccaacgtggtttgatggttaactggggtgtttacccaatcattgccgacaagcctgctaacaccgatgccatgttcgacttggcaaccaagaaggctcaagaccttggctttgctaaggaaggcgatctgattctgatcactgccggtgttcctgttggtgaatctggcacaaccaacgttatgaaggttcaacttatcggctccaagctggttcaaggctcaggtgtcggtgacgaatccacgattggtaaagcagtcattgcaagcaatgcgcaagaagctgctgctaagatgcaaaagggtgacattctggttgttaagacaaccgacaaggattacctgccagcaatcgaaaaagcggctgccttggttgttgaaactggcggcttgaccagtcacgctgctgttgtcggcattgccatgggcattccggttgttgttggtgctgaaaatgctaccagcgttatctctgacggccagatcattaccgttgattctcgtcgggggattgtttataaaggtgctaccaacgccctttaatccggacgatcaatttaacattggttttcagaaactcctgaggaaactcgggagttttttgatggctgaaatgagttctcattttagcaattaactgctagcaaaaatgactggggactcgtcagcgatgatcgggtagcttataatgaaaagcagtatgaattgatgagatgaatagcaggcagccgatgatcctgatcggcaaatgattggaggagcgcacctgtggaaagttggttatttttactggccattttgatcattgcgttagtcggcaaaaataagagcctcgtgatcggcgttgctgtcgtgatggtgctgaaattactgccgcaaacacagcatttgatgaagttgttgcagagtcaaggcattaattggggtgtcaccgtcatttcggctgcgattatggtgccgattgcgacaggtgaaatcggcttgaaagagttactgcacgtgattaaaagtccggctggctggattgccattggctgcggcgttttagtggcagtgttgtctgccaagggtgtcggtctgctagccatgagtccggaaatgacagttgctttggtttttggcacgattttaggggttgtgttcttaaaaggcatcgctgccggtccggtgattgctagtggtattacttatgttattttgacagcgttcaacatactgcctggacggtaaggcaagtcggatccagctaaaagggagacatgatcattaaaatgaaattcaatggccaaatcgtcaccgcacacgtgacggatcacaatgaaaaagaagtattcgctcagtacgatggcgttaccttggcaatcgatcgtaaggaattagcagctttgcctgagatcggcagtgaacttgaaggttttgcttatgagaacaagcatggtgaagcccggttaacaactaaattacctaaggtgggccgcgatcactacgcatttgcaccggttgttgaagtacgccgcgatttaggggtctttgttgatattggcttaccggataaagatatcgtggtgagtgaggatcaactgcctgagctcaatcgactttggcctcaacgcggagatcggctgatgattgctttgacaaccgataaaaaagaccggttgtggggaaatcttgctgacgaaacgatcattcgggcagtggccaatcgtgccaaacctgaccaaatgaatgctgatgtgaccgcaacggcttatcgcctgaaaatggcgggtacgcgggtattgacggatgacttttaccttggctttattcatccaagtcaacgtgatgtcgagccgcgactgggtcaggtgttgcatgcccgcgtgattggtgtcagcgatcaaggcgaactgaatctatcgttgaagccacgggcatatcaggcgattggcgacgatgcggcgatgattttggcggtgttgcaacatgatcctgctggcaaaatcgcctataccgacaaaagcgatccagatgcgattaaacaggtctttggcattagtaaaggcgcgtttaagcgggcattaggtcacttattgaaagccggattgattaaagaagaagcaggttatacgattttgttaaagacaaacggtaacgcatctcaggagtaagaacatgcacgggttgattgcagattttattcattatttagatgttgagcgtggattggcggccacaacgcaaataagctatcaacaggatttaatgacctttcaggcttggctgacatcgcaaaaacggactacctttccggaagactttgcggttattcagacatttttgaaacaacaaaacgatacgaaagcccctgcgtcagtcagtcggatgatttcggcgctgcggaaattttaccgatttttgttgcgggaaggggctgttaaaaccgacccgatgaccaaaatcgatacccccaaaaaggcgcagcacttaccggcaacgttgtcagggccagaaatcgacgcgcttatggccaaaccggatattacgaaaccacttggcctgcgtgatcgcgccatttttgaattgatgtatgcgaccgggttgcgcgtgtcggaactcatcgggctacgcatggatcaactgcatttagccatgaacttgttgcaggtgactgggaaaggtgacaaggagcggctcgtgccaatcagtccccaggcaacagagtgggttaatcgatatttgcgtgatgcgcggccacggttgattaagcagcaccaacctaaagctgttttcgtcaattttcatggacatgcgctcacccggcaggcaatttggaagaatttaaaggcctatattgccagtgtcggcattcaaaaagatgtcaccccgcatacgctgcgacacagttttgcaacccgactgcttgaaaacggggcggatttacgggttgttcaggaattactgggacatagcgacattagtacgacgcagatttacacgcatcttagtaatcagcatttggttgcggtctaccataaaacgcatccgcgcggttagggagtacgttgctccaacgcggtttgtatgatagagtgttacgagagtatctcttggaggcaaatatgctggttaaatacaaaaacgactacgagaagatcgccatgggacttttgtcttttattcccgatctcaaagatgtcggacacttgaagaccgaacttaagatgtacaccgaagacgattcgcatgcgctgtatttgtataagcaggggcatgattttgtcggtgtgatcggtatcgagttaagtgatgattttgttttggtgcggcatttgagcttttcaccgaatttccgtgatcaggcgacggcgtttgctgcgctgacagagttgacgaagcttttccctgataagaaactgatgggtgctttagagcatgcgtcattgatagctgcctttaacaagtttcgaaaagaggatgaccatggcactgacactcgtgctgaatgatttctccggaccgctggatttgttgtggcatttgattcggacaaacgaagtggatatttacgatattccgatcgccgagattaccacccagtaccttgactacctgcaccagatgcaggatctggcgctggatgtagccggcgattattttgtcatggccgctaatttaatggttttaaaaagtcgccttttgttgccgcaaccggaaccggaaaccactgaaccagaggagccaaccgatccgcgggcggatttagtggcccaactgttgacttatcaggtttaccaagaagcagccaaagatttaaagcaccgggaagctaaacgggcacaatcctttgccaagccgacgacattaccagacgagaaaatggctgtgccgctcgctcctggcaccgtcaaattgattgacctgcaggcagcgatggcccgggtgatgaaggcgcagcaagcggcccgccagacgattgcccatattgaaaccgagccggtgtcggtcgaaaaacgcatcggcgaagttctgaagacattacaaaaagacggccagtgtctttttgctgatttattggcggttcattcggttgagcaggtggttacgacctttttggccttgttagaactgatgaaaagcgatcaggtgatttgcgaacaagatgcgccgtttgatccgatcacggtgacgctgaaggaggccgcttaatggagccggtattggaagctattctgtatacagcaggtgaaagcggcgtgaccctgggcgaacttgccgggattttggaaatcagcgaaagtgcgatgcgccaacaactagaggcatatcagcaaaagctggccgccgacgagcagcgcggcttacaggttcaacaatttgctgaccgctactacttgttaaccaaaccggactttgccgctgctatcaaaaagtattttgccggtccgcctgctgctggtttgtcacaggcagcgctggaagttttagccatcattgcttatcagcaaccgattacgcgaatcgaaattgacgaaattcggggcgttcaaagttccggtgcgctgacaacattagcatcccggcaactgattaaagaagccggccgtaaagaagcgccgggacggccgattctgtatgcgaccacccagtttttccttgattactttggcctcaatcggttggcagatctgccgccactggccgatgcacctgaagataccggtgaagtcgatctttttacagcatttcgtgatgatggtcagtcgcaacaggctgaagacgataagaaaatggagcaaaaccaacaagatgacaaccaaaactgaacgattgcaaaaagtcattgccaaagccggcatcgcctcacgccgccatgcagagacactcattgcctcgggacatgtgaaagtcaatggccaagtgaccactgaaatgggcattaaagtcggtccgcatgatgacgttgaagtagacggtgttccaattggcaaagaggctaaacggtattttctgttttataaaccgcgtggtgtgattagcgcagtcgaggacaacaaaggccggaaagtcgtgactgattattttgaagatattcgcgaacggctttacccggttggccgcttagactatgacaccagcggtttgttagtgatgactaatgatggcgagttagccaaccacctcatgcatccgcgctatgccctcgagaaaaagtatgtcgccaaagtggaaggcattccgaatcgacctgccttagcgccgcttaaaaccggggtggtcattgacggtaaaatgacggcaccagcaaaattcgagattctgtcgacagataaagccaagaaaacagcgattgtggcgctcaccattcatcagggcatgaatcatcaggtgaagaagatgtttaaagcggttggcttcccagtgatcaagctgtcccgtgaagcttatggcaacctgacactagccggtttacagccgggagaacaccgtgagattaaaccgcaggagctgcatgatttacggcaacttaccggtgatcaggacgaaaagcattaagttgttaacgttttcaaggcaagcgcttgaatttaggccgcacctctgataaagtatgtctgtaattaaataattggttcgtcttcagggcagggtgtaattcccgaccggcggtatagtccgcgacccgcgtttgcggtggaaccggtgtgaatccggtaccgatagtgatagtctagatggaagaagatggggcttttttgaatctgcattcaatcgagacctattcccccctgaaggaggaataggtctttttaagttccggaagacggcctcatggaggttatgtattatggcaagtcgttctaaagttcatcgtttggtgggtatcgcacttttagcggcgatcggttacgtattgatgatgttctcgtttccgattattccggcgtttccattcttgaagttggatttatctgacttggttgtgttgctaggagggctgctttatggaccggttggcggcatcagtgttgcctttatccggagtctggtccattttgccttgaccggaggcggcgttgtgaacctcatcggcgatttggccgcctttattgccagtgttggattcttactgccggtggtttataccatccgcggcaaacacagtttatggcgccaagttgaaggtctggttttaggtactttaagccttactttggtgatgagcattctgaactggctggtcatcacgccgatgtacatggcggtcttcaatttcaacttaggcatgtcgctaacccgttatgtgctgattggcgttgtgccattcaatctgattaagggtgtcgtgatttcagtcgccttctttgcgattgcgaaggcactggcaccttggcttgcccgtcaagaaatgcagatgagccactaatcgattcgtcgaggccttttggaacctttagtagctgcacgtttgcaaacaaaaacttccgtcaatttggcggaagtttttttgcgcgacttggctacaggcaggcatcatttgaaaacggcgtaatgtatgaatagagcgttaatcgatgtatgagagagacagccgacttattttgccttggttggcgtataaggatcggcgtcaaacggatggtcactgcgtttgatggcgtgtgtcgggcaccgtttatacgctaaacgaaaatgaatcgtcgcctgatcatcaagcgcttttgtgccggtattgcgatcaggcttataataggcgatgcctgcctgatcgtagtcaaataagtctggcgccagcatctggcataaaccacacgcgatgcattcaggccgttctactctgccgtataaagccattatcatatccgccttcaatcttttgtcatgattccaactacctgtcattgtacaataacaaccgggaaaagaggtgcttattttgctgccagacttggtgattcaattttttaatatccaaccgcgtcgcgaacggtctgtatttgggctgttaaccggtaaacaaaccatttctatcctctatgcggctttgagtcaccatcagttgcaatggctccatctttatcccggattatcgaaggaggcgtttttagccgccgtggcgaagctaaaagcacaaaaatgtttagcggccacggaaaccggattggtgctaacggaaatcggccaaaagcgtcagatccaagcagctgaggaggtgtcactacctgcttactaccaaccatggatgcgggttgacaggttcgcaccgcgcttctttttagcagttcaggttttatccgaagccagctatcattcgcaagcttaccgaccgatcagtactgattgggcaacccagcaggctgtgaagcgctggtatcgacaaacgcgtgttcagacagcggttgatgaattaaccgatctttttgagcgattaccggcgtcgcttgctgatgagctcgccgccaacctgatcgggcacaattacgcaggtcagcgccaaccggcaacattatcggcacattttgccaatgtgaatgcgttagctgcgttgattcaggaaattgctgcagccaagaatcaatggtatgccttgtggggtggaccgcaggagttggtgacgcgtccggctcaagcgaccttgaagcaagttcggttaggcgttgatttggcgacagttgccgcacaaagtcatcgcaaaatgagtactgtcaaagagcatctactattagccgcgatcatgggtcaggatgttccgatagccagactgattccgccagcggtgcatcacgctttggatcaggtggatcaatggcaggatcatcagacgttactggcgacgattccggacagtgaattttttcagattcgtttgtttcagatttttaaactgcaagggagatggccgcgtgccgcaacttgaaactttattggccgaccatttcggctttgaacattttcggcccggacaaaaagcaattattcaggcagtcttagcagggcaggatactttggggatcctgccaaccggtagcggtaagtcactttgttatcagttgccaacgatcatcaaagcaaagccgacgttgattatcgagcctttaattgctttgatgcatgatcaggtcgggcggctacaggcggcgggtgagaagcgggtcttggctttgtcgggacaaattgccccaaatgtgtttcctgaagttttgcgaaatttgggtcagtatcgctatcttttcatctctccggaaatgttgcagcgtgcggatgtattggcggcactcaagcaacttgatttgggcttgtttgtggtcgatgaggcgcattgtatttctcaatggggtccggattttcgcccggcctatttacagttgggacacgtccgaagccaattacacgttgatgccgttttggcgctcaccgcaaccgctcctgaacgggttcgcacagatattttgacgcaattgggcatgcaaaatccagtcaccattgctggttcggttgatcgcccgaatatttttctcggggttgatgtttgtcctaatgaggaagcaaagcagcaggagcttcaacatattatggcagcaaacattgggtcaacgattgtgtactgtccgacccgagcggcatctgagaacctggccggcgaattgcaaaaagccggaatggcagccgccttttatcatgccggattggaccagcatcagcgtgatttgattcagcggcagtttcaatccgatcagcttcaggtgatttgcgccacaagtgcttttggcatgggcatcgataaggcaaatgtccgccttgtcgttcatttgtatgtacccgaatcacttgaagcgtattaccaggcaatcggtcgcgccgggcgtgatggggcgtctagtttagcggcgatggtggtgactcaggatgacttgaaacgcagtcaggcgctggcaggaatgctgcctgaccaaacgatgattcagactatctttgcccacccggagatttatcgcaattttgatgacccgcaagtcagcttgattgaagcgtatattacggccggcttttcgctgcttcaaacgcagcagcaacttgagaagcgaatgacggaaaaacagaatagttttacggcgatggcagcttttgtcaacgcatccggttgtcgacgggcgttattacttaagcactttgattcaccggttccggcacatggctcattttgctgcggccgagtgacgtcggacgtcttacaaatttttgtcacagaaaaaagacatcagacaacccagccgaaacactggcaagccgtttttaggcaaatctttagataagcggcgtcctgatttgctgcgatatgatacaataaatccatgtagtgaggaggttcgtgatggccgaaaaagataaacaccaacatgacagtgcggatcaagaacataagcgtgacgatcaaaacaagccttgggaaacccttttcgatgatgatcgtgatgaccaaggcaatttaagtcgattggccacccgtaaaaaacgccaaggcagctcaaaatttacatggattttggcaattattttgattttgctcgttttatcgccaattatttacgtcaaggtttggggcagccaaggtagcagtggctcaaatttgtcaaatgacaaagtggtgattcagagcgccaagaaagccagccatcgatcaaaggttaaaaaatccgaaaagtcttctaaagcggcaaaggcttcttcagcttctacgaaagaagcaagcagtcagcagccgtcgactcaacatgtggcaagtaaagaagccacaactgctgcttcgacaactgctgcttctgcccaagcacctagtgtcgcatctacagcgccgagtcaggccagcactgctagcactgcagctaactcgtacacggtgatttccggggataatctttaccggattgcccgtaaccataatatgacgttggacgaacttttgcagttgaacggccttagcgccaattccagcctgacacccggaaccgttttaaaagtgaaataaatgtaacgcgcccctgttcgtgccattgacgagatgaacaggggcgtgtgttgtggaggaaattcatgcagattgcgatcgacggcccggcaagcgccggcaaaagtaccattgcaaaacttgtcgccaagaaattgggctttatttattgcgataccggtgcgatgtaccgtaccgtcacatatatggcgcttaaggatcaattaccgctggacgacgaaacagccattatgcagcatctcgccaagatggtgattcggtttgcccccggcgaaacggaacaacgggttttcatgaatgacgaggacgtgacgctggccattcgtgaacccgatgtgacgaataatgtgtcccaggtttccgcgttaccgcgcgtgcgaaccgaattggtcaagcggcagcgtgatattgcggcgactcatgatattgtgatggatggccgtgatatcgggacaaccgttttgccgcacgctgctttgaaaattttcatggtggcgtcagttacagagcgtgctaagcggcgctataaagaaaatgttcaaaaggggatcacgacaccactggcaacacttgaggctgaaattgccgagcgtgaccgtaaagattcccatcgggcggtatcgcctttacggcaggcgtctgacgcgattcggatcgatacgaccgatatgtcgattgatgaagtcgtggcacggattctgacattagtgacagaaacgaaaacgcattagttaaccggagcgaaataagcgctggtaatttgtttcgttttcaagtacaatagatccagtatacagctgcataggaggattttttggcatgagtgataataacgttaatgagaacaccgaaacaatggcggacgcccttaagagtgtcactacagtaaagattggtgacactgtcaaggcagatgtccttgctgttgaagataaacaattgatcgttgggatcgaaggaacgggcgtcgaaggcgtggtcccgatcaaggagttatcaactcagccaatcgatgacattcacgatgttgccaaggtcggcgacaaacttgatttagttgtgctttcaacggttggcaaagataaagaaaatggtcagttcttgctgtccaagcgccgtcttgaagcacaaaaggtttggaaagaaatccaggctaaatatgaagccggcgaaaccatcacggcacctgtcaccagcgttgtcaaaggtggcttggttgtcaatgccggtgttcgtggctttgtcccggcatcaatggttgaagatcactttgttgaagatctcaatcaatataaaggcaaagaactcgaatttaagattattgaaatcgaacctagtgaaaaccgcttgattctttcgcatcgggctattgttgaagcaagtaaggctgaagcacgcaaagaaatctttgctaagattcaaccaggcgatgtcgttgaaggtaaggttgctcggttgaccaactttggtgcctttgttgatctcggcggtgtggatggtttggttcatgtgtctgaaatttcattcgaccatgttgataagccaagtgatgtcttgaaggttggtcaagagattaaggttaaggttttgaatgttgatcctgaccgtaaccgcatctccttgtccatcaaggcaaccctgccacagccatgggataatatcgaagaaaaagcaccggctggctcagttttgaccggcacggttaagcgcttgacgacgtttggtgcgttcgttgaagtattccctggtgtcgaaggccttgttcatatttcccagatttcacatgagcatgttgcaacgccagctgatgttttaaaggaaggccaagaagtgaaggttaaagtgctgtcagttgaccctgacgcacatcgcttggcattgtccatcaaagcattgcaggatcgtccagcaggcgccagcgaaacgccagcgcacgaaggcggcaataacagcggcaataacgaacgtcgccgttcatcccgtccgcgtcgtggcaatgatcgtcatcagtcgacatcgattcctgctgagtatcagcaagatgattccggcttctcactcggcgacatcttgggcgatgcgttgaaagacgctgctaaaggtaagaacgatgatcaggatgacaacaagtaattgttccgtcctttaaaaagttgagccttggctcaactttttttatggctaacggtctgttgcacataaaattagcggatcggttgcgatacattttaaaagtgctcataaaagacctcagcaaagaaaggaggccataacatggttttaccaacacttgccattgtcggccggcccaacgtcggtaaatcgactatttttaatcggattctcggtgaacgggtctcgattgttgaagatacgccaggcgtcacgcgtgaccggatttacggtaaaagcgaatggttaggcaaagaatttgcggtcattgatactggcgggattgatctcggcgatgagccgtttctgtcccaaattaaagatcaggctgaaattgccattgaggaagccgatgtgattctgtttctgaccagtgtcgaagcaggtgtcactgacgctgatgaacgggtggcacagatactttatcgagcgaaaaagccggttgttttggctgtaaacaaagtcgataatccagagcgccggcaggatatctatgacttttattcattaggctttggcgaaccatttccgctttccggtacccatggcatcggtttaggcgatgttttggatgctgttttggcggcgttccccaaagaagccaattcagttgaagacgatagtattaagttcagtctgattggccgcccgaatgtcgggaagtcatcgcttgtgaatgctattctaggggagaatcgcgtcatcgtgagtcccattgaaggcacaacgcgcgacgccatcgacaccaagtttgaagccgatggcgaaacatttaccatgattgataccgccgggattcgtaaacgcggcaaggtttacgaaaatacggaaaaatacgccgtactgcgggctttacgtgcgattgaccgatcagatgtggttttggtcgtcattaatgcggaagaaggcattcgcgaacaggacaagaaagtcgccggttatgcccatgaagctggacgcggtattattatcgtggtgaataaatgggatacggtcgaaaaagataatcacaccatgaaagattttgagaatttgattcgccaggaattccaatatctggattatgcgccgataatttttgtctcagctaagaccaaacaacgtttacagagcttgccagctatgatcgtcgaggtttcagaaaaccaaacccggcgaattcagagtagcgtgttgaatgatgtcttgatggatgccattactgtcacaccaacaccgacagttaatgggaaacgcttgcgaatttattatatgacgcaagtggccgtcaaaccgccaactttcgtggttttcgtgaatgatcccgatttattgcacttttcttacgagcgctttctcataaaccagttgcgtcaggcatttgattttagcgggacgccgattcacgtcattgcccgtcaacgtaaataatttttacaatgttggataatgacttttcattcaataaatcgagattttcgataaccaatacgcgattatcgagcaaaaattttggcaaaaaccttgtcacggcgggcttgctatgctatgtttaaacctgaaatggtgatacataattatcattgtttcttcattcctgagcggtcaggaatggacatgtttaggtgttcacgcatctaatcaattatggaggtgaaatgttcatggcaaacaaagcagaattgatcgaaagcgttgcaactgcaaccggtttgaccaagaaggacgcaaccgcagctgttgatgcagttttcggttccatccaggattccctttcaaagggtgacaaggttcaattaatcggctttggtaacttcgaagttcgtgagcgtgctgctcgtaagggtcgcaacccacaaaccggtgccgagatcaagatcccagcatctaaagtaccagcattcaagcctggtaaagcactcaaggatgccgttaaataaacggttcaattgggtcagctattaaagcatcaccaaaaaccgagtcttagcggactcggtttttgcgcgttttggcagtgataagtcatgatgtggttactggctcaagtaccggttcacgctcacattaacgcgttcactggcgcagaagcctgcgtgtaaggaaccttggtcgcaatggcaaagcagcccgccatcgcgcccaaggctacttacactccggcttctcccgcgccggttcacgctcacacatgttaaacttatgcatatggaatttattttggcttttcagatacggaggcagctatgagttacgcacaaaaaatgctcgatgcacttgaaacaggtcagatggaaacggcgcggcaactttttacgcaggttttgaagcatgatgacgacgaaacccaatataatctagctgaagaactttacgctatgggcttcaatggtcaggctaagcggctgtatcaaggcctgttaggtcgttatccggatcaaggcgacttggccactgctttagccgatattgcggtttctgacggcgatacagatgccgcactgaactatctgagtcgcattcagccaggcgatccggcttatgtccaaagtttggtaagcgccgccgatgtttatcagacactggggttgtatgaagttagtgagcagaagttattggaagccaagaaactggcgcccaaagagccggtcgttacatttgcgcttggtgagttttattttgactggggccattttcctcaggcaattgcggcgtacaacgagcttcttgctggcgggaccaaagaacttgccggggttaacattgaagcacggctggcggccagtctggcgcaaaccggccagtatgaagacgcggtggctgcctatgaagacgtcggggtggatgcgttggatctcaatggccgatttgagcttggcggtttgtacctgcagttggacgatccggccaaggccattaccaacttacaggcggtaattgacaccgatccaagttatgccaatgcttatttaccgttggcacgtgcgtatgaggcccagaatcagcctgataaggccttagacaccgttcaagcgggggttatggtcgataacacgaaccccgacttatacgcgttaggcggcaaactagcgcttagtgaagacaatcccgatttagccgaaaattatttacaaaaagcactgaaaatcgatccagaagatcaaggtaatatgttggcctggagtaattttctggttcagcaggaacgtgatcaggagaatatcgattttcttagccagattgatcgcagcggtgatgtcgacccgcagatttactggaacatggctaaaagttacgatcgactggatgacgttaaaaaagcccgggagaattacctgttggcgttcaatcgcttccaggattcgccagactttcttcatgatttgattgatttcttccagtcaaccggtgcccgcgctgagcttaaggcagccttggttcgttacctgaaattggtgccgaccgatgatgacatgcaaatgcggttagatgaactcaatgatgaggcggattaaagtgcgagggattagtggccgaacaaaagtcgtcgccgtttcttttggtaggtgaagccttcgcctaatgcttcgtggacatccagaatgctgatgaaggcatggggatcgatagcttcgatcaatcgtttcgtataggcgatttcggttgaggcgacaaccgcataaacgacttgcttgtgatcatgcgcaaagccgccttccgcgtgcaaaaaggtggtgccgcgttcaagatcattcataattgccgtggcaatggcttgactgtgatctgagacgattaacacacctttggctgcatacgcgccatccagcgtaaagttgacgatgcgggaaaagacgtaggcacccagcagtgtgtacatcatcaattcaaggtttaaataagtcagtgaaatggtcaaaacaatcgcatcaaaaatgagcagcgtccgccccatcggcaccccggtttgttgctcgacaattctggccacaacatcggtgccgccagttgtgccgccgtggcggtaaatcaagccgctgccaaaaccgccaaaaagaccggccagtaccccggaaatgaataaatcatgatgaatgtcgatgctcagtgggacccgttgccagatccatagccatgccgataacattaacgttccgaaaatcgtatataccagcgcccgttttcccagaaacttataacccacgatgagaagcgggatattaagcagtaccgtgctataagccgggtccacgtgccaccagtaacgaatcagcagcgtaatccccgtgacgccgccttctgccaggtggttggcaatgttaatatagaccaagccaaatccgtataaagcacaaccgagaacaatcatcaaaagatccagacaaatccgcatgttgcgtgacataaggtgcctcccaaaaaagaatttaagctcattctaacagaaatcttatcttgcggtgtttttgaggtgaggtcaacaccaaaacaaaaggagtagcgtaaatgcagttagatttaaagcagcctgattttcaagcggcaattcctattttaaaaaaaatcgaagcagccggttatgaagcctattttgtcggtggcagtgtgcgcgatgcgttgttagggctgccgatccatgatgtcgatatcgccagctcagcctacccggaggagattaagcgcatttttaagcgcaccgtcgataccggtatcgagcatgggactgtgatggtgttggaccatgggacgggatacgaagtcaccacatttcgaaccgagtcacggtatcaggattttcggcggccggatcacgtgacatttgtccgttcgttggcagaagatctcaagcgccgggattttacgattaatgccttggccgttcgccatgacggcacgattattgatttattcgacggtctagccgatttgaaaaagcacgagttgcgggcagttggtgatccgcacgagcgttttcacgaggatgcgctgcggatgatgcgcgccgtccggtttgaaagtcagctgggttttcacattgagccggcgaccaaagaagcgattacggcaaatgctccgttgctaaagcatatttcggttgaacggattgcggcggaatttaatcggctgttgatcgggattgatcggcggtttggtattcaagactttgtgacgaccggattgttcgcgtatgccccggcactggctggccagagaacggctttatggcactttagcgagctgccggacaccccttttagcggcattgccagtggttggagcgcgctgctttttatgctcaagctagatccggaaccaaccttaaaagcctggaagcaatctaacgacttaattgacctagtcagtcagacggtgacgctgctggccaaaatatcgacgccgactccctgggatttgtatactgccggctcccgggctgtggcagttgctggtgaagtggccgccttactggaaccgaactttgatcgacaggcgctggcggcagcatatgcccggctgccaattcacgccaaaaaggagctggcactgaccggacgtgatttaatcacagccggtgttcgtcccggccccgaaatgggaaaattgctgcatcaggttgaatcacaggttgtggccggtgttttgcccaatgatcccaaaaagttgttgcccgcagcaattgaaatgtctcgagaacggcagtgagtgtgttatgatgagcatgtaagcacatacaacaacgtcacatcaggatcaatgcatggtcgcaaggcttcccaaaagtttctggccaaccttgatgctggtgtgatcgtgaagggggatttctaatggcagaacatgtttttgaacaattggtttttcattttcgtaatggtgacgaatggacggtccagcatgatgagctggccgatgtctggatcagccgggtaaccaccagctatgggcggattcacggcggccagattcaggaaattcatccttgcaagagtttcaaggttgaaattttaccggaagccgatcatgtcaaatcaagcgacatcaacaccggttcacttgaaatgggcatgtttggtcgcgctacgaaatatcaggacattgaaaaaatggacttggtattcgatgccgaagccaaaaagcaggttcaaatttacttcccgtttaagcaaaaagatccgagcgggcttgataatgagtatcaaaccagtaagctagccaagaatggtcatctttacatcgtcattgatgcccaacataccgtggacgacgaatacccgcggatttaaggcagcaaacaggcaggtcgacagtgagtcggccttttcttgtgccttgcttcttgctaagatggacaacgatacaagggaaatgagggacaacatgcagacgttaacagcagaaggcctgagcaaggcatacggtgacaagcaattattcaaacaaatcgattttttaattaatgaaggcgaacgcatcgggctgatcggggtgaacggtaccggaaagaccacgctgattcgcgccttggctgggctggaagcattagacgccggcacggttaaaacgccgaagaattatcgcattagctatttgacccaagtacctgaccttgatcctgatctgccgattatggatgccatctatcgcggtgattcgccggtttttcaagcgattcggcagtatgaacgggcactggctgcctacaccaaggatccgctgaatcaagcgaaaactgatgcctacaccaaagctgacgcccgcatgactcaagaagacgcatggtcggccgaaaccgatattaagacgattctgacacagctgcatattgacgacttgtcggctcgggtcggtagcctctccggcgggcagcaaaagcgggtaggactggcgcaggttttgattgaatcacctgatctcttgctgctggatgagccgacgaaccatcttgattttgattccatcgcttggctcgaaaaatatttaagtagttatcgcggcgccttaatcgtggtcacccacgatcgctattttttggatcgcgtcaccaatcgcatttttgagttggatcgcggccgacttttccagtatcaaggcaactatcaggcatatgtcgccaaaaaggctgatcaactggaggctgagaaatcggctaaccataaacaggcgcaactttatcgccaggagctggcttggatgcatgcgggcgctcaagcacggtcgaccaagcagcaggcgcggatcaatcggtttaaagaactgcaagcagctaaagacgatgcgccgacacctgatcagcaattggatccgatccagattgccagtgcgcggctcggcaagaaagtgatcgaaatgaaccacgccaatctgagttttggtcatcacgtgattttaaacgattttaactggctggtgcagccaggaacccgtattggcattaccgggcaaaatggggccggtaagtcaaccttactcaatattattgccggcaagcagaagctggacagcggcacgatttcgttaggagaaacggttcagttggggtattacacccagatgaataccgatctcgatccaaataaacggatcattacctatttgcaagaagtcggcgaagaagtcgtgcaggcagatggtcaacgggtatcagtgacccagatgctggagcagtttctgtttccacgcaatatgcacggcacgttaatcggacgactttccggcggcgaaaagcggcggctgtatttgttgcaggtgctcatgcggcaaccgaatgttttgctgttggatgaaccgacgaacgacctggatattgcgacgttgacggtcttagaagattatctggatcattttcccggcaccgtgatcaccgtgtcgcatgatcgctattttcttgataaagtggccgatcagctgctgatcttcaatggcaatggccagattgaccgcgctgttggtgaattttccgattacctggcgaagcaagctgcgcaaccggcgacaccaaaagctaagcctgtcgcaaccaaaccggcaccgaaaaaagttgcgccgaaagcgaagtcgaaactcacatacgctgaaaaaatagagtatgataaactgcaacaagaactcgatgaacttgacgagcgcttggccaaagtgaaggcggaaatggccgatgtcaacggcgaagattacgttaagttaggtgatcttcaagcaaagattgataaaatcaaccagacgattgaccagaagttcgaccggttcgccgagctggatcaatatgtatgagcaatgaacgatagaaggggaaagacgatgttagagcagccatatctggatcttgcaaaaaaagtcctcgatgaaggacatttcaaacccgatcgcacccacaccggcacttacagtatttttggacatcaaatgcgctttgatctcagcaagggatttccgttgctgacgactaaaaaagtgccatttggtttaattaaaagtgaactgttgtggttcctgcgcggcgacaccaacattcggttcttactgcaacacaaaaaccatatctgggatgaatgggcatttgaaaaatgggtcagcagtccggaataccacggaccggatatgacggattttggtcatcggcgggtaaaagatctcgagtttgcaaaagtttatcaggaagaaatggctaagttcgacgaaaaggttttgaacgatgatgccttcgctgcgaaatatggcgatctcgggttggtgtatggttcccagtggcgtgcctggcgcaccagtaccggccaaactatcgaccagctaggggatgttatcgagcagatcaaaacccacccatactcgcggcgcttgatcgtgtcagcttggaatcccgaagatgttccgaccatggcattgccgccttgccatacgctttatcagttttatgtcaatgacggcaagttgtccttgcaactttaccagcggtccggagatatttttctgggcgtcccgtttaacattgcgtcttatgcattactgacgcttttagtcgcgcatcaatgcgggctaaaagtcggcgagttcgttcatacattcggggatgcccatctctatgtcaatcacattgaccaaattaaagagcaactgacacgtaccccgcgtccagcgccaaaattggttttgaatccggataagcacgatatttttgattttgagatgaaagatatcaagctgctgaactatgatccttacccggctatcaaagcgccagttgcggtttgacggggcttgtcagaggactcgtagatgcggcgcatggtatgatcagtttaaccattgatggcaaagctgcttatctaggaacttggggatttttcaacgatcaaggaggagttgcatatgaccgaatttttatgggcacaggatcgcactggcattatcggcaaggacggccatttgccttggcatctgccagatgatttgcattattttcgggcacaaaccgtgggcaaaatcatggttgtggggcggcgtacctacgaaagctttcccaaacggccgctgcctgagcgcacgaatgttgttttgacccatcaagccgattatcaggcgccgggggctgttgtgctgcatgatgtccctgaggtctttgattacgccaagcagcaccctgaccaagatctcgtcatcgcaggcggcgcacaaatctttacagcctttaaagatgacgttgataccttgttggtcacgcggttggccggaagctttgatggcgatacgaaaatgatcccgttagactgggatgccttcaccaaagcatccagccgcaccgttgaagatgccaatccagatttgacgcacacgtatgaagtttggaaaaagaaagcttaaggctctacttttgtatgttttagtatttcccagcaaagcatgcctgtgacaaaaacccagcggcaatagccacgaaaaaacgtctctccagtcacgtgaagagacgtttttcgtggctattttacggtttacaggtaaaagtaaatcgataagtacatgcataagctgccaagaatgacgaagagatgccagataacatggatgtatgggatgcctttttgcaaatagagcatcgctccgccagtgtaagctaagccgccagccactaataagctgaatccgaccgggcccaggtgatgccatagcggaaccatgccgatcacgcagagccaacctaacaccacataaatcatggtttccaaatgtttgaagcgattcaggaaaaagagcttatagccaattcccccgaggcacaaggcccaaatggcgattaaaagaccggtgccgagtttgccgccaatggccaccaagcaatacggcaggtaggaaccggcgattaaaatgaagacgccggagtgatccagtacctgcaaaacatggcgggccttgctaaaatagaaaccatgaaaggcagttgaagcggtgtagagtaacatcagtgaaacgccgaacccgatgagactgaacaattcgatccgattgccactatgtacccctttaacgcccagtaaaacggttcccatcacggctaggccgagtgcgaacgcgtgggtgatagcactaaacatttcattgttaaattcgtaatggcttgattttgacacgcgcattgccaacctccttgaagacagtcgcgtaaatttttgaatgcgaccgtcgctgcttcatatcaaattctaccatgttgcggtttacaaaacaacacaatgtagttatgataactaggtaatgtatactgacattggttagggagtttgctataatatgacggtagacgaacctaacagaaagcgtggctcagacatggcaaatatcaagatcgtcacggattcctccgttcaactgactccagaagagatcagcaagtaccatattacggttgttccgttgactattatgattgacaatacggtttacattgacggtgaaacgatcacccgcgaagactttatggatgaaatggcggcggcgcataatctgccaaagacatcccagccggcaatcggcacttttacggatgttttcgataagttgaccgccgatgggagccaggtactggcgattcatatgacggaaacgcttagtggcaccgttaactcagcacggcaggccgcgcaacttgcaaaaggtaaggtgacggtcgttgattcgttatcgacggatcgcgggctggcatttcaggttttggcagctgcggaaatggcagaggccggtaaggatcttcaaacgattcttaataaaatcaagcaaatccgcgacaacacaacgttggttttaggggttacaagtttggacaacttggttaaaggcggacgaattagtcgtgtttccggtttgatttcgtctttcttgaatatcaaagttgttttgcagttgaaggacggagagctgtcggcactacgcaaaggccgcggcatgaagaccattaataacttcattaccgaaacgatcagtcaaatggctaaaatgccgaatatcaaaagtgtcggcatttcaaccgcaggcgcaactgagttaggtgaaaacgtcggccgccgcattgcggaagtcttaccaagcgtcccggttctggtgcggccaaccgatccggtcatcgcaacccacaccggccccggtgcccttgcgatcatttattacgttgattaaattttaaataaacttcaatcggccggcgcggaggcgttggccttttttgtttgagcgcgagcaggagcgcttagaaatcggagtgtaagtggcctcagacctaaatggctgggttttggccatttaggtctgaggtccttacactccgatttctgcgactgcgagcgcgttatagaatgcgtaagtcaatttgaatattgccagcaatagaacgccgccatccttaacacagctcaggctattgcgaccaaggtccttatgtggaggtttctgggctggtgaacgcgttatagaacgcgaaagcccgctacacttttgcccgcaatagaacacctctgacttaacccaactaacaaaaccagcaaaccaactggtatcgataccataaaaacccgttaaaaagcattcacctttgtttattcacccgcggtcaagtacaataatctattatgactaacaacacatgcgttcatgggaggcaatatggctaaattaaaaaatatttttatagcttgtagcgtcgtgctgattgcctgcctgctggcgtttggcgggtggcagctgtttgggccggcaaccgaccctagtgaggttaaagttgcctcgagcacgcctaagcaaatccaactgacggcggttggcgattcgttaacttatggtgtcggcgacgcaaccaataatggcggttatgtcggtttaacaaaaagtgatttagaagcaaccggccaatatcaggttacgacgaaaaattacggggtcagcggcgacactagcacgcaaattctcaaccgcatcaacaaacaagccaagatccgtgctgacctgaaacgcgccaatatcattaccgtgactgccggcggaaatgatttaatgcatgtcctccaaaagcactttttgacgttgtccgaaaagcagatcacggcaggcagtgctgcgtttcagaaacgcttgacaacgctgcttaccacgattcgcaaggaaaacccatccgcgccgatttacgttttcggcatttacaacccattttacgtttattttccaaaaatgacggccatgaccaatagcgtcaccgcgtggaatcaagccactcaaaaaacattgcatcagtttaaggacgtttactacgttgatattgacagtgttttgtcgagcggagacactgcggcaaacaaggcttcggctaaagaagcgctcaaagaagcaacttccggcgaaggtaatccgcttattttctctcaggatcattttcatcccaataatgctggctatgcgcagatgacgaagcagcttatgaaacaaatacaggcaacgaagaaagagtgggagtaggtaggatggaagcaaagaaacgatcacgtcagcgaaacacgccgcagcccaaaaaaatcagaaccgggattaactggtggaaatggttattgcttgtgctggtcgggttactgctgggaaccggtatctggttcacgaagacaattttgacaccggtgaacatcaacacaaccgctaaaaccgccacgaccacgaatgaaccggttttcaccgtgaagctcaccaaagccagtgccaatcgcatcatggcccactatttaaaaaattatctgcgtgacagcaacgtcaaatatgcggtgacgctgggtacgaacgaggctgcgttaagcggtaagttcaaattccttggcaattccgttaaatttcagttaacgttcgatccgttggttctgaaaaatggcgacgtgctgctcaaagcgaaggatctgaatgtcggtgcgttaccggtgccgattagttttgtcatgagttatatcggtaatagttataaaatcccgcgttgggtaagtctgaatagtaaggccggaactgttgtgctaaaattgagccaatttaaacttcaaaatgggatgacactaaaggccaccaaattggatctcaccaatgatgatcttgaatttgcggtttatctgcctgacgagccgtaaccattagaaagaggctgatgaaacatgaaaaaagaaactgctatttttgccggcgggtgtttttggtgcatggttgaaccgttcgaggaacaacccggcattttaaatgtggtttccggctataccggtgggcatgtgcctaatccaacttatgaacaggtatcttcgcatacgaccggccataccgaagccgttgagatcacttttgatgcagacgttattgattacccgacattgctggggatctattggcaacaaaccgacccgaccgatgccatgggacagtttcaggatcgtggcgacaattatcggccggttattttcgtgaaagacgaagcgcaacgcaaagcagctgaagcgtcgaaggcggcgttagaagccagcggacgcttcaccgacccaattgtgacgcagattgaaccggccaagccgttttatccggccgaaccggagcatcagcaattttacgccaagaatccgcggcggtacgcaatggaacatgcacaacgccaagcttttattgacaaaaactggaaggactaatcatgcatcggactttttacgaatatctcatgacattgcgcaatcccaatgaccatggggaaattgccgagtttgccaagaacgcttttctggatcaaagttttccgaaacaggagaaagattaccatcggctaagtgattacctggaattaaacggtaattatctgccgacactggcgatttttgatgaaacgtaccacgactatctggccagcgaaagcacaggaggcgattccaatcaataaacacaaggttccactgtgggcggtcattttgatctttgtagttgcgcttggcggcggtgcagtaggcggctatgccttgtcgtatcagcaggcccaacaaagcgtgctgaaaaccggcgttcctaaggcattggcacctgtcgtttccgcgtacgaaacagtcaccaacaattactacaaaaaggtgaacacgaccaagctgacagacggggcgatcaaggggatgttggggacgcttgacgacccttactcggtctatttgcaaaacaatgacaaaaccgaccttgacgacaccatctctgcttcgtttggcggaattggcgccacgattcaacaaaatcacgacagtctgtcgattgccagcattttgccaggcacgccagccaaaaaagccggcatgcaggtgggcgatgtcctgctcaaagttgacgggaaagatgtcgccaaaaagacggtcacgcaagcggttgacaaaattcgcggtaaaatcgggacgaccgttgcagtgacggtcaagcgcggcaacaagcaggcaacattttccatgaagcgcaagaagattacggttgatacggtgactggtaagcttgcgccggaaaacaagcaggttggtgtcatcacgatctccagtttcagtgaaccgactgtgaagcaattcaaagcgaccgttaaaaaattgcgtaaagaaggcgcgaagtcctttgtgctcgacctgcgtcaaaaccccggtggcatgatgacagcggctttgtcgatcagttcgatgttttccaagaacgggcaaaccgtgatgcaaatcgaagaccgtaacggcgccaaagaggtctacaaagctggcaagaagcttgatggcggctttaagattaccgagaaaaccgcggtgctgattgatggcaattcagcttcggccagcgaaatcacggcggctgcattgcaccaaaaccgcaatattccgttagtcggtgagaagagttttggtaaaggcaccgttcaaaatgtcggcgaaatgggcagcaataaggagctcaagctgacagttgccaaatggcttacaccaaacggcacctggatcaaccacaaaggcttaacgcctgacgtgaaggttgactatccggctgcggccaaaatcacgttaatcaatgcgacccagctcaagcctggcgacaaaggtagcgatgtgaaatccctgcagcaaatgttgacggctttgaaagttggttcagttaacgttaacagtcaatacgacgatgagactcaagctgccgtcaaatccttccagcaagccaacaaactcgacgcaaccggcacagccgatcaggaaaccttggcagctcttgcccagaagttgagtgatcagctgacgaaagatgatccgatggtgaaagctgcggtgcaggaagtcacgaagtaagttagattgaagttgtttaaatgcgcgcatgccttaaaggtgtgggcgtattttttgtaaagatttttaattttaaaaattaaaaaacagactggtgcgtattgatatgacctcaaatttctaaaattagtatttttcaaataaaaaaataacctaatgagggaatgctttcaaaaacgctgataaatcagctattgatagaacttgctcaagaggtaacatatgcacatttaaaaaacagggattttctttctaaacgacattggataagcttgaaataaaaggagtgaatgccatgacaaaagcaaaaggtattgttataaaaaataatcttgcagaagcaatggaacgttgtcatttttcagtcaattctttaagcatcttttcaggtgtatctcgatcaagaattgcagcattacaaaaaaatcgtaatttaaacgttacacttcagaccgcagtgcctctggccagaacgctggggctgccattttacgaaatatttacttctgagcagtcatttagatctcactgggaatttgattccaagagactcgacagcttaagaaagttggctgaagaagaaaaaatcaaattaaaactaagcccctattctcagggaaatgcacttaatttagaaacaaagtatgcaagtaatcggcgagtcagtttttctggaaatttccatactgcgtcaaagtattcagtgcgagttcttcaaatcatagattttgatgtagacaggagagattctgaagtctccttagaagagcgcgataagatggtaaaacaaatggcttgcgtagtagcaaaatttgcgaagttaaaccaaataggtattattttggtgagattaatgactccaggtattcgtattaacgccgccccaacgattgcctctttgcaaaggcaactaaataaaagtcggttactagatacctattttctaaacgattatcgaagtttttacagtttaggatttagagtcaattcaaaatcagtaagaaacagatttttaaattttgatttgactttggagaagaagatcaggatttttgagtagtgatcacttgcataagtaacatctttggagaaagccttgcgagtataggctttttcctatatcgtatggaaaacagtggaggagtgaacaacattgattgaattagaaggatttgctgtccatcctgacaaaattgcgcgtgcccaagaatggatggctttcttgaaaagtcatcaagagactgttaatgcaaccttggtgcccgaacacatcaccgttgaacgaatcttttcgctctcgtttaatgatcggatgtacctatgctggtattctgaacaaaccgcccctagtccggatgtcacagagagtcccaattcgattgataaggttcatgtcgctttttggcatgaatgtattgatgaatccattccaagcatgaagtttcggctggaaaatgaatttgttaatccgaacctgataggtaagtgaatagcctttgggtttatcatatttttaaagaactttgtttatggtgaagagacaactcgttgccctgatgagtaccaaggggagagaaagacagatggatcaacaggaaacctttgccaacaaagtattggcatttagtgaaagcctcaagcatgtctcaattgatttgcccagaaactatcgcatagtcaatccctttagcggtgctcaaaaaaatgccgtcaataagacagtgacgacattttacaaaaggtattttaatgacaccaagccgcggcgcttgatacttggaagttcacctgcacgccgaggaacagcgataaccggcgtgccttttgaagatgaagatgagcttaaaaaggagaccggtattacagttaatgaatttcgagttaatcgaggctcatcaagcttcttatacggcgttatggacaagtacggtggtaaggataaattttacaaagactttttcctaagttttgtgtgccctctaggattgatcaaaataaatgaaaagggcaatgaagtcaattgcaattattatgagaaccggcgccttcagcgagagctgttaccatttattgtgaattcactgcgaactcagattaagtttggggtgaatacggaagtttgctattgcattggaagtggcgagaactataaagcattaaatgaaatcaatcagaaagaacacttctttgaatcgattgttccacttgaacacccacgctatattatgcaatataattccagaaacaaggacttttatatgggaaaatatatttcagcattaagtagaacttgacgacacaagcgttatggctattcgacgattcggacaaacttttaggaaaaaaagagtcatcttgttctggattgaagtaagcccttttttatctgaatcccactaaacttaggctcaaagtctatgctatatctaagtggtttgctatactaacgataagctagcatcataagggtagctcccgaaagagatctagcccagcagttttgcaagacatcacccctcaactattatctgaaggcggaggtgaggtcaatgcaaaatcggagtgactggagggttcgcgatggttgattttgccatcgctgtctggatcttgtccaaggcgtatctcaattacgtcaaggctcgccagatactaaaaaagccagctcgtaagaactagctttgacccagtcttctgaactgcgcttgaggccatcgaggcgcaactcggtggcctctattcaactatagaaattgtatcatggaattcactggttgtaaaaaagatcgggaataatttgatttgagtgatgcagtgttctgaatcgcattggcagtacctgttttctcgtgtaacataagcatcggtaactttcaaaatcaagctttaaacaagctctatataactcagatataaacaagtattttgcccataaggagtctgaaaattttggcaattcaatggttcccgggccacatggcgaaggcccgtaaacaagtacaggaaaaaataaaacaagtcgatctcattcttgaggtcgttgacgcgcgtacacctgaatcatcgcgcaacccaatgttagatgagataattggcgaaaagccgcgcatggtgatcctcaataagcaagatttggcggatccggccctgacacgtgaatgggtgcaatactatcaagatcaaggttttgccgcaattgcgattgatgcgcaacatgccaaacgactgcagcaaattccgcagttggccaccaaattgatggcagagaaaattgcccggaagaaggcgcgcgggattcgtaatcccatgattaaggcgatgtgtattggtatccctaacgttggcaagtcgacggtactgaatcggctggttcatcgtaatattgcggtaactggtaacaagcccggtgtgaccaagaatcaacagtggttaaaggcgagtgataattttcagttgctggatacccctgggattttgtggcccaagttcgcctcacagacgatcgggatgcgtctggcgtttaccggtgcgattgccgacgctgtattccaagaagatgtggtcggtttatatggcttaacttattttatggcaaattacccggacgccctgaaaaaagcttaccatctcactgatacggacttgcaagcagcaccacatgacttactggtgaagctgacaaaaacgcagggattcggagaggaattcaatcgaatggcggaacggttaattttcgatgcacggcaggggaaattaggccgctttaccttggaaaagcctggtgagactgatgccgacactgagtgagtataaggcgcttttgcaagcagatcatgtcgatcccgcgatcttaacggcgctcaaaaatgatagtcgcattggtgcgggcaaattactggcggcttatcaacggcgtgaggaccatcgcgctgccgaggcggtggcgctgaaatatcgcagcaggtatgagcgccagttatggggaacgtaccagtatgttgctgggttagacgaagtagggcggggaccgctggctggcccagttgtgacggcggcggtcatcctgccgcatcattttcgatggccagtgaatgattcgaagcaactaacagcacatgaacgcaacgtgttgtacccgcacattttgacggaggccatcgcggttggcattggcgtcgctgacaatcgcgaaattgatcgggagaatatttaccacgcgactgaacttgcgatggcaaaggcggtgagtcatttacgcgttgcgccggagtttttgctggtagacgcgatgcatgtgccggtcgatttgccacaagaacggttgataaaaggcgacgccaatagtattagcatcgcctcggctagtattgttgcgaaagtgattcgggatcggctgatggtgatgtacgatcaagtttatcctggttatgattttaaacacaacatgggttacggtacgaaagcacacttagcaggtctggctgctcatggcgtcacgccgattcatcggcgaagttttgggccagtgcgtgattgtttaaactcctaaggtgtgattgtcgttaagccgcgtaatgtattgacaggaggaacttctggcatgacattacgtgactttttattaacttggcatctagtaacccatcagaatccgcgcttggcggtcgctttggaagaagctattcgtgccaaaaccgatttaacagcatttcaacgcgaacttgacaagaaaatgattcagtcggcggaaccattattggcggtagcgcggcagtcagcttacgtcacttatgtcgatgctgcttatccaccacggttgcgtgaaattccccagccgccactggtgcttttttatcgcggtcagataaagttgcttcaacaattgacattgggtgttgttggttcgcgcaaggctaccggttattcagcggccgccttagcgcaattattcccgcaactgccgatgatgacgattgcaagcggcttggcaaccggcgccgacagcacggcccatgaggcggcactcacagctggtttgccgacgattgcggtgatcgctaacggtattgatcaggtctatccggctaagcatcgtttgctgcaggaacggatcggccgcgctgggttgattgtgagcgagtacccgcccggaacagctccgcaacggttccaatttgtggcacgtaatcgaattattgccgggttggcgcatggggtgatggtcactgaagcggaaatcaaaagcggcagtctgatcacggcaaattatgccttgcagcataatcgtgaagtttttgcgttacctaatcgttttggcgagcgtttaggcgcgggaaccaatgcactaattcaagcgggcgcggcaattgtgaccggtccggatacgttgatcgagaacctgcattattacccgtgaagtgccaaaaagtgccctctctatagtaggaaaattttcatttgatttgacaagagcaaaatgactagcttatgatagcaactgttttgagccagcaggcgtgatcggatggttttaggcggaagtgtattgcgccactgtgaccgatcgtagtaacctactgaatcatgaagcactgacggtaacccgtcagcccgcacaaattaatcagggcttgctgttgtagcaatgccaccggaaggagcgcgttcatggccgacaagaagttagtcattgttgaatcgccagccaaagccaagaccattgaaaaatatcttggccgcacctataaagttgttgctagtttagggcatattcgtgatttacctaagagtcaaatgggtgttgatgttgaaaacaactacgaacctcggtacatttcgattcgtggtaaaggcgatgtcattaaatccttaaagaaagacgctaaaaaagctagccgcgtttatctcgcagccgatccggatcgtgaaggagaagccattgcgtggcatgtcagtcatattctcggtttggatccccaagccaaaaatcgtgtcgtctttaacgaaatcaccaaagacgcagttaaaaacgcgtttaaggcgccacgcggaattgatatggatctcgtcgatgcccagcaggcccggcggattctcgatcggcttgtaggctattccatcagtccgttgctgtggaagaaggtcaaaaaaggcttaagtgccggccgagttcagagcgttgcattaaaactgatcattgatcgcgaaaatgaaatcaagaatttcattcctgaagagtattggtcactggatgcagagttccagaaaggccgcagcaaaaagtttacagccagtttttacggcatcaagaacaagaaacaggccttaaaaaataatgaggctgttcaaaaagtcttaagccaggtcgataaaaccaagccgtttaacgtgaccaaagtagttaagaaagagcgcaagcgttttccggcaccgccgtttaccaccagtaccttgcaacaggaagccaaccgtaagctgggtttccgaacccggaaaaccatgatgttggcccaacagctgtacgaaggtattaatttaggcggcaagttaggcacggtcgggttgattacgtatatgcgtactgactccactcgtgtttcgaatgtcgccaaaaccgagaccagccactatctgcacgaaaagtacggcgaagcttatgccgccgttaaaatccgtcaaggcaaacttcaggaaggggctcaagacgcccatgaagcgattcgcccaaccagtacgttgcggacgcccgaaagtctggcttcggttttggataaagaccaaatgaagctatatcggttgatttggagccgatttgttgccagtgaaatgacaccggcagtgatcgacaccgtcgccgttactcttgaccaaaatgatgttacgttccgtgctaatggcagtcagatgaagtttgaaggctttactaagctctacgtatcctcgcgggataacgacgaaaaagacaatgttttgccgccgcttgctgtcggggatgccgttaaaatgctgaaaaccgatccggcgcagcattttacccagccgccagcccgttattcggaagcgaatctggttaaggcattggaagaaaatggtgtcggtcggccatcaacttacgcgccaaccattgaaaccattcagaagcgctattacgtcaagctcaatgcccgccgctttgaaccgaccgaattaggcgaaatcgtcaacagtctgatcgttgaattcttccctgatatcgtcaatattaagttcacggcaaatgttgagtccgaattagacagcatcgaaaccggcgaagccaactgggtaaaggttattgatcagttctacaagccgtttgagaaagaagtagcgcacgccgaaaccggcatcgaaaagattcagattaaggacgaaccagcaggctttaactgcgacatctgtggcgcacccatggtcatcaaaatgggacgttatggtaaattttacgcctgctcgcgcttcccggattgccgcaacaccaaggcgatcgtcaaagaaattggcgtcatttgtcctaagtgtcacgagggtcaggtggtcgaacgcaagagcaagcgtaaccgtgtcttttatggttgctcccgctacccagactgtgactttgtctcctgggacaaaccagttggccgcgactgcccggtctgtggtcacttcttagtcgaaaagaaaaccaaagccggcacccaagtcgtttgcccaaacaacgattacaaggaagctttacaaaaagcataaaaccaaaaccagcaagcccgaatcctttgggtctgctggtttttttgataaactaggcaagagcgtgagctggcgcgctcagaagtcggagtataagtggccttaggcgtgatggcccggatttaggccattgcgcctaagggtccttatacgcagacttttgcgccagcgaacgcgttttcggcagcatcggccaaaaaacttttcccacgagaagactttctctacgcccaaggcccggcaaacaagcctctgcgccaataaagcacatgttaaatgtaacatcacaaaaacccacatcaaacaaactttaagaacccccgtcccaccatcaacccaaaccccacaccaaaggaggaattcaccatgcctattgttaacgtcattggcgctggcctagccggttcagaagccgcttggcaaatcgcccaaacaggtgtcgacgtcaatttatatgaaatgcgtccggttaccatgaccccggcgcatcacaccgccaattttgcggaactggtctgtacaaattcgttgcgtgccaatcagattacgaacgcggttggactgttgaaagaagaaatgcggcgcttagattcgattattattcaaagtgccgatgcgaccgccgtgccagctggcggtgcgctagcggttgaccgcgagccattttcccagttagtgacccagaaactcatggcgcatccccgggttcatgtcattcatgaagagctgactgattttcctgaaggggtgacagtggttgctacagggccgctgaccgcaccgggcttggcggatgctattgtcgccttaaacggtgaagctggcttatcattttttgatgctgccgcgccgattttggacgccagcaccattaataccgacattgtttataaaaagtcgcgctatgatcgtggcgaagctgcttacttaaattgcccgatggaccgggaagaatttcaagcgttctatcaggcattaatctctgctgaagttgcggaaggccacgattttgaaaaaatgacggtctttgaggggtgcatgccaattgaagtgatggccaaacgcgggattaagacgatgctgttcggcccgctgaaaccggttggcttggaggatccgcgaaccggcaaaacgccgtatgcggtcgttcagctgcggcaggataacgcggcagcgagcctgtataacatcgtgggcttccagacgcatctcaagtggggtgaacaaaaacgggtcttccggatgattccgggattggaaaatgttcagattgtccgctatggcgtgatgcatcgcaatacattcatgaagtcaccggctgtccttgagccgacgtatgcgtctaagcggcgcgcggatctcttctttgcagggcagatgaccggcgttgaaggctacgttgaaagtgcggccagcggattaattgctgggacgaatgcagcccggttggcgcaagatttgccgccactggtatttccggaaacaacggcaatgggtgccatggcacattacatcactcacacctcaccaaggcattttcagccgatgaatgctaattttggtattatgccgccactagcagttaaggtacggcaaaagaaggagcgtaaccagcaattagcagaacgggccttaaccgatcttgcagcatttaaaactgaattaagacgcgtgaaccaactttaaaaataaaaaaagatctcgggtaaccgggattttttcattgtcgtgtcatgttatcttcataaaggaacggttataatgaaacaaggccaacgcttaagcaatcttggtgtccggagagcgaaaaattgccgctccctatcaatgtttggcttctgaaaacgtcaacaatcgttctttttatgttaatctattaagcggagggatgtcgggatgaagccaattgcagcttttcaggaatacttaacggtcgagcggcagtattcaccagaaaccgtcacggcgtatttaaaagacattcaggaattccaggcctttctcaaagccaatggcgggttcacggattttaacaaggtagatgatctagacgttcagacttatttaaccgatttgaataaacagggactggctcgtacttccattgcccgcaaaattagtagtttgcgtagcttttatcggtatctggtgcgaattgatgcggtcaagcgcaacccgtttgaattagttgaattgaagaagcaacaccatcacctgccgcagtttttctatgaggcggaaattcaggaactgtttaaaaccgttgaaggcaaaacgccacttgaccagcgcaatcgggcattgctggaagtcttgtatggcaccggcatccgggtttccgagtgtgccaacttaacactcaaccaggtggactttaatacagggttgttactgattcatgggaaaggcaataaggatcgctacgtaccatttggtcagtacgcccagcgcgcgttacaaacttatctaaaggatggacgccacacgttgatgcagaagcaccagacccaacatcgagtggtgttcgtcaaccagtatggtcggccgatcacagctcgcgggattgaatacattctggatcagcttattaaacagacgagcctgactgccaatatccatccccacatgttgcggcatagctttgctacccacatgttggatcacggagcagatctacgcactgtccaggagctgctcgggcatgcgagtctgtcgacaacccagatctatacccacgtgacgatggcccatttaaaaaacgagtatatgaaatattatcctaagcatcattaagactaaagtacgatgtaatcggtgcttgaattttctaaagtatgactattggtcggttgctaacaaccgccaccgctgatgagtttcaattcatcagggggaatgaaaaggagcataacaatgacaacaattgcagcagttagaaaagatggcgtgaccgctttagcaggcgatggccaggttaccttgggcgaaaaagtcattatgaaaggcaacgcccaaaaagttcggcgcatttatcatgatcaagttgtcatcggctttgccggtggcgttgccgacgcgttcactttacaagattggtttgaaaagaagctcgagcactatgccggcaacttacggcgttccgcagtggcgctggcacaggattggcgcaaagatccaacgctgcaaaagctcgaagcgatgatgatcgtcatggacgaacacgacttgttgcttgtatccggctcaggggaagtcatcgatccggacgaggatgtcgtggcaatcggctcaggcggtaattttgcccaagctgccgccattgcgatgttgcggcatgcgcctgacatgacgccggccgacattgccaaagaggcagttaatattgccggtaacattgacattttcaccaaccacaacattatcgttgagagtttctgactaggccagagcacgctcacaggaggtttaaaatggtagaggttcaaacacctaaacaaatcgttgaaaaacttgaccaatatgtcatcggtcaggacgatgccaaacgcgccgttgcggttgccttgtataatcgctatcgccggatgcagttgtcacccaagatgcaagaagaaatcacgccgaagaacctgttgatgattgggccaaccggtgtagggaaaacggaaatcgcccgtcgattagccaaaattgtggacgcaccatttgttaaagtcgaagcgaccaaattcacggaagtcggctatgtcggtcgggatgttgaatccatggtccgtgatcttgctgaaaccgcagtggcgatggaagaagaaaaacagttcaagaaagtccgcgttcgcgccgaaaaggaagccaacaaacgcctcgttaaaattttggtaccagcgattcgcaaagaaaagaactcgaatccgatggctgaaatgatgaacatgttacaaggtatgcaaaacggcaagacacctgctgctgacgatgccgatgctggtggcgaagtgaccgatgacattcggaacaaacgcctgagtgtcgctgaacagctggagaaaggcttgctagaggatcgggaaattaccgttgccgtcaacgacgagaaaaaaggcggcggcatgagtgatatgtacggccaaatggggattgacttaagtgatacgattggtgcgttaatgcccaagaaaaaagtcgagcgcaccatgaccgttaaggaagcccgcgaaatcttcattaaagaagagtcggataagctggtcaaccatgccgatatttatcacgacgccatccagagtgccgaaaacaatggcattatctttattgacgaaatcgataaaatcgctgcaggcgacaagcataccagtggtgaagtttctcgcgaaggggttcaacgcgatattttgccaatcgtcgaaggctcacagattaacaccaagtatgggccaatcaacaccgatcatattttgttcatcggttcaggggcatttgctgaagccaaaccgagtgatttgattgccgaattgcaaggtcggttcccgatcagggttgagctaaaagatttgaccgaaaaagacttcgtacggattctgaccgaaccggacaatgcgttgattaaacaatatattgccttgatcggtgctgatggcgtgaaaatcacgtttaccaaggaagccgttaatcggattgccgaaattgccacgcaggttaatcacgataccgataatatcggcgcgcggcggttagcaaccatcttggaaaagctattggaagatgtgctttacgaaggtccggatatggcaatgggcagtgtgacggtgacccagcagtatgtcgatgataagatcggccatatcgctgccgatacgaacatgacccggtatattttgtaaggcaacccgtggagaactgtagataaaggatgaggatgtatggtaacgattgcaaatgactttttgaccgttgacatcagtcggcatggtgccgagctgactagtatcaaggataacctgactgggcgtgagcgcctgtggcaggctgatccggaagtctggccgcggcacgcaccggtattattcccgattgtcggggcactggctgatgaccaatatcattatgctggcaaaacttaccacatgacccagcatggctttgcccgtgatcgtgatttcacagtcgtgtcggcaacgccttttaaggccagccttgttcttaaagatgacgataaaactcgcgccatgtatccctttgcgtttcggctgatcatcacctacgcattggaaaacaataatctgcatgtcacttaccatgtcgataatcctgataaaacggctcctttatacttcagtgttggcggacaccctggtttcaaggtgccgatgacagcagacacgcagtttacggattattacatgaacttcaaaccgcgcaagtcgcttgttcaaattccgctggttgccggcaaaggcgtggattatccgcaccgaacgctggccgcaactgatgccaatctggcgctgacccatgagacgtttaaaaatgatgcactcatctttgctccgcttggtaagacctcgtttaatctgctttcggacaaaaccaaacacggtgtgagtgtcaccatgacagacacaccttacttaggcgtatggagcccctatcccaagacgggtgagtttgtttgcattgagccttggtggggcatcgcagatacgattggcacgaccggcgatttcaccaagaagctgggcatcaatcgtctcgaaccgggaacggcgtttgaaaagggctacacaatcagcattttttaattcggtaggatagctggtgatcgataacaaaaagacatccaacaggggatgtctttttgcgtggtatattttgtgttctttactgctggcgacggtgttgccgtaagtaaaggccgaggccaaatgggaccatgttctcgtcgcccgctttgatgcgcttaaaattggcccgatgtttaatgaagaaaacgacaagcagaccgcaagccacggtggtcagcaaccagtcgtgataaacaagcgaccagcaggtgataatgaccatgccaagtgtactggcgacactgaccatggacgttagcaagatcagactaaaccagatagcaaaggcaatgaagaagaattccggattatacgcgagcaaaatgccggcactcgtcgccactgctttgccacctttgaaatgaatataaatcgaaaaggtatgacctaagacagccgccagcccgacaatcagaatcagccagtggtggtcaattccaaacaaaatcggtaaactggctgacaacgttccttttagaatatccaatagcaacactagtgttccgccaaccggtcctagcattcgataagcgttggttgtcccgatattatggctgccacctttgcggatgtcggtatgataaaatactttgccaatcaccacaccaaacggaatggcaccaatgaaataagcgagtataaaacaaagcacaagaaccaagtgtgcccctcctctcagacttaaaaactattttagcatttttgacttttgagtgatacgccgttaagataatgcgaacacacattcgatttgcaataatgggttaaatgccctagagaaacgtcaacgcagactttttatggacgtaaaggctacactggaaatacgtagctcataaagcggctgcgtgcgaatgttggccgagatcgtcttcgtgccgttttctaagcattttttagtcatgctttgttcgcgctctgcgggtgcgtggtgtattctataaattagttgtttcaaaaagggagtttattatggacaaagcaacgcaagcatataatgattcatccattcaggtgctgcacggcctggaagccgttcgcaagcggcctgggatgtatattggttccaccgatggccgcggattgcaccacttggtttatgaaatcgtggataactcagtcgatgaagcgctcgcggggtttggggacgaaatcaatgtaaccattcacgccgataattcggttaccgtgcaggatcatggacgggggatgccgacggggatgcatcccagcggcaagccgacgattgaagtgatcttaacggtgctgcacgccggcgggaagtttaaccaaaatagctataaaacatccggcggtctgcacggagtcggttccagtgtcgtgaatgccttatctgaatcactgaccgtgcgggttgtccgcgacaaacgggcttttgaggagcacttcatcaacggtggtcatccagacggtggtttgcaaaagctaggcaaagtgaatgaaccaaatggcaccacaatcaccttcaaaccggatccgacaattttccagaccacggttttcaactatgatacactcgccgaacggttgcgcgaatcagcctttttgctgaaaaatattacgattaacttaattgacgagcgcaccggtaagcaggatcagtaccactatccggatggcttggtgagtttcgtcaagtatcttaatgaaggcaaagatgccttatcgcaggtcatcaattttgaaggcaaaaaagacggcattgtggttgactttgccggccaatataatgatggctattccgaaaatattatttccttcgttaacaatgtgcgcaccggagatggcggcacgcacgaaatcggcctgcgtagtgggatgacccgggcgtttaatgagttcgcacgcaaagtcggcttgttgaaagacagggataagaaccttgaaggcagtgatgttcgggaaggcttcgccggtattttaagcgtgcggattcctgaagaaatcctgcagtttgaaggccagacaaaaggcaaactgggtaccccgcaagctcgcacagttgtcgacggtattgtttacgaaaatctttccacgtttttgatggaaaatggggaagagtcccaggaactcgtacgtaaggcgattaaggccagggatgcccgcgaagcagcgcgtaaggcgcgcgatgacagtcggaccggccgtaagcggaaaaaagatcagggactgctctccggtaaattaaccccagcacagaccaaaaatcctaaacgcaatgaactttacctagtcgaaggggattcggctggcggctctgccaagcaagggcgggatcgcaagtttcaggcgattttaccgttgcgcgggaaagttctgaatacacaaaaggccaagctgcaagacatcgttaagaacgaagaaatcaatacgatgatttatacaatcggtgccggtgtcggcgcggattttgacatccagcaggcaaactacaacaagatcattatcatgaccgatgcggataccgatggcgcgcatattcagattctgttgctgacgttcttttatcggtacatgcgaccgttgattgatgccggacgggtttatattgcgttaccgccgttatatcggctgcaaaaaggtgctggggctaaaaccaagatcagctatgcctggaccgatgaagagctggctaaggaaaccaaggccatggggaagggctatacgctgactcgcttcaaaggacttggggaaatgaacgctgatcagttgtgggaaaccactatgaatccagagacgcgcacgttgattcgggtgcggattgacgacgcccagttagccgaacggcgcgtgacgactttgatgggcgatcgggtcgaaccccggcgtgaatggattgaacatcatgttaagtttgacatggatgacgacggtagtattttggagacaccgacagccaaccacgagaagttgcagtttggtgccaagcaaatcgttaaacagttagacaagaaaggaaagtaaaagccattggccaatcagattcaggagttgaccttagaagaggtcatgggcgaccggtttggccggtactcgaaatacatcattcaagagcgggcattgccggatgtccgtgacgggctaaagccggttcagcgccgaattttgtttgcgatgaatcaggatggcaacacttacgacaaaggttttcgtaaatcggctaaaagtgtcggtaacgttatgggtaactatcatccacatggtgatagttcgatttatgaagcaatggtccggctcagccaggattggaagttgcgggcaccgttgattcaaatgcacggcaacaacggatcgatggacggggatccgcctgccgcaatgcggtacacggaagcgcgtctgagcaagatcagtaaagaaatgctggcggatatcgacaaagagaccgtggatatggtccttaatttcgatgacacggcgcaggagccaacagttttaccggctggatttcctaatttgttagtcaacggtgcgaccggtatttccgctggttacgcgaccgaaattccgccgcataatttgcgtgaagtagtaaatgccattttgtacctgttaaagcacccgcaagctgacctaaatgacttgatgcaatatgtcaaaggcccggattttccaaccggtgggattattcaagggcttgacggcatcaagcaagcatatgaaaccggccgcggcaagattgtggtgcgttcacgcacgcatatcgaaaccatgcgtggcggacgggaaaagattgttgtcaccgagattccttacgatgtcaataaagccttgatgattaaaaaaatcgacgaactgcgccttaataagaaagtcgatggcatcgccgaagttcgggatgaaagtgaccgttttggtttaagcgttgtcattgagctgaagaaagaagccgacgcccaaggcattttgaattatctgttcaaaaataccgacctgcagatcacttataactttaatatggttgccatcgccgatatgcagccaaaactgctaggtttaaagccgatgctggaagcgtatgttgcccatcgccgtgatgtcgtcactcgccgcacgcggtatgaactgaacaaagcacaggcacggcagcatattgttgaaggcctgatcaagatgctgtcgattttggatcaggtgatcgcggctattcgagcttctaaggataaaggcgatgccaagcgtaatctggttaagcagtttgacttttccgaagcgcaagcagaagctatcgtgtccttgcagttgtatcgcctgaccaataccgatattactgccttacaaaacgaagcggcgcaactggctaaggctatcgctggttatcaggatattctggcgcggccggccgcgcgtgatcgggtcatcgagcaggaactcaagcggattgccaaggaatacggggatgatcgccgtagcagcatccaggctaaaattgaaacgcttgaagttgcaacgacggtgacggttgctgatgagccagttatggttcaagtatcacgggatggctacgtcaagcgcagttcgttgcgcagttaccaggccgttgaccctgacgataacgggctcaaagcgaatgatttggccattttcactggtgagttgcgcacgctgcagcacctttatattgtgaccaatgccgggaacatcatttatcggccggtttacgaaatcggtgatgcccgctggaaagatactggcgagcacctgagccagacagtcggactgggtaccgatgaaaaggtattggcagtctttgcctttgatcagttggacattgcaggtagttttgttcttggttccagtgatggctatattaaacagacagcgctgagtgatttacaaccacaacggacctataaacgtaaaccgatgctggccatgaagcttaagacggctggtgcggtggttacgaatgcttatttcaccactgatcagtcacaggatgtttttgttgtcagtcaccatgcatacggattaacgttcccgttagccgatgtttcgaccgttggcgcgcgagcaaccggcgttaaaagtatggatctaaaaccggatgacgaggtcgtcaattttattctggttaagaatccgcaaagcgcggtcgtcgggattctgacccaacgcggtgcgttcaaacggatggcattaagtgaagtcggcgaaatgagtcgggctcgacgcggtctgctggtcttgcgcgagcttaagcgtgatccgcatcgcatcgtcgccatgatggcagttgatgtgaatacccgcttggatgtactgactgatgctgacaaagttgttacgctgacgccgagccaacacccaaccggtgatcgttactccaatgggtcattcgtcattgatacggatgttcaagggacaccggtctttgtccgtacccgcgaagagattccagaaaaaaatgaacaatagattgaagggtagccgttcctgtattaatacaggaacggctatttttacttattgtagtacagataagttgtgcacgatttatcaaattcgcggtctactaatttttatgaaacagttaagtacactaaaaaaacaaaagaacccctgttatataggcaataaaacgcttgcatagatcccgcaccgtgttatactgagtttgtaagaactgtcacatctgtaattcactttaggaggcaaacacctatgaaacagcttgacgaaaccaaagttcctaattattgggaaggctttaacggcggtgactggcaagaagaaatcaatgtgcgcgattttatcgagcataacctgaaccaatatgatggggacgagagtttccttgctggccccactgaagcaacaactgttttgaacaatcaggttctgaacttgaagaagcaagaacgtgccaatggcggcgttttggatgcagacaacaacattccatcaaccattacgtcacatggccctggctatctcaacaaagatctcgaaaagattgtcggcgttcaaaccgacaagccattcaaacgtgcattcatgccgtttggtggtattcggatggcagaagatgcgttgaaagcttatggcttcgaaaccgatcctgccgaacacaaaattttcactgaatatcgtaaaacccataaccaaggcgtctttgatgcttatacgccggaaatgcgcaaggctcgtcactacaagatcgtgactgggttacctgatgcatatggccgtggtcgaatcgtctcagactttccacggattgccatctatggtatcgatcggttgatggaagaaaaggttaacgattataacctgactggcgacggtgaaatgaccgatgatgtcatcaaactgcgcgaagaaatcaacgaacaatatcgtgcgttaaacgatatgaagaaaatggccaaagaatatggctatgacatttctcggccagctgcaaatgctcaagaagccgttcaatggatttactttggctatctggcagccgttaagacgcaaaatggcgcggcgatgtccgttggccggatcgatacggttatcgatgcctacattcaacgggatatgcgtctcggcaagttaaacgaagaacaggctcaggaactgattgatcatttggttatgaaattgcggatggttcggttcattcggactgaagaatataattcactcttctccggcgatccgatctgggcaaccctgtccttggctggcatgggtaatgatggtcggcatcatgtcaccaagaccgctttccggttcctgaagaccttagacaacatgggtgcagcaccggaaccaaacattacgttattgtggagcgaacgcttgccagaaggcttcaagcgctacgcaactgaagtctccatccaaagttcaaccattcaatacgaaaatgatgatctgatgcgtaacgaatggggcacggactattatggcattgcctgctgtgtatccgcacagccgatcgctgacggcgttcagtactttggcgctcgggcaaacctggcaaagaccgtcttatatgccatcaatggtgggaaagacgaaattcaggaagcacaagtgggtcctgaatatgaaccaatcaccagtgattacatcgattacgacgaattcatgaagaagttcgacaagatgatggactggttagctgacgtttatgttaatgcgctgaatgtcattcactacatgcatgacaagtattactacgaagcagcacagttggcattgaaggacacccggctgaaccggacgtttgcaactggtatttccggcttgtcacatgcggttgactctatcagtgcgatcaagtacggtcatgttaaagtgattcgcgatgaaaatggtattgcggttgactttgttgctgacaacgacgactatccgcgttatggtaacaatgacgatcgggccgacaacatcgctaagtggttggtgaagaccttctacaataagatgaacacccatcatctgtatcgcggtgccaagttgagtaccagtgttctgaccatcacctccaacgtggtttatggtaagaacaccgggacaacaccaaacggccgtcagaaaggcgaaccattctcaccaggtgccaacccggcatacggcgcagaaaagaacggtgctttggcttccttgatgtccaccgctaagattccgtatcactacgcaactgacggtatcagcaacacgttcggggttacaccaaataccctgggacatgatgatgaaacccgtaaggataccttggttcacatggtcgacggttatatggagaacagcggcatgcatctaaacatcaacgtcttcaacaaggaaacgttgatcgatgcacagaagcacccagaagaatacccaaccttaactgtccgggtttcaggctattgcgtatacttcgcggacctgacaaaggaacagcaggatgacgttatcgcacggacattcttcgacgaaatgtaatccagtcaactcaacatcaaaacaggaaatcattcctgttttgtcaaaagacggcaacgttgctgttgccgttttttgacaaactgaaatgaaaatcgtttgaaaactatcagcatactagcagtggaggcggcatagatgaaacttatcgatcaatcacaaagcccgttaaacattttggaacaggtcgggcaggatcatgaagggccaattaagggttacgttcactcggtcgaaagcttcggctcagtcgatggacccgggattcgctttgtcgttttcatgcaagggtgccgtatgcggtgccaatactgtcacaatcctgacacttggaatatcggcgtcggtgaggaaatgaccgctgatcagattttggcggatgcacagcgttataaggctttctggggcgaacaaggcggtattacatgcagtggcggggaaagtctggtgcaaattgactttatccttgagctctttactaaagccaaggaactcggcatttctacttgtctcgatacgtcaggtggcccattcacccgcgatcagccttggtttggtcagtttgagaaactcatggcggtcacggatatttcattggtggatattaagcacattgattcggctgagcacaagaaattaacgggattcccgaacgaaaacattttggatatggttcagtatatgtctgcccacggcgatgatatgtggattcgacacgtgttggtaccacaacgtaccgattttgatccttaccttaaacggttaggggattacatcgcaacgttagacaagcatgtggttcaaaaagtcgaaatccttccttaccacacgctgggggtcaaaaaataccatgaacttggcattacctatccactggaaggcatcgaaccaccatcagcagatcgggttaagaatgcggaaaatctgttgcatgtccaagattacactggctggcaaaattggcgtccgcgtccggctaccaaggcgtagtttagttagaacttaacgtaacgattaaaaacgcggcaaatctgttgcgttttttttaaatgccacttatcatgataaatgatcagtattataaatttataaatgaaagggaagccgccccatgaaaacgaagcaagagcgcattttctcctcgaagactctcacgtattttctgcaacttgcagaaacaatgaactacacccagtccgctcagctgttgggcattacccaacctgcattgacgcagcaaatcaagaagctggagcggacagtgggggcgccgctgttctactctgttgggaagaaactgcatttgtcggatgccggtcagacaatgttgaaggcaacccacgagatctatgagatcctgaaccagacgactgacgagattcagcaaagtaccagcgcaactgtgggtaagattaacattggcttgttgagttcgattgaagacagtgcctttaacgccttcattgcgcattactatgatttgaatcccgaagttgaaatcactttgcggatgatgacccgtcacgaaatttgggaagcattagaaaacaatcaggttgacttggcgattatgaatctgcctgatgagacgatcaagaattggaaaccatacgccagcaagaaaattcttgatgagcaattgctgtttttacatcatgacgattcgttggcaaaccgtaagcgccttcattttaaagatacgcttgctgaaccatgggttacttatccggatgattatttcctggggcagatgcttcacgaagcctacaagaatcagatggttgattttccgcatgtggtggcgcactttaccacgccatatcaacttacgcagtttgttaatcacaccggcgtgaatactgccttgccgacgagttttgtgacggcccacgctgatcaaatcaaagcccatgctgtttcattcgaaccggccattcgctttgagacctcattcgtttatcgaaaagaaaaggctgatattccgcggattgccaacttctttaagacgtttgacgcctatctggcagaaaaagattatctgtcgcgggtcggcgaaaacagtggtaagattgaaaggtaaatattgagctgaggagcgatcaattaatatgacgactttgatttttggacatcaaaacccagatacggatgcgattaccagtgccatgagctgggccgagtttcaaaagcaggcgggcaacacagatgttgaagcagtagcactcggtgaaccaaatgatgagaccaagtttgtcttggatcatttcaaggttcaagcaccgcgtgtcattaaaaccgcagcaaatgaaaccgacactgtgatgctggtagatcataacgaatttcagcagagtgttgctgatatcgaggacgtgcagattgcgtcagtggttgatcatcaccggattgcgaactttcacaccgctgcaccgctgttctatcgcgcagaaccggttggcagcacgaacaccgtgattttcgaactatttcaggaacacggctacacgatctcgccaacattggctggcttgatggcatcggggttgatttccgacacattgttgctgaaatcgccgactgccacggacaaggacaaaaagattctgcctgaaatggctaaaattgcggggattgatttgcaatcgtacggtttagccatgctgaaggctggcactaatttggctgctaagtctgatatggatattatcgaaggcgacgccaagagcttcacaatgggcggcaagtcgatccggatcggtcaggtcaataccgtcgatctggatgacatctatgcgcgtcaggatgatctgttgaacgccatgaccaaggaagcacaggcaaagggttatgacgacttcctgctgatcgcgacggatattttgaacagcaactcaaccggctttgctgttggtgctgaccgcgataaagtagcggcagcatttaacgaaaagttcgatacgaacgctcgtttggcattgcctggagtagtttcacgtaaaaaacaagtcgtgccaccgatgcaaaaagtatttgaaggttgatctgtccgttttacgaatatagttaattaagtcgcagctgaacaccttggctgcgactttttgtgttgtttaagttggcaagatggtagagcacttaagctaaactgagtgactcgttcgattgaaagcagatgtcctgacgatgatgatcaaacgtggttagcaaatttttgtgaaccaagatttggtgtagacttgattgactgtatgtgtgccggaaatttacgagcggttaactgatcggctcaatgagcacacgagaatgctagatttgcgtaatttgagtgaacctcctggaaaatatgcgaaatcaacgacctacatactacttcgtataatatatattatgtaaactagaatggagaatcagggaacggcacttttcgctatattttgccgggcagtaaattcttcctagtacactcccccactcgtggatatcggaaattttttaacagcaacgagattggcacaaaagcagcggtttgattcgaggttaagaatttttcgcaaactttatgtacgataactgatcagcaaactttatgcagatgttttggcttaaacggacatttatcggataatcagtaaatttgcccagactggcagaaatcaatcaattgttgcatgattgccacttttgtgatggccgcatattttggctgatagctgattcatgatgaattgctgaagcttgttcaaaattgtagccaaacaacaaccaccaactgaatttttccagtagcaagcagcatccagtgctgcagacggcgaattttaaagttcgaaagttcggtggtgcgagcgagtttccatacataaattcggatcaataaacacgtttaagaattaacgggatttggcgaccttaaccaggctttgacgtttacctttggataaagctagaactttattcaatacagtctcacatcattttgccgaaacaagctgcgttaaatcgcggttaagtcgctcatcttcctcggcatcagcctcttttttcaggtatactagcattatctagaagaaaacatatgttcgaggtgatgttgattgtcgactcagaattatccaaaattaatccacgccatgctgccctctttgcctgactacattcaggactactatcacagtcaaaaagcaattccgattgctgactctaccctttaccagtatctgcatttttatcaggaatttcttgaatggctgatcactagcggcgtgacgaccgccacttccccgcaatctgtgccgcttgaaacgctggaacacctttctttacgcgatgcgcaggcttttatggcttatctgctagagcggccttccaaaacgcatccaaataaacggatgacgcggcgcagtgttgccttgcgattggtgggcattaaggcactttatcgatttttgaccgaggaaagtgaaccgcatgaagacggtgagccttacttttaccgcaatgtctggaataaggttaaattaaaaacccatgccgagacgacggcttatcgcaatcacaaattgcaggaaatgctgtttgtggacggtgaagatgctaagtttttgcattggctggatcaggtttatgcccatcagttaccttcgaagcaacgggcttactttaatgcagccaaacagcgcaacttggcgattattgcgttgctgtttgggtctggtgtgcgtgtgagcgagctggttaatatgaatctggaagatttgaatatggaccgacacacggtgcaggttgtgcgcaaaggcaattttcaggatcgggtgaattttgcggactggattgacccctatctcaccgcgtatttacaacaacgtgcggccattattgcctatcaaaagccgacctcgccgctgtttgtaacgcaggtcggtcaaactgtgaagcgcattcgccaaaatacgatcgaggctttttttaaacgttacacgacggcttatggtcgaccatccacaccgcataaagcgcgacatactttagggacgaatatttatacggtgaccaaggatgtgcaacaagtggccgatcagcttgggcagacgacgacaagtgcgactgatctctatattaacctgagcgataagcgcgggaaagctgcgctgcgtgaggtttctgaaacagcagccaaggcgttggatcggcacacccaacaaccgcatgaaaactagtgcgcctgaattagcctagaagggtgttattcaggcgtttttgcatggacaggcttataatgaagccagttagcataagggtaaatagaaaggcgtgattcattgtgttggatgttaaggattcagtgaaccggctggcttggaccaccgagcaccattttctgcatattcaggcgcggcatgatttcatgcgggcttgggccgttcaattcgaaatggcttatacggattttcgggtgattcagatggccttacagcttggcggtgagcagtatcatgatctgctaaagcggtttgcggctgcctatgaagcagtttatccattcgaatacgcatttgcggcaggtggccttgccggttttgatgagcaattcgccgataaaatggccgattatcaaaccgctgaacaaaacctgcttaagctgattgccgagattaaagccttgcagccggcttgagacataacaactaaaaatgccgtttctgacagtatcgttgtagacaaacgatgggtcaggaacggcacttttttagagttttggtggttaccggactatcaccagcgtccccttacctacctgcgactggttggctggcggcgggaaacgatgcggtaataaacattgccggtcagacgatacattaacacgtagatcacggcaaaaatggctaacgtgatgagtgaaacggtcaggaagaattgccaatcaggcaagccaaacagcatcatgattcgctgcacgaatggcaaggcaaagccaacgtggatggcagcgacgaccaacggcagataaaacagcatgagtagttggctgttgatggttgaccgcacctcgcgcaggcttaagccgactcgctggagaatggtgtaacgccgctcatcagcataaccttctgccagttgcttgtaataaagaatcagcaaagttgccaagataaacgtggcaccaaagacgatgccgagaaacagaaagctgctcatcatgctggcggtatcgtcgtagttgacggcgcgggactgaacagtgtcaggaagtgcgatgccacttttgtttaaatcttgatacagcttagtttggttgacatgactgccgctcaacattaaatcctgattcgtggtgacatctgttttaagctcggccatggtctttttcgggtacaaatgatgcaatgccgcgagcatttgtgtttcagatggaaatgcgacgaaaagattgggaataaacgttttcggtgcattgggaaagcttgaaacccgcgttgcgacatgataagtttgcttcccgattgtcagagtattgccagcgaaatgattggacgtgtaaataagaatattgtttccattcagcgaacggtgttgtccagtgtaacgattatagttcgcaatggtcatcaactggacgctgcgggcattgtcaaagccaaacggtccgttgatactgctttgggaattcaaccggtttttttcaagcaatgccaacgtgctggaagggccagtaaacgtgcgaattgaccggatacggacgtgatgggttttggccagctcggtgacgcgattggcagcttcggcatcatttgttttaagggagtatgataagtcgactggcgtttgtgcgttaacgatttcattgatgccaaagaaaagcgtggcggtcgtggccagcgtaatgagggtcatggtcaccaaaatggcaattgatgctaaaccggcgccgttttgttgcattcggtaaagcagattcgagacattaatgaaatgcttaggctggtagtaatagttttttcgacgccgcagccattttaagacaaaaaccgaacccgacgtgaataagccatatgttcctgtgatgaccagtatgaccgcaaagaaaaacatactcatggcttccagcggattggtgatgacaacggccagtgtatagccggcgattaaacatacaaggctgaaaatcagcgtgaaccacgcaatcttcggttcccgctcaccggcgctttgttcgcgaacaatgtcaattggctgcttgcgaataagccagatttcatcgatgaacattaagatgatgaagagtccgattgtgatgatgccggcaatgctgaaggcttgttggctcagaccaaactcaaggtggtggttgacatgcagcaccttggccagtgtcagatagctaatccgcgacaggactgttcccaaagcaccgcccaatagcaatgttgccaacagaagcagcaatttttcgatggccatcattttgctgagttcgcctttaccaaaaccgatgatgttgtacaaaccgagctggcggatacgttgcttgcgaagaaaattgttggcataaatcactaaaatgacggagacgattgcggtaatgaccgagccaaacatgaacagcgatctgcccgccgaagcgccaaactcgctgaacagaacatcactgctggcataggcatttagcatgatcagattgatcgccattaggaagctggtggtgatgacaaatgggacaaataagcggcggtctgctttgaggttggtggcggccagtttgaaatagaatttcattgtccttcgccttccttcgtcagcatcgccgtcatcgtctcgctgattcgggtcaggaattccggttgatcaagttcgccccggtaaagttgatggaaaatttggccatcccggatgaaaagcacccgcttgctatggctggcagcaatggcactatgcgtcaccatgagaatggtttgttgactctgggcattcacgtctgtcagcaagtccaagagttcgctcgaagttttggaatcaagcgccccagtcggctcatcggccagcagaatttccggttcggtgatcatggcgcgggcggcagcgacccgttgctgctggccgccggagagctcgtacggatacttttgtaagaggtcgctgatgcccaaccgcggtgcgagtttagccaagcgctcgttcatgacggctagcggcttttttgccaaaaccagtggcagaaaaatgttgtcttgcacgttgaaggtatcaagcaagtcaaaatcctgaaaaataaaaccaaggtgctcccgccggaatttagcacgtgccccttctttaactttgcggagatcctggccgttgagcgtgatttcaccgcctgtagggttatccagtgtcgcaatcaggttcagcagcgtacttttaccggatccggattcccccataatggcgacgaattcgcctgattcgactgtaaaactgatattaaccaatgcttgaacgggttgggcgccccgacttgtataggttttttcgacattttttaatttaagtaacgttgacatacgatcttcccctttcactgactagcttaaaagggatggcaccctaaaactacttacagtcggctgcgattgcttacaagctggtaagctggcttactctgccagccatcgggtttggggaaaatgaatcgcaaacgtactgccaacgccgacttttgacgtcaccgttaaccgcaagcctaatttttcggcgatctgacggctaaggaataagcctaatccgctagccttttgcgtggcgcgcccgttatagccggaatacccctgttcaaaaatccgcggcaggtcttctggcaaaattccgatacccgtgtcggcgacaaaaacggcatccccttttgcgtaaatccggatggacccgcgcggcgtgtatttaatggcattcgtcaagagttgttcaaaaataaaccgcagccactgactatcactgacaacggttggcaatgcttagacggagaccgttaaatccttggcaataaacaatttagccagatcgcgaacggtttcgttgacgagtggttttagcgccacttcggttaaaaccagatcggtgttgagggttgtcagtttgaggtagtttaacatcaccgtcagatagcgattgattttgctgatttccagccgtgcatcgtttgcattgaccggttctacctgcagtagcaaatccaaagccgttagcggcgttttgatttggtgcgtccacaactgcaaggtgtctaacatttcctgctcgcgatcgcggtaggtgtcgctgttttttcgcacagtttgttgcaaagactggattttttggtaatacgcgcggcccaacggatcggtgatttgggtatcgtccagcaacgagacatccgcttgtaattgctgccattcccggttgaaacgccacaaatcgtaaccgccaatcacgagtaacggaataagggcgaacagccacatattaagaatgacctcaattgagacattaaccagccaatttgccaatagaccggtcagaagcaacgtgagcaggcttaaccaaaccatccagcgtgcatggtaataagccttaatcatggccggcctccttgctggctaaccggtaacctttgcctttgactgtttcgatcagttgcgccaggccaaccggtgcgactttcttgcgcagccgattcatattcacggctaatgcattgcggtcgataaactcgtcaccttcccacaatttttcgatcatggcttcgcgggtcacaacttcgccattggcactaaacaaaaggctcaacaatttagtctcagtgggtgtgatatcaagcacgcctgctggtgagcgaagctgattatcggttggtaccagtgtgaaatcgtcgtgggttaaattagtctcggtttgctgatactgataagtccgccgcagcatcccctgaatcttcgccaacaaaaccggcaattcgatcggtttggccaaaaagtcgtcagcacccaggttcatggccatcacgaggttcatatcatcgccggaactcgtcagaaaaataactggtacgttgctgtgcttgcgcagctcactcagccagtgaaagccgttaaaatatggcagactgatgtccataatcacgagatccggtgccgcggcgcgaatttcttcgtcgacttggtcaaattttttaaccaggctgaccgtgaacgcccagcggttcaggtaattggcgatcgttttagcgatcacatcgtcgtcttcaacaataaaaatcttttggggcatgctcattgcgctcccttcgtggtgattcgtgggtttttttgatcttttgatttacactaaagtcagtttctattttaactgatttcaggtgtttaagttgggacaatcaaaaatcggctggcaaggacaaactgcggcctttctgttaagtcaaaatttatttgttttcggtacgtcaaccgtcttttttgcggtgctttgggacattgccttaaaaacgtcttcaggcgcgtggatgacgtatgtatcattggcgacttcgttaccggcgattttaatctccttatccgctggagttttggctgataggtacaatcgaaaatggctgattgtcctctctgccgttgcggtcacggttttgaccctcgctgttgcctacgtgtttgcttttgtgactcaggagctgtggctgttgctggtgattgccgtgatccgcagctttggcaacggactggaaaatccggcggccaatgccttactgccgcagctggtgccagccaagcaaattacgcgggtgaatggctacaatcaaattttgatggcggcgatgctggtgatgtcaccgttgttggcgggctatattttaagcgatctgggaatcttctggatattcgtcattgatgctttgaccgcggcgttggcagtactttgcctaggggtggttcacgtaccgacgccaactgcgcgccgggatcgagccagcaaacggcaaaatgggatcttggccggcctgcgttacgtggggaatacaccgttgctgttggcgttcatgttgtttaccggcgcggcctttattttaattgcgccatcctcgcaactatcaacgttgtatgtgaatcggacatttggctcggaagtctggcatttgacgttcaacgaatggtcgtggacgatcggtgctggcttagggggcctgtttattgcccgccacaaaaagtttcgcgatcagcttggcctcatcgccattggctttgccggcagcggtattgcgtttgcggaaatggggctgaaacagccgttcatcacttatctgttcttcatgtttatttccggtattttttatccgttgattcaagccggccagacgatttatctgcaggagaatgtaccagcagataagttagggcgcgtcttttcgttatgggcaatcctatcgaccggtatctatccgctggcgatgttggcatatggaccattggcagattgggtgccgatcggatggattttcatcgtcaccgggctactattaattggcgttgcttactggttctggcagcggttaaaaaaattgagttggtagcgatgcctactgctgatcacgatgtattcaaaaatgcctcatcacgacgggccgaacaacggcacttcatgtgtgatgaggcgtttttctattcaagtttaaaatcgctgaagagctgctggcaaaagacgccagtggtcagtcatcatgacccaccagcagacgtttgcgagcaatatgtttatttaaaaaaggtgactttacttgctgggattcgataaagtgagtccggcgcattctttggcttacccaccgcaataagcagcgttggcatgaaatgctcaggatcaagatccaatgccggtaagatcttctcgtgatcaaagccggtcatggcgccggtttcatagccataggcgcgcgcagccaacatgaaggacatggcggacagactgctgttttgaatgatgaattcacgcaacgcctgtttgtcggtttggaaagatgccaccagattttcgatcatgggtttttgatgctcaacggcgcggtcggtcagcaagcctgctgccgctgctcgcttgaacagttctgcttcaaatggccctaaatccagttcaccaccgacaagcacaaccgcggatgcggacagaatttccggtgcattagttccagccacgctggcgattttttcttttgctgcgttactttgggcaacgacaaaacgggtcggttgcatgttgagtgcgcttggcgcttttgtcgcataggtaatcatctgcagcaattcgcctttgctgatagtaatttccggatcaaattcgcgtgcagtgtggcgtttcatgacgacttcatcaaagttattgttttccaacatcaaattcacctcttagaatgtgagcgtgagccggcgcgcttagaagtcggagtgtacgtggccttgggtgtgatggcccgggcttaggccattgcgaccaaggtccttacacgcagacttctgcgccggggaacgcgttaatatttttggacatcttcaggatacgctaaatgttggcgttttcctagtgatatttaaaaatggtataggccttataagaaaaatggaagcgccatcattggtctgctatgccatcgtcaactgtaatgcgcctaattctgtaatcgccgctgtcaattgatcgccaggcttcaaaaagacttgcggatcgcggccaacacccgtaccactcggcgttccggtgaagatgagatcgccgggctgcagtgccacaatcccactaagataatggattaacgtcggtactttaaaaatcagttggtccagacttgcctgttgcatcacctgaccattgaccgttgttgtgatttgtagccgatccagattggcgatttcgtcaggtgatgtgacccacggaccgatgggtgaatagttttgaaacgactttgccaaagaaaattgcggttccgcattggcaaactgaacagcccgatcgcttaaatcttcgccgaccatccagccggcaacatggcgcatcgcctcgccttcaggaatattgcggccaccaagcccgatcaccacgactaactcggtttcccagtcggttttgggcccatgcatgcgcaccgtggcagtcggcttggccaatgagctactgaatttggtaaaaacacttggaaccgttggcaacttgatgtgaatttcttccgagtgatccaaaaagttcatcccgatcgcaaaaatctgctggctagtcgtgatgggtgcttccagctggtcagcggtaaattgaaaagtcggcccgagcgttaatgatgccggcttcgttaaggcagtcaaaacttccggcgcattcgtaatcggttgtgcggtcgatgctgacgtgatcagatgcggctgaccgccaatgttggcaattttcacttgaaaaacttcctttcagaagtattaaggtacgtcttcagtttacttctgaaaaatcgtggtgccaaatgtattggccgtggtagatgagttaatcttaggtgacgcgaggcgatgaactaagacatgatcttggtacacgctcatcagagattcgcctgaaacgcctgaataacttgctgaacggcttgattttggcttgcggttccaaaagtgactctcaaccagccaggcatgagtccgtcacgaacaagaaagccgtgctgaagcaattcctgcttgagagattgcgcttggttttgtggtgcctgaaaaaattgaaagttcgtttggctaagataatgcggcaacgccctatctgtcaaaaaagtttcccagctgcgacgtgcctgccgaacgcggcttcgtgttatctgaacaaacccctgatcagccaatgcagcctgtgcgcttaattgtgcgatggtgctgaggttataaggtaagcgaaccgactgaagatagctgaccagttgcttcgggaaaataccaaaaccaacgcgaaaattggccagcccgtagattttggaaaaagtgcgtaagacaaccagattatcgaattgcggcagcaggccgattgcacttgtggcgggatagtcgtcggtgaattcgatataagcttcgtctaccagaaccagtacatcttccggtacttggcgcatgaaccgggttaatgccgtcagtgacagcagtgtgcctgtgggattgttcgggttacataaccatatcagctttgttcgtggtgtgatggcctgcaccatcgcggctagatcgaagttgccggtttcgggttgaaccgggacatccaccaccttggcgccttcaatctcggcatgtaaccggtattcggaaaacgttggccaaggttcgacaacttcatcccccggctccaaaaaggttcgggcaattaaggcaatcacttcgtcaagaccgttgccaaacacaagttgctcgcttgcgacatgaaggtgatcggcaacggccattcgcaactgactcgcgttaccatctggataatcgcgactttgcgtaaaatcccagttagccaccgcctgtcttacttcaggactggtaccaaaagggttttcgtttgccgacattcgaattaagctggttaaccccagttcttttttcaaatcggccaacggtttttccggtgtgtagggttgtaaatgcttaacggtgtgtttaagcatgtctcttcctcctgtatgcaaagaagtgagcgtgagccggcgcggttagaagtcggagtgtaagtgggcttgggcgtgatggcccgggcttaggccattgcgaccaaggtccttacacgtagacttctgcgccagggagcgcgttatagcgagcgtgaaccagtggcgttaaatgtgtggctaccgcgggctattcaaccatcaatatttattgatgctgctgcgttccttcagacgactcattttcccttcgcgacttgccaattccgcttcgatctgatcaagcgtaataccccgttcaaccatcaacaccagaacgtgataagtcaaatcagcgacttcgaggacgaaggcggcgtcatcaggatttttggcagcgacaatgacctcggtgctttcttcgccgactttttttagaatcttgtccagccccttggtgaagagataatccgtataggaaccgggaatcggttgggcttggcggtctttgatgaggtcatatagttcggtgatactttgtttggcagctgtcatggctgatcattcctttcttgcataagtgcgataaaaacaactcgtgtgcccggtgtgacaggcgggacctgcgggtagaaccgatatcagcaacgtgtccgcatcgcagtcaacggcgattgattggactctttggatgttgccgctagtttcacctttgtgccacaacatctggcgactgcgcgaccaaaaccaggtttcaccggtttccagggttttttcaaaactttcggcattcatgtacgccaccatcaaaacctgttgggtccgagcatcttgaataaccgttgtgatcaaccctgagccctttttaaaatcaagtgcgatcatcgaaccgccacctttgcttgttttaaaaccgttttgacttcggggatggttaattgaccaaaatggaaaattgacgcggcgaggccggccgaaacggcggtctctttgaacaaggcaacgaaatcttcggcggaacctgcaccgccgcttgcgacaatgggaactgttaccgcggcacttaattggcgatatagggctaagtcgaagccctcctgagtgccatcagcgtccattgacgtgaccagtagctcccctgctccggcagcaactgcctgcttagcccactgaatcgcatcgagatccaccggcgtgcggccaccattaatcgtgacctggtagcgttggcgttccgcttgccaccgggtgtcaatggcgactacgaccgcctgactgccgaatgtctcggcaccggccgtgataagtttcggctgcttcacagcggccgagtttaaagcaatcttgtcagctccggcgcgcaacaagtcgtgcatatcggcaactgagcgaatccccccgccaactgtgagcggcatgaaaacctgcgctgccactgcggccactgtttgagtcatggtttggcgggcgtcagtcgtggcagtgatgtccagaaagacaagttcatcggctccttgggcttcataagctttggcgatggcaaccgggtcgccgacatctttgagttgaatgaaatgaacgccttttttaacccgtccctgatcgacatcaaggcatgaaataattcgtttggtcagcatcgtcatcctccaattctttgagcttgttcagttcgatggcgccggtttgccacgcttttccgataatggcggcgtgaatgtcggctgtgcgtaagacggttaagtcagccagcgtccgaacaccaccactagctacaatgttgatctcagggatggcgtgttgaagcgtccttagtaagtcaacgtttggcccttgcatcgtgccatcccggccgatatcggtcacgatcaccgtctgcaccccggctgtctgcatcgtttgcatcacggccagggcgttttgccgagtcgtggtcagccagccgtttgtggcgactttaccagagcgaacgtcaatgccgacaacaattcgccgtgaaccaaattgcgcaatcgcttgctcaaccatttcaggatccgtaatggcaacggaaccgaggacaaggcgatcaataccggctgtcagatattcattcatcgttgccagattgcgaataccgccgccaagttcgataaacgccgaggtgtgttggcgaatggtcttgatggcagcttgattaatcggttgttgggcgcgggcgccgtctaaatcaaccaagtgcagacgggttaaacctgcagcatttaaccgtgccacctggtccagcgggtccgcgcttaaactgacgcgttggtaatcgccttgcgttaagcggacgcttttgccggctaataaatcaatggctggataaagttgcatggtcggtcatctccttaaaacgctgcaaaccggcaaggccaatcgcaccgcttttttctgggtgaaattgcgtgccgagaatattttggcgccgaacgatactggtcagtggttggccgtaatcggtcgtggcgagtgtatacgcactttttgtttggacgtaataagaatgcacgaaataggtcgcttgattggcaaatcctgctgcaaacggatcgtcttgggtcagcgtgttggtgttccagcccatgtgtgggatagagatgccttcttttgtcggaatcgcgaccacctgtccggggataagccctaggccttgcgtttcaccaaactcctcgctgcgatcaaacaagagctgcatgcctaagcagatgcccagtaatggtttaccagtggcggcaaaagcctgaatcaccgagacgaggtgcctttgctgcaaggcgttcatggccgttttaaaggcgcccacccctggcaaaatcagaccgcttgctgccatgataatggcgggatcggcggaaagttgattgtcaatcgccaaatattcaagcgcttttttgacgttaagcgtgttgccggtgtcatagtccacgatgacgatcatcaaatcactcccttagttgacggtatccccttgacggccggattctcggcaacggccgcttgcatgctgcgaccaagtgctttgaacaaggcttcaattttatgatgggtattgcgtccgtataaaacagccgcatgcaggttaaactcgccggcaaaggcaattgcctggaaaaagtcttcggtgacttccgtgtcaaagccccccaatcgttggttggttaactcggcgtcaaacactagataagcgcgaccggaaagatcaacgaccacgcgcgccagtgtttcatccatggggacaaaggcgctgccaaaacgttcaatacccgctttgtcaccgagcgcttgcttaaaacagttacctaagacaatgccggtatcttcaatcgtgtgatgcgggtcgacatccaggtcgccttgggctttgattgtcaggccaaagcggccatgcttggcaaacgcctctagcatatggtcaaaaaagccaatgcccgtatcgatggcaataccgctttgctgatcaaggttgagactgatcgtgatttgggtttctttggttgttcgggtgatcgtggctgtacgcatggaaatacctccttgtcgttaagtgatgcgttgacaaacatttatcgggctgtccgtttcaaaatggcttcagcatgaccgtctagtccctcggttcgcgccaacgtcacgatcgcatcagcttgtcgcgccagcgcttcggaactgtactgaataaattgggttcgtttcacaaaatcataaacgcctaaaggtgagaaaaatcgcgccgatccggcagttggcaagacgtggttcggaccggccacataatcgcccaccggttctgcagcattttcgccaaggaagaccgaaccagcatgctggattcgatttaagtaagtgatcggatcaggcaactggacctccaagtgttccggcgcaatcgtgttcatgagggtaaatgcggcatttgtgtcggtaacaacagcgataaagccctgattcctgatcgcggtgcgggcaatggccgctcgcggcaacgttgctaactgaatttcgacttgatcactgacggcctcagccaacttttcactaggtgtaacgagcattgcccgggcgttgggatcatgttctgcttgcgacaagaggtcggcggctacacgcacaggattggccgaatcgtcagcaataatcccgatttccgatggaccggcaatcatatcgatggcaactgctccgaagacttgttttttggcttccgcgacatattgatttcctggccccataattttgtcgacgcgtgggatggtctccgtaccaaaagccaaagccccgatcgcctgggcgccaccgatctggtaaatttcgtcaatgccagccaatttggcagcggccaaaaccacaggattaagtcccgctttttgcggtggtgtcaccatgacgatttttttgacacccgcaagtttggccgggatcgccgtcataagaatcgttgacggataagcagcagtacctccgggaacgtacaaaccaaccgcatcaagcggcgtcactttttggccgcgaatgatgcccagggatggactatcgatgaaaccgtggctgatttctaactggtggtaacttgtgatgttggtcttggccaagttcaacgctgttaataatttcggcgataagtttgccaaggcagcatcaattgttgcttgtggaacgcgcaggtcgtcgattgagacgtgatcaagttgcttgctgtagttccgcaaagcagcgtctccttttgctttcacgttagccagaatttcctgtacggttgtttgaaccgccgtattttgtgttaggttttgttcgcgggcggcgacttgttgctgaagttgggttaaagtgccggtaagaattttcatgttaaacctcctggggacgaacccgtttcagtgcctggatgagttggtaaatggcagatttcttttgcttgagcgccagccgattcaccacaagatgggtggacactggcgttagtgtggcaaaaaccttcaaatgattttcgcgtaaggtcgtcccggtttcagtgatgtcgacaatcgcatcagccatgccggtcagcggtgccagctcaaccgagccttcaattttaatcatctcaacgtcttcgccttgtgtctgaaaatagctctgggcgatgtgcggatatttggtggcgattcgtttgcgacttgtctgatatgggtcaaagtcaggggttgatgcgagaatgaagcggcaacgaccggttctaagatccaacaggtcaaactgttggtgaccttgttcctcgagaatatccgaaccgacaatgccaatatccaccgtgccacggttcaagtaagtcaagacatcaggcgctttgacaaggacaaaatggaaatccggatcatcggtaaagagcaagcgccggcttttttcctggagcggcatacagtcaataccggcagcgctgagtagtggcagcacctgttcagttgtcctgccttttgccaatgcaatggttaacgtcatagtgtggcctccttgggggaaagatcaattaagcgagcatggcgactttttgccaatgcccgggcttcagcaagcgaatcgacgaggcaaagccgggcattgggcgttgtggcgacaactgctgctgcttcctgccattgggaaggtaagccatagacaaaggtctgcggcgatgcggtcggttcctgaacggtgtccgttaaggcatccacatcaaatgccaatccgactgccggcagcagatcgcgttggaagctcgccatgagctggtcatagcgcccaccgctaaacagatattcgcgccgattagggacgtaagcgtggaagaaaatgccggtgtaataggattgcggcggctgactggttaagtccagcgtgacgttaagatccgggaattggtccttcaagaaatcaactgttatctgcagacgtgttacctgctcgcccacaaatgccggtggcaataattgccttaattgttcgaaaacggtcgcagctggaccgaataaccacggccattgttttaagaaggggtacaacgcattggcagccagtggttcaatcaaccgttcgtaggcgttgagattcttcgcgaaaaaggccgtctgcaatgcggcttcggtttccgggtccagcgccaaagcctgcagaatttgcggaacaaagcgtgcatcggaaagttctagcgttaaatcgccaaccttcaaatcattacaaatgcggatggcctcgtttaaacacgcccattcggctttcaaagacgcgtaaccgatcaattcaatgcctgcttgggtgatttggttgtaggtaccgctcagactttttctgacgcggaaaatatcgccgacataccaccagtgaaccggcggctgaatattggtggtgctcaataagcgcgccaatggcaacgtcaaatccggtcgcatcacaacggtctcccctgcatcatcgagcatctgataaggttgttcacccgtgacggtcagcggctgaaaaacatcgcgatattccaacaagggcgttttgacccgatcgaatccggcatcgataaaatggcgactcatgatttgaattaggttttctttacggatagcgcgcggcccgaattcgtcgcgggtaccaacaggtaaatggcgatttgacatgacggtgctcctttcgctggtgcgggtttttctggtgcgaagttgttggggggcgtgttggctggtgattagtctagttgaatttttgctatctatagcgcgccggctcacgctcacaccataacgcgttcgccagcccagaaacctgcgtgtaaggaccttggtcgcaatggccaaagaccagccatcacgcccaaggccgcttacactccggtttctaaccgggctggctcacgctcacgcaaaaaaagcccccgaaaacgtttttacgttttcgagggcgactggtgatcgcggtaccacctcaattttgtttagacctcacgacccaaacctcacctaccagccacaagtcggcttgcgcgaactgtgactggcagcggtgataacgcaacgggtgcgtgacagcctacttggttcagccatcaagttcttagatgtgtgttcggctggtcgatcgcaccttctcagcaatgggcgctctcttgggatcggtggtagcttacttggtctaatcacaacttcatgtttgttaatgtgactctaatcataacgacctttagaaaaatgtcaaccacttttttaaaataactgcattaggttccgagattgccaaccgtttgttttttaatttagatgcaagaacgagattgcgatattcaaaatgatcattttgccagcggagatgtcgtcttcagaaaatcgagcaataacccctgcacttcagcatcctgttctggggttccaaagctttggcgaatccatccgggaaccatactatcgcgcaccagatagccatgttgctttaagaaagcgcctaatgcttgtggttgcgccacttggtacagcataaagttggtctgggtggcgtaatgccggatgtgatggtgatcgaagaatgctgtccattgctggcgcgccgcaaaaagttggcgtttaactttttgcgtgaaagcaacatctttccatgctgccaaagcggccgtctgactgaggccgctaatgttataaggcaagcgcacgttttgcattttcggaatgagcgccttggggacgatgctaaaaccaacgcggaaattggcgagtccgtaaagtttggaaaaggtgcgcatcaccaataaattggcaaactttgtgatcagcggcaagacggaaggattggcgacctgatcaacaaagtcaatataggcttcatccacgacaaccaaaatttccggcggcacctgtgccatgaattcggcaatttcactgaccggcaagtaggttccggtgggattgtttgggttgcataaccaaatgactttcgttttcggtgtgatgcctgccaacagggcttgaagatcaatgcttcctgtggtatcgtcgaccggtgcattgaccgtcacagcacccgcaatcgccgcctgtagctgatactccggataagtcggccatggctgaaggctctcgtcgccaacgtcaaggaaggttcggcaaatcaaggcaatcatttcgtccaagccacttgaaaaaagtagttgatcagcaggaatgtgcagccgctccgccacggcggttcgcaacggcatggcatccggatcaggataactgcgagcttgtgaaaaagtccaattggcaatggcttcctgtactttaggagaagtaccgacaggattttcattaaaagataagcgcgttagttttgccaaacctgccgccttcgcgattctttccggggtgctgtccgatacataatccggcaacccggcgatacttttgcgcaacatcacgccacctgctttcttaattgccttagagtttacccgcatttgggtgcaatgtaaatataaaatgcataaatattcataaatgtaacagagactaaccttgtttttctttcttgaaattttcaaatgttattcaactgctctaaatataaaagacattggcgttttttttatcacctacgccagacgatgttcgttgccaaaagtttttcgccatcgacttttgcccacacaaacaggcactaaaagacgggattcagtcctttagtgcctgtttggtgtcatggatcagcgaacatcagctattggcaacaaaggctaaatagtaagtcactgccgcaacggtttgagccgagttgattttacctgccttaacgccttcaaccagctcagaaaacggcactaaacgactggtgacgaattcgtccttatcgaaatcctgcgacgttttggcggctaagtcaatgttggccagcacaagattgactgtttcatcggtcatcccttcactggaacggaccgcggtcagccactgcaaatcatgggtcagataacccgtttcctcatgcagttccctgctcgccgcagtttgccaatcttcaccaggatcgattaatccggcaggcaatccaaaaacttcgctgttggttgccacccgatattcccgattgactaacactcgcccatcgtttgtcagtgccagcatggcaacagcattggcgtggcgaatcaaatcgcgttcaaccgtcagaccatcaggcgttttgattttttgcgtcacaacattgaaaatcggaccgtgataatgcggcgtttcacttaaaatttttcccttcgctaagggttggtcaaaaaacatgctggaatcctccttcaataacacgctcctgctcacgctcaaatcaaaaaagccgcgcctggacgcgactttacttatgctttggtgaaatccttcatccatgctagggcaatggccttttcgcctaagtgtgtcccgacaaccgggccgaaataggaaagttcgaacggaacagtcggaaacttctgctgaagatccgtcaaccagcgctgtgcttcctcagggtcattagcatgaatcaccacagcgcgaatcggataatcgactcgttcaagttcttgctggaacaatgtctcaacgcgggcgtaagcttttttgatggaacggattttttcgatagcgacgattttatgggactgatcgtcgaaagttaataatggcttaattttcagcataccgccaataaaggctgaggcattacttaagcggccgccgcggacaagattctgtaagtcattgacaatgaagtattcgcccatggtgctgcgcagatcatccagccgggccaaaatggcttctgggtctttgccggcttcagccatttgcgctgcggctagaaccaaccagcccattaggataacggtaatttgggaatcgtaaacataaactttagcgccatgaacttcatcaacagcaccttttaaggtattgacaaagccggaaatcgtgctggcaagatgaatgctgataatggtgtcatagccttcgttggcgagattttcgtaaagcttcagcatctcacccagtggcggttgcgtggtgctgggaaatgtttttgcggtttttagtttggcgtagaattcttctgtggtaatatccttaccttcgtcatagactgcgccgtcaagaatgaccggaatcggcaccacggtaatgtgatgtttgtcgatttcggcttgcggcagataacaggtactatccgtcacgatagcagttttcatacaggcacccacttttttaaaaatgattgtctacatcataccataaaatgcaaagatcaaggagaaacacccgggagcgtgttatctaaatttgacgctggatgcttcaaccgttctccagatactacctttcaacactaactatgctatattttgagcatagacaattccaaggaggaccttgcaatgacgacttcaaagcataccacattggccgtggtcaaaatgaccagtaagcaccagatcaccattcccaaggccgttcgtgaaaaactgggattgagcgatcatgataagcttgtttttcagctgactgatcatggacaagttatgatcgataaagaacaaaagtcggatctatggtcgattattcgcgaacaggatgcggcccacggtagtatcgacacacctgagcctgattgggggaaaggtgttggggcagagttgatcgatgactgaaaatagaaggtttcactagagcgacgtcattttcctcaatcttgatcttactgaaggacgcaaatctctcgctcttccataaacgccttaaaaccggtaaaatgattgggacaattggaaagcgagcggattaacatgtcttttgatggaatctttactcatgccatggcccaagagcttaacggaatcttaagcggaggccgtgttgctaaaattcaacagccttatgaaaacgaagtcgtgattaccattcgcgccgggcgtaaaaatcatcccctgctgctgtcggccaatccgcagtatgcgcgggtgcaaattacccatattccctttacgaatcccgatgttcccgctacctttaccatgacgctgcgaaagtattttaacgccgcaacattaacggcagttcaccaagtacaaaacgaccgcgtactgcattttgaattctcgacgcgcgatgaactgggtgatgagttaggactgcgtttgattatcgagatgatgggccgacacagtaatatttttttggttagcaagcgaaccgggaaaatcattgatttgattcgccatgtctcggctgaccagaatcgctatcgcccgttgatccctggtgcgcagtatgtggagccgccaaaacaggacaaaatcaatccgtttgatgatcgtgatcgactttaccacgaactagaacgtcaagtgacgccaacactcagccgcgccgccttgcttcagcaacattatcaagggttagccaaggattctgcggcggaactggctttgcgcctcaatcaaggcgatgctggatgggatggctttttcaaggaacttgaagcgccagcgccgacgattacgacgcaaggcaaaaaagcggtctttactgccatcccctatcagtcgctgtcaggcgatcagcagtactacccgaccttgagcacaatgcttgatgcttattatgaacaaaaagccgagcacgatcgcgtcttgcaacaaggcggcaacctgattcatgtcattaaaaacatcatcgataaagaccgtaaaaaacagcgtaaattgaaacgcacgctggaggaaacggaaaaggccgatgattaccgcgttcgtggcgaaattctgacgacgtatctgagtcaggtgcagcgtggcatgaccagcatcgaattaccgaatttttatgcggataaccagccgattaaaattacactctcgaatcagctcacgccatcccgcaatgcccagaaatattttgccaaatacacgaaattacgcaatgcggttgctcatgtgaaccaacaaatgcaggaaaatcaggaggaactcgattatctggaaggcattatggcccaaattaatgtggccagccccaaggatttagccgatattcgccttgagctgcagcagcaaggctatttgcggaaacagaagcagaagaaaggtaacaaacgccagaaagtttccaagccggatcaattttatgccagtgatggtacgaaaatctgggtgggcaaaaataatttacaaaatgaccaactgactttgcataccgccaagaaaactgatatttggctgcatgtcaaggatattcctggctcgcacgtcattatcgacagcagtaagcccagtgagaaaacactgctagaggcggctaaactggcggcatatttttctaaagctcgggaaagtgccaatgttcccgttgattggattgaagtgaagaaaattcgtaaacccaatggcgccaaacctggctttgttgtttacgaaggacaaaaaacggtgagtgttacgccagatgctgaattagtcgacaaactgcgcaccccgccaacgaaatagaaagggattttaaatgaccaacacatctgcacaaattagtcgaccgattcaggaacacattattgccaacaaagttaaacatggctggaacacgaccgataccaattttgaaatgctgctcgcctatcatgaaatggctgaactaaccacagcactgcttaagcgtgatcaagacaacatcgctgaagaactggctgacgtcactatttatctgctcggtattgccgaaatcaaagggattgatttggctgaggcggttaatgcaaaagttgccatcaacgaccatcgtgtttacgatgcgcaaggccataagcatcttgaatgaagcagtgtctaggtaaagattgagactgcgcgatcatgttccacggccaataaaaaatgaccaaatatacccgcttgcgattggggtgtttggtcattttttggttactattttggataatttttagggtgcgtctttactaacccaaaaatttgaaaacgattcgactgtcgaacaattttagcatcttttcaaataacactttgcttagcaacgctgctgctaccggaatgacgatccagcatagtaaaaccagcggaattgccaaaccagcatccatggccgcaagtgggccgaccatgccaacaattccgaagccggccgactgtggcgtcccgctgattgacaataacgcgaccggaattgcggagatgattgccgtgaacaagcatggaagcaagataattgggtgcttaaacagatttggcatcatgattttcattccgcctaatgcaatggcaatcgtgacgccagatttgttgaccttccaggaataaaccaccagtgctaaggctgtggcggcaacgcccattgctgatgcccctgccgaaacgccgtgaagttggatcgccagcccgatagcaacagttgaaatcggactgacaattaaaatggcaaaagaacaggagatcagaacagccatcaggatcggttgcagagtggtgaagctattgatgacatcgccgatcgcggtagtgaaagcagcgatgaatggcagcaacagtaccccaatataagcgacgccacacccgactagaattggcatagcaatgacagctgttgaaccaaaccgatctttcacccatagcaagactaagacagcgattgatgccgtaatcatggtattgatcaaatcgccggtcccggcaccaacataggctttcgtggccgggttgaatttcacgacgcctgagccaacaaacgctgcccctgccgttaccatcatttgcaaaggcttcagttcaaattgaagcgcgattaagccgccaataattaagggggtggcaatttgaaaaatggctgcgacttgcgtcaaagttactgcgaatgtgttcgttccaaaatatttgagaatgccggacaaaaccgcatttggaatcaatccaataatgacccccaacgctgttcctgataaaaccttattgataaaagccgtcactgtcatactgattgcctgagtagtcgtcgcgtgagaacctcgctctccttgcatcggtgcgtcagcaagtgtttcggctgcagcgggcattccttttgttgttgaatctcctgccattgacttttcccccttaataagaatgtaatgagaatattaacagaagatgtgcagataagtctagcgttagattgaaattaattaatgggatttttctgttatacatcagtgggcattgcaatggtcgcaacgataaattgtagtcgcaaaattaaccgttttggccgtcaatacgtgaactttagatcaagggaaacccgcgtattaattcaattttaaaagggcatgttcagtatttgctggccatctttagacatgattgtgattcaatgatcgttatcagggagcactatgcttaatatgaaacagtccgtatactcagatgtttgcaattacacttttaatgatagtcatagccaacgcacgaaaattgcaaaacgtcatcgtagctttagaaacatttcaacaaagaaaggccctgtcagcaatgttgaaaatcgacattgctgacagggcctttccgattaaattttgatgaatatgctcgacggcctagcgattattggaaccgatcgccccacttggcgggatcctcacgccattgatgtaaggaacttagctgctgagtcgttatggcgccttgagcttcagcagtttgaatgagcgccgtatagttggtcagcgtgaagaatggcaagcctgctttggcgaagttagcggtcactgctgccagctgataactgaagattgctgcgacccccagaacgttgacaccgtctttttgcgctgcggccacggcactgagcacggaaccgcccgtcgatagcaggtcatcaatgacgaccagcttggcgtcttctggaaggtgtccttcaatctgtctcccctgcccgtggtctttaggcttactccgaatataaaccaatggcaagttcagcagattggcgactaaagccgcatgcggaatcccggcagtggccaccccaccgatggccgtcacgtccgggtaatgagccacgatttcctgggctaagccggccgcaattttactgcgaacgtcagggtaaccgatagtgagacgattatcggtataaattggactttttaacccgcttgcccaagtaaatggttcttcgggacgtaatgtgacggctttgatgcggagtaaatcgctggcaatttggttttctagtttagtcatgtgctgtttcccacgctttcttgatcgattgataggcttctaccgggtcaggcgcctgtgtgatcgggcggccgacaacaatggccgaactacctaaccgtttggctcttcccggtgtgacgacccgtttttggtcgccgattgcgtcaccctgtggccggatgcctggtgtgaccacgagaaattcaggtttagtcacactgcggatcaatggcgtttccagggcactggcaacaacgccgtctgcatcactggcctgcgcgatggccgccaagtgttgaactgcttgattaagtggcacatcgatggataattggttttccaacatggtttgatcggttgaggtcaggtgggtaatggcgagcattttgggtgctggatggtgcgcggctttggcacctgccaacaagccgcgtttagccgctagcatcatttccttaccgccggctgcgtgcacggttgtcagcgccacacctaatttgcctaattgccaagcggctttttcaactgtattcggaatatcatgcaattttaggtcgaggaaaatgtcaaccgggtgtgctgcctgaatggcggtaataatcgccggcccttcagcatagaaaagttccatcccgattttgacgaaaagccgtttatcttttggaaaacgtgccaaaaaatcaagtgtggtcgcctgatctttaaaatcgagtgcaatgataggtgtcataccgcctgtccttcctgaatgcgtgcaaatgctgcggcaattttaggaattgccttttcttcatagtaattggccgatccgattgcgactgcctgggcgcctgcagctaacatctcggcagcatcgtgaccggagctgaccccacccatgccgataattggaacatgaacagtgtgggcaacctgataaaccagatgcagtgctatcgggaagattgccggaccggacacgccgccagtgacattgtccaaaaccggttgacccgtgtggatatccaagcgcatacccaccagcgtgttaatcaaggagatgccatctgcaccagcggcttcgactgctttagcaatcacggtgatgtcagtgacattaggcgtgagtttaacgaaaatcgggaccgaactggcttctttgacagcgcgcgtgacggccgcagcaaccaccggatccgtaccaaacgccatgccaccttgtttcacatttgggcaggaaatgttaacttccaaagctttgacatttggggccgcgctcaattttttagcaaccgccgcatattcagcaacatcggcaccggcaatgctggcgatgattggcagatcaggatagttttttgccaaccaaggcagtttttcgcgtaacacaacctcggatcccggatttttcaaccccacggcattcagcgtactgctcgggccgtcagcgaaaatcttgccttggttgccaacccgtggcaataaggtggttgatttggtcaccaatgcccccagcaggttcaaatcatattgtttggcgtattgttcaccaaaaccgaatgttccgctggcgggcatgaacggattcttcatcgtaaagccgggtaattcaatcatgtgacgctgcctcctttgttgtaacggctgctgctgccggcagttgtcggctttaacttctaattggtgtcatcgaaaatgcccgtgattccaagaccttcaaaatggcatctgcggtatcgaggctggtcatcaatggtacgccatgttcgatagcagtttcccgaatgcggaacccatcacttgaggtcttcttgtcggcggtcatggtgttgatcaccagctgaatcttgcggtcggcaatgtcctccaaaatagtttctttgccgctatcaagtttctcgatggtctcaactgtaatcccggctttttcaaatgctttggctgtgccgctggtggcgaccagctggtaaccgacttcacggaaccgtttggccagttcggttgcttcggttttatcagcgtctttaaccgtgattaatgcgcggccgaattgcggcaagtgcatgccggctgcctcgaatgctttgtataaggctttggctagggttgtatcactgcccataacttcgccggtggacttcatttccggtcctaacaagctatcaacgtgattcaacttggagaagctgaacactggtgctttgacgtgaattcctgcctggtttggcagtaagcccgttttaaagccctgctctttcagacttaatccgagaatcgccaaggtcgcaacttgcgccagtttgacattggttactttacttaagaaaggaaccgtgcggctggcccgcggattgacttcgatgacatacgctttgccttgatgaatgatgaattggacgttcatcaagccgatgcagttcaaagcccgtgaaagtttgatcgttgcatcggtgatctggtcaatgatgtcctgactgaaggtttgcggcggataaacagccatcgagtcgccgctgtgaatgccggcgcgttcgatatgttccatgattcccggcaaaacaactgtctcaccatcggagatgcaatcaacttcgcattcttttccgaccagatagtgatcaatcaaaaccggatggtcgtgggaaaccgacacagcccgatcaatgtaactggctaattcatcggcatcatgcacgatttccatcgcccgaccgcctaatacgtaacttggccgaaccaaaaccggataaccaatcttgtctgcaactgccagtgcgccggctttatcggttgcggtaccgccttccggttgcggtaacttcaattgtttgatgacttgatcaaacagatcccgatcttccgcccgattaagatcctcaacggaggtgcctagaattttaatgccgcgtttagccagtggttccgccagattaatcgctgtctggccgccaaactgcacgatcacgccttctggttgttccaggtcaatgacgttcagaacgtcttcgagggttaagggttcaaaatacagcttatccgcaatcgaaaagtcagtggaaaccgtttctggattgctgttcatgatgatggcttcatagccggctttttgaatggccttaacgctgtgaaccgttgcataatcgaattcgaccccctggccaatccgaatcggaccggaaccgatgactaagacgctcggcttatcgcttttgaagctatccgtgctgctttcataagtgctgtaataatacggcgtatcactggcaaattcgccggcacaggtatcgaccattttataaaccggtaaaatgtgctgttctttgcgcatctgccgaatctgatccgcatgtaagccccaaagctgggcaatttcttcatcagcaaaaccataacgctttgcttcagcgagcaacggcaaatcggctttatgcgcagccagttcccgttccaattcgacgatgtgtttaatcttgtcgaggaagaatgggttcattttggataattcggcgacttcatcgatggtgtaatcccgccgaaatgcttcagccagataaaagagccgttcgtcgttggcttgaatgatatgcttacttaattcatcgtcgctaagcttggcaaaagccggacgacggggatgaatgaggccgacttcaagtgagcgtaccgcttttagcagactttcttcaagcgttcggccgatcgccatgacttcaccggtggccttcatctgagtgccgagggtgcggtcgccgttttcaaatttatcgaatgggaaacgcggtaatttggtaaccacataatccaaggccggttcgaattcagcccaggttttcttggtgaccggattcttgatttcgtctagatgcaagccgactgcaattttagcggccattttggcgatcggataaccggtggccttggaagctaacgcgctggagcgggaaacccggggattgacttcaatgacatagtacttgaagctgttgcggtcaagggcaaactggacattgcagccgccttcgatcttcaacgcacgaatgatcttcaaagctgagtcacgcaacatctggacttctttatccgtgagcgtttgtgttggcgcgaagaccattgaatcgccggtatgcacaccgactggatcgaagttttccatgttgcagaccacaatggcggaatcggaagcatcgcgcatgacttcgaattcgatttccttatagccggcaatggaacgctcgatcaacacctgggtgaccgggctcaggttcaaaccgttttcggcaatttcggcaagctctttttcattatcggcaataccgccgcctgtgccgcccatggtgaaggccgggcgaatgataacaggaaagccgattttgtcagcaaactcctgcgcttcatcgacgttgttggcgatggcagattccggaaccggctcgtggagtttttgcatcaggtttttgaacaattcgcggtcttcggcttgatcgattgcgctgagcttggtgcccagtaattcgatgccgagctcgtccaagatgccggtgttgcttaacttcatggcaaggttcagaccgatttgtccgccgattgttggcaaaatggcatctggcaactctttacgcaagatctggctgacgaattcgacggttaacggctcgatataaacccgatccgcaatttccgtgtcggtcatgatggtggccggattggagtttaccaaaacaacttcataaccttcttcacgtaaggcaagacaagcctgagtccccgagtaatcaaattctgcggcttgcccgatgataatcggacctgagccgatcactaagattttatgaatatcttgacgttttggcatgattatcctttctgcgtacgatctgaaaatgcatccatcatttccataaactcatcaaaaagatggtcggcgtcatgtgggcccggagcagcatccggatggaactgaactgtgaaggctgggtaaagccgatggcgtaagccttctaccgtaccatcattgatttcaacgtgggtgactaacaaagtgtccggatcaatgctgtccggatcaacggcatagccgtggttttggctggtaaaatcgatgcgtccagtcgcaatctcgcgaaccggatgattaaagccgcgatgaccgtatttcatcttaaaagtatcagcgccgttggccaaagcaaacaactggtggccgaggcaaatcccgaataacggaattttaccttcaatgccgcgaatcatatccagcgcttccggcacatcttttggatcaccggggccattggtcagcatcacgccatccggggccaactcaagaatggtggcagctgttgtcgtcgctggcaacacggttacgttgcattggcgcttggccaattcccgtaaaatgctatgtttgagaccaaaatcgatgaccacgacagtgcggccggtaccaggtgccggataggcttgctgagtcgaaacctgttgcacctgattcttcggaagcaccaacgctttgagttgatcaaaagcatgttcatcggctgcatccacaatgctggccttcatggcgccgacttctcgaattttcttggtcagagcacgggtgtcaacaccgctgatgcccggaatatgtttgcgtttaagaaattcatcgagtgtcatctgactgcgccagttaccggtgacccgggctacctcgcgcaccacgatgcctttggcggtgggatcaatgctttcataatcatcgcggttgatccctacattgccgataagcggctgcgtgaaggtaatgatctggccgttgtaactttggtcggtaatcgtttcctgataaccgctcataccggtattaaacacaatttcgccggttgtgacggtttccgcaccaaagccgacgccaggaaaaacgctgccgtcttcaagaattaaatagcgcttcatgcttgtcctcccttttgataggcaatccgcccgcgactgatcgtatacaaggcctggccctgaaccttttcgccgataaatggtgaattcttgcctttggagaaccagtcggcaggatcaatggtgtaagtggtgtccagatcgagaatcgtcagatcggcgggaccacctaccgtgatatggccgcctggcagaccaaacttccctgccggaaccgtactcattttggcaatcagttgcttaagcgtgaacatttttgatttgaccagtttggtgtaaagcagtggaaaggcggtttcggaaccgacgatgccgaatgccgcggttttaaaggaaccggatttttctgcagctgtatgtggggcatgatccgtggcgatcatgtccagtgtgccgtcttgcaagccttcaagtaaggccagatgatcggcgcgggaacgcaagggcgggttcatcttgaacatcggattatcgcctgggatattattttcatcaagtagtaagtgatgtggcgaaacttcggcggtgacgtgaacgccgcgttttttggcttcgcgaatcaaggctacgctttggcgagttgaaacatggcaggcgtggtaatgaacaccggtggcttctgccaagtccagatcgcgcgccagctggctgctttcggtttgattgatgatgccaggcaggttcaacttctcagcaaccgggccggcattgatcacgccgccgtgcatgagactggcatcttcgatatgggcgacaatcggtgctttcagtttagccgcctgtttcatagcttgatacattgtatcggcatcctgaacgccaacgccgtcgttggaaaagcccagagcgcctgcttccagcaacgccggcatgtcgactagctgatctgaatgtaagtcatgcgtaatcggggcaaactgccggacggtaatcttggcatcgctccggtttttcgccaataccggcgtcaaggtggcgactgtgtcgggaacaggttttagattgctcatcgcaacaacagtggtaaatccgccatgtgcggctgcttgagccccggttttaatcgtttctttagcagtaaagccaggttcgcgaaaatgaacatggacgtcaatcagtcccggaacgactgttgcaccggtggcatcaatgacggtttcatcactgcgggcagcaagttgctggccgatcgccgtaattttgtcgtcggtgatctgaatatccgctgtgtattcggtatcgctgatgatatgggcatttttgatgagcataagtaaagttactcctctccgaagtgacgggcgttgatgaccgcctcaagcatcgccatccgcatgaaaacgccattttgcatttgggtgaagatccgtgagcgcggaccgtcaaccaagtcgctagctaactcaacgtcgcggttgaccggtgccggatgcatgaaaatggcattgggcttcatggttttggctaaagcatccgtgataccgtatttcgcatgatagctttctttggaaaatgcttcgcggttgtcagtattaaaccgctcaagctgaacccgcagcaacatcaaaacatcgacctgtttgactaggtccggcacgctgatgaagtcgccatatcgatcaaagctaggatcataccactgttgtgggccggcaaaatgcagcgtcgccccaagtttgtgaagcatctgcatgtcgctgcgcgcaacccgactgtggctaagatcacccacaattccgatattcaagccatcaaaatgcccgaattcttcgtgaatcgtcattaagtccagcatcatttgggatggatgctgaccggcaccgtcaccggcattgacaatggcagttgtcggccaggcgcccatgagttctttgtaatagccgtctttagaatgacgcatgacagcgatgttgacaccgatggcaccgatcgttttgatcgtatcttccaaggtttcgcctttcgaaaccgaactgtgggcgggatcaaagggaataacggtcaaccctagtttgcgttcggccatttcgaagctggtgtgtgtgcgggtgctattttcaaagaataaattggcagcatagatcggctctggaaaatgaactgtctgaccagccttgaagtcttcggcccggttaattagtgccaaggcgcttttttcgtcaacttgttcagcggaaacaaaatctttaaatggtgtatcagtgagattagataaggtcatttttttctgccccttcttcgttagcggcatgttctggtaaaacaaagttcaggaagattccgatcacggttgccagtgcaaggccggagaattgatacccggcgaattgcaggctggcattgccgataccgatcacaagaatggtcgaggcaatcatcaggttgcgttttttgtcgaagtcgactttgttgtcaattaaaacccgtaagccattggaagcgatgacgccgaacagcaggaagctgatgccgccgatgaccgggcttggaatactgcgaatcaaagcacttaacttaccaatgaaggcgaacaggatggcaaacatgccagcgccgcctagcacatagacactgtgaactttggtcatggcaagcaccccgatgttttcaccgtaactggtcaccggtgggccgccgacgaaaccggcaataatggaagccgtgccatcccctgccaaagtatgattcaggcccggatccttaaagaagtcgcgttttgtcaatttgttgaggaccatgatgtggcccatgtgttcggtcatggtgacaaaagcgatgggcgccattgagagaattgcaccccagtaaagttgcggtttgtagctgatgaatggcaactcgaacttcggtaggtcaaaccaggcagcttgctgaaccgaggtcaggtccacgatgccaaacaacagcgctacaacataacccgtgacaatccccagcagaatgggtagtaagctaatgaattttttgagatacatgttgtaaatgatgaccgaagccaacgtgatcatggcaacggcgaagtagcgcaaatcatacacgcttttggtcgcggaaatcgttcgcatggtggcgtcagttgcggcagtgccggccagtgacaacccgatgaccatgacaatcggcccaacgacaattggcggtaaggcgcgatcaatccaagccgacccgctgcgggcgacgatcaatgccacgatcaggtaaacaaccccgacagcgacggtgccttgtgcgatcgcgggataaccggcacctttcatcaacgcctgcatgatggtaatgaatgaaaaacttgatcccatgtaggccggaattttaccgcgggtgatcaaaatatagactaaagtgccaaccccgcttgagaataaggcaatacttggatccaaaccgaccagaatcggtaccagcacggttgacccgaacatggcgaaaagatgttggatggataagcccacccattgaccgaacttcggcttgtcgccgatgtccaacaccgcttcatcgttgtgaaaagccattgactagtcccccatcttctcgatgctgatgccgtctttgccatcaagttccgcaacctgtacctgaatctgttcgtcaagggaggttggaatatttttgccgacgaaatcaggacgaatcggtaactcgcgatgaccgcgatcaactaaaactgccagactgatcttgcgcgggcgaccttcgtccatcaaggcatccagggccgcgcggatggtgcggccagtgaaaatgacatcgtctaccaggatgacgtgcttcccagtgatgttaaccggcagctgcgcaccttcaacatcgggttgatgttcgtgatcgattttatgaacgtcatcgcgataaaagcgaatgtccagttcgccgaccggtacctgaaggccttcgagctgttcaagtcgcttggcaatgcggtgggccagataaatccctcgtgttttaatgccgacaagaacgagatcgttcaagcctttgttttgttcgatgatttcataactgattcgggtcaatgcgcgtttcatcgttacctcgtcgactacttgtttggactgtgtcatgatgtgccatcctttcttgtatgtatgctggttggtgtgggatttgcgtggggctgttctattggaggcgattaggagcttgggctttcgcgttctgttatgaagtgacccctgtcaaccccatctttataagattttcgatattgtcgttggcactaacaagctccagaattccgt

SEQ ID NO: 312 - DNA, 265036 bp, Lactobacillus casei
taatgattgtatggttcgttttaacacaacaccattatcagtctaaatccccgagtcgacaatctagggggtcacttcatattatctataacgcgctcacagtcgcagaaatctccgtgtaaggaccttggtcgcaatggccaaaatcgggccatcacgcccaaggccacttacactccgatttctaagcgctcctgttcgcgctcaaacaaaaagcgcctcccatccaatttggatagaaggcgaccgtagcctgaataatccgccgcaacggaaagggaccttctaagcctcactggacttagttaaaggtgcttgtttgattgagttaagattaccggacgttgcgggtcttgtcaatgcctgcgcgcagatcaactaaggttttttcgaaaacttcggggaccggtgccgtgaaagttaagcgtttaccgctggttggatggacaaaaccgagcttggcggcgtggagaaattggccgttgcctgggagtgtgcgtttaggtccatacaaaggatcgcctgctaccggatggtgaatgtaagccatgtgcacgcggatctgatgcgtccggccggtttccagaacgcatttgatcaaggtatagtgggcaaatcgttccagcacctgaaaatgggtaaccgcatgccgaccgtcagcaaccaccgcctgtcgtttgcggtcacgcggatcacggccaagcggtgcatcgattgtgccttcatcttctttaaacgtcccgtgaactaacgcgaggtattcacgaatggacgttttggctttaagttgcgccgacaaactcaactgggccttttcggttttggcgaccatcaacaagccgctggtgtctttatcgatgcggtgcacaatccccggccgaatgacgccattgatgccaggcaagtcagtatgataaagcaggccgttcaccaatgtgccgtcaggatggcccggcgcgggatggacaaccatgccttgaggtttattaaccacgatcacttggtcatcttcatagacaatatcaagcggaatcggctctgcgacggcttctaagggtcgtgcttccggaattgaaacggcaatgacatctcctgacgagaccttataattggctttcaccggctggccgttaacggtgaccaagccgtcctgaagccatttttgtacctgactgcgggtatgggtcgattcatgggccgtgatcaccttatcgatgcgcccttgttcagtcgtgatggtaaaggtctcggtcatgcggacaccgccttgtcgcgatcaaataaaataaacaacaaaaccagaatcaccccgaatgtgatgcacatatcggcaaaattaaaaatagcgttgaaccgccactgatccaaaaattcaaggtgaaacatatccgtgacgtattgaaaccgcagtcgatcaatgaagttaccaatcgcccctgccgtgatcagtgtcaggcccagccgataaaccggcttatgcaggctatcacgccaaagcaacgcgacgaccacaaacgctagaaccgttgtgacgtagaagaaccactgtttcccttcaaacatggaaaaagccgcaccggtattacggatgtgcgtgagatcaatcacgcccggaatcagttgctggctttcgccaagtggaatatgcgcgctcacccaggttttaatgacaaaatcaatcaaaaccaagacagctgcaacgatcacataaataaacacagatgttccccctgaataaatgacatttgcctttaagtgtaccgcgccaaaagaaaaaccgccattcgaaaaatgacggttacatcttgcgccgaaaacatggatgatttaaaagagtccggaaattttaccatcatcggtgacatccatgtttaaagcggctggcgcttttggtagtcccggcatggtcaaaacggttccggtcatgacgactaagaaccctgccccaagcttagggataatgtcgcgtacgtgaatcgtaaatccttcaggtgcccctaatgttttggggttatcagtcaatgaatactgggtcttggccatgcaaaccggtaaatcctgccaaccatttttagcgatcgttcgcagtgcagcgttggcttttccttcataaacaacgtcaccaccaccgtagatcttttgcacaatagttttgatcttggttttgacatcctgatgcacatcatagagtggcgtgaaacttgccggctgcttcaaggcatccaacaccgcatctgccactgctaaaccaccgcggccgccgtcagcccaaaccgttgcggtaacagctttgacgtttaattttgcgcaagcatcgataagccactgaacctcggcatctgtatcgctggtgaagcggttaacggctaccacaacaggcacgccatagccctgcatgctgtgaatatgccgcttaaggttcgcaaaaccttgagccaaggcatccaggttttcctgttgtaaatcagctaacgcaacgccaccgttgtatttcagggcgcgaaccgttgccacaataaccacggcatccggggttttacccaaaacaggtgtcttaatatccatgaacttttcgccaccaaggtcagcgccgaaacctgcctcggtaatggcgatgttccccagttgcaacgctgtccgggtagctaaaacggaattgcagccgtgggcaatgttggcaaatgggccgccatgaatgaacgccggcgtatgttccagggtctggaccagatttggcttcaacgcatcccgcaataacatggcaatggcgccggtgacctttaagtcggccacggttacaggcttacgatcataagtatagccaatcacgatgcgactgatgcgggctttgagatccgcgatgttttccgcaagacacaagacggccattaattcgcttgcgacggtaatatcaaaaccgtcttcacgcggcacgccgctggttgggccgcctaacccgatcgtgacgtggcgcaatgcacgatcgttaatatccaaagcgcgtttccaaagaattcgccgtgggtcgatattaagtgtgttgccttgttgcagatggttgtcgattaaggctgcgagggtgtcgaccgcggttgtcagagcgtgcatgtcaccggtgaaatgtaagttgatgtcttccatcggcacaacctgcgcataaccgccgccggttgctccgcctttcatccccatcaccgggcctaatgatggctcccgcaatgcgatgacgggatgctggccgcgctgctgaagcgcatcgcctaagccaaccgtaatcgtcgatttgccttcaccagctggagtcgggttaatcgaggtcaccaaaacaagcttgccaaaaggcttgtcttttaacgcattgagagccgcgaagctaagtttggctttagacttgccataaagttccagatcatcatcggtcaggcctagatttgctgcaactttcgtaattggccacattgaggtcgcttcattggcctgggcaatttcaatatcagacatacaacacactccttatttagttgatgtttccaatcctttttcgatcaacgccacgatcttttgctttcgttttttaccgaacatcaggaacgaatcccgaccgtattgtttggttttaagcataactgtcaaatggccggacgtaaacccctcaatttcgctccaggacagattgatcgtattacttttaaaaagactggttaatcggatgcctttttcagtcgcaatcaggcgaagcagcaaaatctggccgatagccgtcaaaatcgtaatcgccgcaatcgcaatcgccagccatgaaggtttcgtactttccagctggatgatgatcgccaagctgagaccgatcacgatcgcgctccaaaacatgctaaaatcgatccaggcaggttgataatgtgttcgatagtcagccaatttgtcacttccttaggagaaatcatgcttaaactatacacagatggcgctacaaaaggcaacccaggcccgactggcattggcattctggtcagcggtttgcctcagcaaatccaacgacatgccgctttaccaccgatgaccaatcatgaggcggaatttgctgctgcgattgctggatttgaactattaatcgatgctaagttaacaaccgcgccagtcgccttttatagtgactccaagctcgtcgttcaggcgattgagaaacgctacgccagacattatcctgccttaacagcagaattgctggccttgattgaccggtttccgcttgtgctgcctaactggttgcccgatcgtcaaaaccgtggtgcccacaccttggcgcagcaagggttacgtgaagcagagacgaaaagttaatttttcgccaaaaagagaccgtgacattccattattcggaatatcgcggcctcttttggcatgaacatagatttttaaagtaaaatgacgcctcagccgaaagacttcagcacctgtgattacatgaatactttaaactggctggtacgatccatataatccttatcttgtgccggtgcctcgatggaaccaaacggcatctgggcacgcaattgccagttttgcgggatatcaaaggcgtcgctgacaagctcatcaatgatgggattgtagtgttgcagatttgcaccaatgccattgttagctaaggccacccatgtgttgagttgagccgatccctgagcctgctctgcccaagttgcaaagttatctgcgtacagcgggaagtcatgctccagctgcttcacgatgtcggtatcggtaaagtacataatcgttgcataggcggctttgaagccagctacttttttcttggttgcctcgtaggcttcctcagtcggaacttcactcttcaagcgcttaaccacgatatcccaaagcttgtcgtgttgtccgccaaataggaaaactgctcgggttgtttgcgaattgaaggccgttggtgttgcctgaatgacagattcaacttgttcgatgatgtcatcgtctttttgcttaacatctttgccgagtgcgtaaatggaacggcgttgcttgagaaggttcagaagatcttgattcacaggaaaaccacctttttctattaatggccacattgtcacgcatgtatccgataacctagctattcactagccatcaggaaaggcaatgcgaaaaaaatgtagcagaacaaaagtaagtgtaccaactcactattagtaagtaaaccccttgagcgatattttttcagaaagtgcaacatatggctcgatcatcaggtcacgatcacacttaagcgtatttaccataagggattgtttccgttaacgtgacagagataggtggcttgggtacaatgaaactattcttcttggaggtgcgctatgtcgctgatcacctggctaattattattattttggttttgaacaccacgggtgcgatttttacggttcttcgtgaagttcgcgacatttcgacgacctgggcctggttgctggtgctgattttcctgccaatcatcgggttcggtttttatctgttcgcgggtcgcggactctcgaccaaaaaactgcgccggattcagcgtgagtatgagtctggggtcaaagcgtttgtgtcgcttcaaaaacacgaaaatgcccgaaataaacttttgcctcctactgattacactccagcggcaaaagctctgaccgcctttttcctgaatacggcccaggcaccggtgctggcccataaccaggttcagctttataccgatggcgaaaagaagtttgctgcgttgtttcgcgacattgaaagcgccaagcactacatttatgtcgagtattacaccatttataatgatgaattaggcaatcagtttcagcaattattgattaaaaaggccaaacaaggcgtgacggttaaggttttatatgacgcttgggggtcgatgggtgcctcggcaaaatggtggcgccgactaaccgatgtcggcggtcaggctgagagctattttagctccaaacatccgattaccgactttcgcttgaattaccgcgatcatcgcaaaatcgttgtgattgatgatcacgtcggctatattggcggcttcaatttcggcgatcagtatgtttcccgtaaaccaaaattcggctattggcgcgatacccacctgcgtatcatcggtaacaccatttatgcgctgaaaattcgcttcacaatggattggaatgcgacggtcggtgaacaggacgagattgcctacaatgtcgagcaggatagtaccgaaaatcgctcaaacgagagcatgacggctggcagcacaccgattcagattgtcgcatcgggacctgatcgccctacccagcagatcaagttagggtacaccaagctgattactagcgctaccaagtcggtttggattcaaagcccttatttggttccggatgacacggtgattgatgcgctcgtttccgccgccatgtcgggcattgatgtccgaatcatgattcccgatatgcccgatcatccgtttattttccgggcgacccagtactatgccacctatctggctcgtgctggcgttaaaatttaccactatcaacatggcttcatgcatgcaaaaaccgtggttgtcgacgatgccattgccagtgtcgggtcagccaatttcgatattcgtagttttaaactgaattttgaggtcaatgcctttatttatgatcgtaaagttgccggggcacttgccgaaatctttgaagcggatatgaagcagagctacttattgacaccagcgattatcgctagtcaaagccgctggttacgcttcaaacaggacttttctcggctcctgtcgccgattttgtaagccagcctgtaagtcatcagaaattgaactatattgtcacaaaaacaccgcgtcagcatggggcactgaggcggcgtttttgtgaccgaaatatagcattttcaaaataatgataggtgtttagctgatcgccataatggcagtgaagaagacttgacgagtcggctaattaccgttgccaatcgtctagtgccttggtgtggccgagaagatagtggatggcagcttggacaagtgtgtcacgggcagtcgttaactcgtcgccttccaggttatatttgtcacgcaggtaaccttccgcaatagcctgatattctttgcgggcctcgcccccatcttttaggtaggcatcaatggcattcagatcatctttagcgcggttagctaattcttcagccagatcttcgacatgtggctggcgtttatgggcatagtccatcagcgtgtcattcatatcaacgacagcggcctcgtctgctttcttgtcacgtttcatgttcgcagtcatctcctaatacttttagtatgcacctacgccggattttcatcaacgccgcctattttaacaaaagcatcgataacagcgttcttactaatctattaaagcttgcgtcggtgatgcctgcccatttttcagagatgaaactgctggcgtgagcgacgaaataatacttgatacagcgcagaccagctttcaaagcgctcactgtctagataaaagaccggggtatcaggtacactggattcctcgcttgcagccaaagtatgcgcggaaatcacgaaatcgggatgttggtcaatggtaactaggcgaatgtaggcgggatgcacaagattaagccgcacggtttcgtacaatggctgtggcatcagcggatcaagtgctacttttagcttattggcaaccgcactttcggtcatgaacggccaaagcaattgatagaagccgtcaatgatctctgaacggactttctcatccggttcttctcgagcaaaaaaggcttcaatcgccttgccaagacgtggaaaaagcggccgcattgggctggcagttttcgctaagtcgatatacgcgccatcaggaaaaatccgttcactgatcagaattttcaataaattgccggctaaggctagatctttggaaactgctggtgaaataccgattaaatgacgactgaattcggtgcggattttttcgacggtctgccacgccgaggtattgtgggcaacatggtaaccgacaaatccggcagcgtcgaattgttgttctgtgtggaaacgcggaatccgccactgcccgagatacaaataaaggatttcggcttccgccacttcacggggtaaatgtgccaagacatctggcagctcatcaggcaacactgggcgaggttgtaatgccgcgaaattcagggtgttgccgatcgaatgattcgcctgcagtcgatacagattaatgttggccgaaaattgaagttgcttgacggagaagtccggtcgaatcaaaccggctgcctgcaaagactgaaccagctggcgggactgcggcatcatcgtggcaaacagtggatcctgggtgtcgactagctgccacaataattggcgataaacttggcgaattcgcggctctgcgccggcaagtgccaaaggcgtgagattaatggtgacctctttttggcgcaagtacccgcgtaatgcggaaatccgtcggaaaaaagctgcccgggagaaaccggtttcttctaataacatgggcaacgtcaagtcaggttgcatcagtgttttgaccaaaagctttccgggaagcgaacggcgaaacaaaaagattcggtagcgaacccgactaatcgaagggggtgccgtcatattgccatcccctctacgtaataaaggtggcgcactaggatcaatggcatgtaaatcctcggcgactttcgccatttgccgtcgcagttgccggtagctctcgccgcgggccatcgctgccgttgcaatattcatttgccgattaggcgcgtctcgcaaatcgccataaagcgccaaccgctcgcgttcttcgcggtctaggaacaattcttcaaacgccatggtgacgacctcctttccaaatttttgctatagtatagcaaagaagatcggcaaccggataaatgatgcttgtgtacttgtctcagacgcctgtttccttaacgggcaggctttcgccgctttaagtcagtctatgattgattagcactggcgtctggcatgcaatcttgctatactaaaagtaagcgaaaatcaagtcgacaccatatgctttggggcatcaaaaaaattaaccccaagatatggtgtttttcattgacatgcaccccaatattgagtattctaaactacataagataacaagaaaggatgatacctatgcgtaacatcacactgttcacgcgcaatggctgtccacaatgccggatgacaaagcgctacctcgatacccacaagattccatttacggaacacaacatcaacgaggaacctgaatacatcgattacttaaagaaaaagggattccagcaggttcctgttcttgaagcagatgggcttgattcattctccgggtttcgaccggatgccttgaagcaactggctgtctgaacagccagtttttttatcgcatcgaacttaaccgaatgaagataaattgcagtgaaagcagggattagcatgtcattaaaaacaatcagtccggacgaggttacttattacgcccttaacaacgagatcaatattcccgtcaacgaccaaattccgctcaataaggacaaggaagcattacaggcctttttgaccgaaaatgtggcgccaaatacgatgaagttttcgtcgctacaagagcgcttgaagtatttggttgaccatcactattatgaagccgactttttaaaaaagtatcagccggtcttcctggaaaagctggatcaatttctgacggcccagcattttcagtttaagtcctttatggcggcttataagtattacgctcagtatgcgttaaagacggacgacggcactcagtatcttgaagactacaaagatcgggtgtttgccaatgccctcttctttgcggatggtaatgagcagctagcggttgacttagcggatgaaatgattcatcagcggtatcaaccggctaccccttcgttcctgaacgctggtcggcaacgccgtggtgagctggtctcctgttttctactgcaaattaccgatgatatgaattcgattggccgcgccattaactctgcccttgagttgtcacggattggcggcggggttggcctgacgctgtcgaatttgcgtgaagccggtgcgccaatcaaaggtattgacggtgctgcaagtggcgtattgccggtcatgaagttgttggaagattctttttcctatagcaatcaactgggtcagcgccaaggtgccggtgtggtttatttgaatgtcttccatcccgatatcatcagtttcctgggtgccaagaaggaaaatgcggatgaaaagtatcgggtgaagacccttagcctcggcgtgattgtccctgataagtattacgagcttattaaggacaacgccgatatgtatctgttctccccttattcggttgaacgggcttatggcaagccattttcgtatgtggacattaccaaggaatacgataatatggtggccaatccggacattaagaaatacaagatcaaggcccgcgatctggaaaatgaaatttccaaattgcagcaggaatctggctatccttacatcatcaacatcgacactgccaacaatgcgagtccgattgatggcaaaatcatcatgagtaacctgtgctcggaaatcatgcaggtgcaggtaccgtccaagctcaacaacaaacaggaatatgaagtcttagggacagatgtttcctgcaacctaggcagcacgaatattcctaatttgatgcatagtcgcgattttggtcacagcgttgaagccatggttcgggcattgacctatgtcaccgatcacagcaatatcgacgttgtgccatctgttcagcacggtaatcacatggcgcacagcatcggccttggtgcgatgggcttgcacacgtactttgctaagaaccatatgtattatggttcaccggaaagccttgatttcaccaacatctatttcttgttgctgaattattacacgttgaaggcatccaacaagattgctaaagaacgtggcgagtccttccataattttgaaaacagcaaatacgctgatggcagttattttgacaagtatatccaacaatcatgggcacctaagtacgacaaggtgcgtgacttgtttaaggatgttcacattccgacccaggcggactgggaagcactcaaagagagtgtgatgaaggatggcttgtatcatcaaaaccggatggctgtggcccctaatggctcgatcagctatattaacgataccagtgcctccttgcagccaattgttaaccggatcgaggatcgtcaagagaagaaaatcggcaccatttactacccggcgcctggtttgtcgaatgacaccatgccttactatcaaagtgcctacgacatcgacatgcgtaaagtcattgatgtttatgccgctgctcaacaacatgttgaccaagggatggcgatgaccttgttcatgcgtagtaccattcctgctggcctttatccgtggaaagacggccgaaccgacaagatgacgacgcgtgatttgaacattttgcggaactacgcacatcacaaaggcctcaagtcgatttactacatccggacttacaccgatgaccaggaagaaatcggtagcaacgcttgtgaaagttgctcaatttgattatcttttaacagggggatctcccctgtttttacatacaaggagcgaagaatatggcaaaacaatatattgcgattaattggaatgcgattgaagatgaagtcgataaggcgacttgggaaaagttgacggaacaattttggctggatacccggatccctttatccaacgatttagatgattggcgttcattgagtcctgatgaacagtgggttgtcgggcatgtctttggcgggctgacgctgctggataccctgcaaagtcaagacggcatggcaagtttgcggcagaatatccgtacgcagcaggaaacagcggtcttgaacaacattcagttcatggaaagtgttcatgccaagagttattcgtcgattttctcaacgctgaacacccctgcggaaattgatgaaatctttgactggacgaatcataatgaacatcttcagtacaaagccaacaagatcaacgatatttaccacaatggttcagcgttgcaaaagaaaattgccagtgtctttttggaaaccttccttttctattcaggcttctttaccccactctattatttaggcaataacaagctgaccaatgtggcggagatcatcaagctgatcattcgggatgaaagtgtccatggcacgtacatcggctacaagttccaattaggcttcaatgaattgccagaagccgagcagcaaaaattgcaggattggatgtacgatttactttacgatttgtacgaaaatgaagagaagtatacgaatgatttgtatgctaaaaccaagtggacggacgaggttttgacattcctgcgttacaacgccaacaaagcgcttatgaatctgggccaggaaacggcctttgcagatacggctgatgatgtgaacccgatcgttatgaacggcatttcgacgtcaacagccaaccacgacttcttctcccaagtcggtaatggttatcgactgggacaggttgaagccatgcaggatgacgactatacattttcaactgaagacgaaggccatgataagtaaggctttcggaaatgaatgtgttgagaaattaaaaaaccggctccaaatgcgtcgcaggttatgtgcgatatgcatctggagccggtttttgatattcactttttaaatcagaatgtcaggaatagctcattttggatgatcgtacgagatcctcttttcctttcggtctaactttctgctttttgctggctgatcgtttcatgaacgaggcttaagaagcgttgggcgatgcgtgaaagttcgcggtctcgtttccacactaacgcaatcggatcggctaatgccggagctaaaggacggaaggttaaggaagtgttcgatgtttgcgttgccagatattcaagacatagcgcgcgccctaatccgactgcggtcatgcctaaagcatcagcggtcaaatcgtaagtgccaacaatgtaagctggatcaagtccctgtcctagccagtgttcaaaggcattgcgagtatgcgtggcccgcggcagaatcagctcgctatcgttgagatcgtttggcgtgatcagaaggttatcggttaagggatcatctgtggtcatcaaaacgccccaggcatcgcgaatcgggagcggcagactttcgtactgggtctgttccttacctgggcgcaaaataaaatcgtacataccggcttcaagattagcaatcagactttcatcggaaccataagtcacatggacatgtagactggggtactgcagccggagtgattgggcaacctgcaacatcaggcgcttgccactggtttcgctggcaccaatgtaaagatcaccacccagtgtatgtttgccttgcaaattatttttggtgcgttcggcgatggcggttaactcgcgggcccggttcaataagtaggtgccatcttccgtcaaggtgactcgtcgattccccctgatcagtaacttaacacccagttctttttctagatcttttaattgccgcgataaccccggctgggaaatacctaatgttctggcagcagccgtaatactgccatggtcggcaatttcaataaagttacgcaacgtctgcagttccataaactcccctacttcctatcagttctgattatcgcagatgctctcctataactattataacctatcaagaccactttgtattccctttcacacgcctttgctcaactgtgacttaaatccgctgctcggaagatgatgcttcaatgcattcacttctggtcatcagcattgcgtggtgctttgtttagcgccattcttctaaaaaagcatcgactcactgagtcgatgctaatgggattaccaaatttgaacgcgtttttccggcggtagatacatgccgtcgcctggttgaacatcaaacgtcgtgtaccagtcatccagattacgcggctggatattggcacgcaactcatgcggggcatgaacatcgacagccagcaacatttttgcccgttctaggcgggacttggagcgccagatacgcgcccagttaatgaaaaatgcacgcagatcggcatccggctcgcgtttggcagtatccaaagctgccgccaaaccaccggcgtcggcgatattttccgacacaacgagtttaccgttaactttgcctgcttcggtttcgagaccgtcaaattcgtcaatcatggctttggttagctcattaaagtgcgcatagtctgctttttgccaccagttgaccatattaccgaattcgtcaaactgtgccccgttattatcgaacccatgcgaaatttcgtgagcgataacggcaccgatgccaccaaggttttctgaggcagtttgcttcaatgaataaaatggcgcctgcagaatcgctgctgggaaggtgatgtcattttttgacgggtcgtaactggcattgaccaaatggcccggcatattccagacactacgatcaaccggcttgcccagcttatcgtaattatattgttgctgaacgatttgcatggcttttaagttttcaagtaaagacttttccgggtcaacgtgcagtaaatcataaatggcttcaggcttgtccggatagcccattttgagtaccatcttatcaagtttgaggatagctttatctttggttggttgtgagagccagtcagaattggccaggcgctgtttgtaagtggcaatcattttttccaccaactgggttacatcggctttcgccttttcgccaaaataagtgcggccatagtaaataccgattggctcactgaaataggcattggctacccgataagcatgcttaacctgatccggtgatttcggtgccccggataatgcgcgattataggtgccgcctaattgtcgcagcggttcgctcaagaaacctgcaacactatcgagacttaatacataaagccagtcgcggtagttcgcaaaattggcttcattgaataactgaccgaattcatccaaaaagcgcggatcggcgacgacaatggtatccggaaccgttttgaaaattgccttcaggaagttttcaaaatcaaatggtttgagtttttcaacgacagtagttgtcggcattggattgtaagcttttggataatccgcccactcttcggaacttttgacgtgtttagcaatttcggcatcaaaagcaagcgcgcctgccaaggttgctttttgcgccgcttcatcaagatcggtgtatgccagtagcttgctcatcatgtccttgaagatcgcaagtagttgggctccgttttgattgtctttggcgtaataggaagtatccggcaaaatggtcttgggtcccatgagattaatcacatttttgctggtgtccttcatgtcggcatcgacgaagacgttgaacggcggatcaatgagctgttgctgcagtaactcggcagcacgttgattgtagtcagccaaatctttgatggcggcaacttggtgcaacgttggtaaagccggtgcaaagccggcagcgtcacgtgtcttaaaatctttggcttgctgataaagcgtgactgcctgcgcaaaatatttgtccggtgcttcttttgaaccatcggcaacagctgcaaagtcagccatcattttttcttctacttcgtcggctaaatcctggaaaccgccggtactgcttttgtcatcaggaatgactgcttgatccatccaagccccatttactgctcggtatagatcgtcttgatagcgcactttactcgtcattcaaaagctcctttcataataaaacgatatatgacaatcttaacgcatttctcatttagttgcacgaggaatcagttgagcgacggtgccggttgtcattgtcactgtaaaaccgaatagaacgattgttaaaaggtgttcactctgcgccatataaaaatattttatggaatcgattccatttagactaatgaattgtttacaatcgaaatcgctttctttttaatgattaactcgttaaaatagaccatgtaccaaatggcgcttaacaatcttcgttgagtgccacaagatcggatgttgaaccggcctttcggtttctaaccgcgccagttcacgcttcatcataacgcgttcaccggcgcaggagtctgtgtgtaaggaccttggtcgcaatggccaaagagcgggccatcacgcccaaggccacttacactccgactcctaaccgcgccggttcacgctcacaaggaggatgttaacagcactcaaatatatcgaatagtatggaatcaagtggtacaacatggacaaaataattaagtggaaggtgtccatgtgttcaaaccaagttaactggcgaaatgtcttgacaagaacctgaatcgctactgtatgatggttcttaccaaagttacgctagctagtattggtttgaacgtctacttcaagcttcctctcgagtagcgtttaaccagctaattgagaggaggtgacaacttttgattaaaacgcataagatcaagctctatcccaatgcaaccatgcggcgcgaactggagcgattgtttaactatcgccggttttgctggaatcaggccctcgaaacttggaatgtcatgtacgacgcatctctcctgatggcggacaaaacgctgcgaccaaatgaacgtaaagtgcgcgatgagctggtttggaacaaagctgactggcagtacgaacaatcagcccgagttttacagctcgcggtaaacgatttaagtaaggcgtggaagaactacttcaatccgaagatgccagatcatggtaagcccaactggaaatctaagaaacgatctcgcaaaacgttcaaaacggatcgagcgcaacttctaaacggcaagttacgtttggataaaccccgtggagctggtgcttggtatgacatcaaactagccgagcaaccgcattggcaaggagaattgaaacaagtttgcgtcgttcaagccgctgacggttactatgcttccttttcaattgaggttcagacctctgttgaaaagcggccggttctaactgtcactggggttgatgctaacatcggtaagtttgactatcgaacgtcaactggctacgctatccaacctaccttgcctgatcgtctgccaatactttatgcccgcattgctcattatcagcgccaattagctcgcaaacggaaagtaaatcccaagcgttttaactccgcggcttatcgcacaacgagaaccaagttgaagcgccagtaccaacgagttgaacggattcaaacggatttgctgcaaaagtttacgactatgctcgtcactgattatgacttaattgggattgaagatttagacaatcaacacatgcgcatgaataaacgtctcgccaagaacctgcatcgatccctgtttggcaagttcaaagtgatcatgcagtacaaggctgactggtatgggaatacgttagtgctagcggatcagttttaccccagtacacaacgttgttcccgctgcggtcatgttaaaacggcagatgaacgggtcacgctaagcggcaacttaaaacaccggaccggccacgatgactatcattgttaccagtgtggggtgaagttgcggcgagacgaaaatgccgttgagaatctgatagcttatgcgaaatcaaaggtttacggggtaggctatacccttaaagttcaggaggcggtcactgtcgggctgatttatttcagtgcgggaataccgttgttgacgggactaaatgaaatgtaggattgtcaatcaagaaaggaaatatataaaacctttattggtgtcaaagagacattcttccacgttttatatagcaggaaacccatagatgtactatgtcattatgaagtcccacgatattcgcgagaatttggcgacggagcagtatttgatgaacgccaaacagtttgatgagccactgttgcttttttattatgaaaagccgagtgtgattgtcgggcgcaaccagaatacactggaagaattgaatcagaagtatgttgaggaacataatattgttgtcacgcggcggctatcaggcggcggtgcggtttaccatgatttgggcaacctgtgcttctcgtttgtggtcgatagcgattctgaagaattcggcgacttcaagtccttcactcagccgattgtggatgcgattcacacgttgggtgccacgagcgccgaggtttccggccgcaacgatatgctggttgacggcaagaagttctctggcagtgcgatgtacacccgcaacggcaagacgttctctcatggtactttaatgctggatgtggacatgagtgtcattccaaaggtcctcaacgtaccggaagacaagattaagagtaaaggtattaagtccgttaagagtcgggtcaccaacctgcgcccttacttggacaaaaagtatcaggatatgacgcttccggaatttcgggatatcttgttaacgcgtttgttcggtgtggatgatgttgctgagattaaagacaaggaatatcacgttactgacgctgaccaagtcgaaatcaagaagatttatgacgacgtttacaacaattgggactgggtttatggccacagtccggaattcactaccaagaagcgtaagcatttcgattacggtacaatcgatgcccgttttgatattaaagacggcaaaatcgcaaacgttaaattctacggtgacttctttggaccacaagatgttgctgacgtcgccgctgcgttgaaagacaagccgtatacgtctcaggcagttaaggagacgctggatggcattaacaccaatgattacttcaccaatattcctaaagatgacgtgatcaacttgctggtaccttaagcattaatcagttcaatatttccaaaaaggggcagccattttaccggctgccctttatctacgccttcttagaagcgttaattatatttaatttggctaatggcgtacgcctgaattcgtttagctcctcgcccagttgctaccgtaatgacgccgcgttcgttgtacggtttaacttttgccgccttaatgtcgacgacacggccttttaggcagcggcgatcgatcgtatcgatcgcaacctcgtgctgtgagtgtaaagcatcttgaagcaagttggtaatttcttccgggcgttgtgccataagaattcctccttcatcttcatgccgtctgaaatgctggcggcaactgtttcaacgcgtattgccgctttgccgggcaatacagtaactgaaaacgtttacgagttcagtataacggttgccggactaaatttcagtaacctcggctcagatcgacttgatgacttgctaattgaccgcttaataccaaggcttggaggttttcattaaaaattttaaaaacttggtcgcgcaaatgaggaaccgtgccggaaatgtggggtgtcaacaaaacctgatccatgtcccaaagcggcgaggtttgcggcaatggttcaggatcgaccacgtcaagaacagcagcacgcaactgctgggattgcaacgcttgaacgagtgccgctgtttcaacggacgccccgcgcccgatgttaacgaaaattggctgccgatcgagagcagcaaagaattcttcgttgtaaaaatatctggtagcaggcgtgagcggcagtgcgttaatcacaatgtcagccgttcgaatcacccgctttgtctcagcatcggtcacgacatcctcaaagccagctgcaggccgaccatgggcactgacaccaatcgtatgcaatcctagcgcttgcaacttggaggcaatcgtcgagccaatatggccggttccgaaaataaccaccgttaaccccttcagtagcgtcattggcggccgttcctgacgcaatgtccacatctggcgccctgcgcgaatcgccggtaggataccacgactgatggtgaacaaagcgccgagcacatattcagcgatcggttctgcgtgaatgccgctggtattggccagtaagacgtgatgcttggcaaaatcagcgagcggtaaatagtcaacaccagcggacattgcctggacaaactgcagatggtcataattaaccgttgctgaggccgcatgccagccgtaaatgacatcgatttgctgggcggtcgttgcgtccagttggtcttcttcgatcacggtatgcccggctttttccaatgcctgccgttgcgctggttcaagagtgaagctatttagaatcttcacgattcatccctcttttctgtcgtgatggtgccaattgggtttgccccaatattggaaaagatcggttcggattgtgccattgtatagtttgcggcgtttggtcgctttactgccataggctttctcaaagcccatgtcgctcgttagaatgtatttgctccaggtggtcaaaggcgcaaaagcctgccccatttccgcatatagctggcggacggccgcttgatcgcttagacgttggccataaggcggattagccacaataacgccattttctttggtggtcgtaaaatctttaactgccaattgtttaaagtgaatgctatgaagtagccctgcttgctgggcgtttaacttggccatgtcaatcatttcaccgttaatgtcacttgcctgaatatcaagttctcggtcaaaatccgcctgatccatagcctgatctttggtggtcttcaatacgtcttgatcaaaaaaggcgaagttttcaaaggcaaagtgccgttgtaagcccggcgccaaatgatggccaatcaaagccgcttcaatcgcgatggttccggaaccggttgtagggtcgacaaacggcatatcgggatgccagttggtgagcaaaaccagtgccgccgcaaagttttctttcagcggtgcctcccctttggcaatccgatagccgcgtttaaataagctgggcccggtcgtatccaaagtcagcgttgccacatcttttaaaatcgaaacttcaagcggatacttagctccggtttcgggtaaacgggtggtgcggtggtaaacggccgacattttctcgacaatcgcctttttggtaatggcttgcgcgtcaggctcagaatgcagctgtgagcgaaccgcccggccttcaaccgggaacgccgcatccagtggcaaatactgatcccacggcaatgctttgacgccttcaaacaattcatcgaaagtgcgcgccttaaactgaccgaccacgattttgattcgatcggcactacgcaaccagacgttggttaaggcaatggtttgatcatcgccttgaaaatacactttgccattttcggttcgggtctcaatgcccagtgcttttagttccttggtcgtaacagcttccagtcctgctgccatggttgcgacgagttgatatgtcatgacgtgatttcctttcaaaatgccggtttaaagaatggtgttcaggtctagtttaactttttttggcggggttggcgatgttggattttaaggtgggggaattgttggtgacgggataggcgattgagttttgcattctgtaacgcgtttaccggcgtgtaagagcctttggcgtgatggcaaagctcgcgttaactaggagatttctattgtgggcaagtattagtctgacttgcgctttctataacgcgctcgccagcgcagaagcttgcgtgtaaggaccttggtcgcaatggtaaagaccgccatcacgcccaaggccacttacactccggtttctaagcgggctggctcgcgctcacaaaaaaacagcccgagtctccccgagctgtgcctgcatgtagatccctataagccatgttttgttccagaacctgttcaggcgcaggttccttcagtcatcatctatctcagcgttgccgctgtattgccgtcgcttcactttgcttggcaaaacgcccctaccaaaagtttgggttactcgctcgcggggtttacccgttccaccgtttaggtttccctgaacgtttcgtcactgtggcacttttcagacctactggcgcatagccgaaaccttagcgcggttggtcgccgtaaccgttgacacggtccctaagcttattgggcttagcacgaacactacaagcatcgcagcttgtgcgggcatggactttcctcagcctgcagatgcagaccgcgatcactcaggatctacatgtgatcatcaatattggtcaacgtcggaatggctgttgtcatcgtgggtatcagcgctgccgctatccgatagctttgaaccgaaaacatgacgctccagattactcagacgtttaagaatatcataatttgtggcggcagcgttagtttgcggtgtctgcgcactgacattcttggaaacactcagctgtttggttagctcatcgacccgactaaacagctttgcattttcttctttcagtcgatcaatctcgttagtaaaagcttcataatcacgaatgatgccgtctaaaaattcatcgacttcatccggatcataaccgcgaaccttattcttgaacttcttgtccaaaatatctttaggtccgtactggatactaaattttgtttctttgttactatccattccgacacacctcattgttttcatggaaccagactaacaataagcttaccatatctcaatcgttttgaaaatgctcattttccgcttctgccatttcttgggcagtgtcttccaaatcgtccatcgtaatcaacgtgaccggataatcacgccgttttgccatatcttcggcagcgcggtaatcccactgcggcttaccgggaaactccggatcgtaaacaatcaccgcagcatccgtgtgtgcggtcatgaaccgcgtataaccctgtaactgtgccggtcgttgatacggcgcctgcgaaactgcatcggaaaaatcgacttgctggcgtagtgcggccagttgtccctgattggcttcattccactttgagccaaaatccgtaaacggcagcatcatcgcaattttaaagtcgggatacaatggcttcagcgttaaagcaacctcgattgcccactgctcaacgcctaattggccgccggtaatcaaccagttcaaaccttcatccagatactgaagtaaggtgttttttaatgaagttttaaggacttttagcttcgggtcctgattgccaaaaacgttgagttcataggcacggtatccggttatccacaatcgttttccagccatgattttcctccaaatattaggccaacgcggttgatattggtataatagcgccaggagtgtgatcgcatgaccattcgttatcccaatggtaatccatacaaagacgggacgcaattatcaccggatcccgtttcgcgcccaacgatttatggcgggcgtgggatgacattagaagaagaacttaatctcagtaatcagtattatcgcagtgttgacaaggcggtcgtgtataaaaagccgacgcctgtgcaaattgtaaaagtcgactaccccaaacgtagccaggcggtgattcgtgaagcctactttaagaccccttccaccacagattataatggggtttatcgtggttattaccttgactttgaggccaaggaaaccaagaataagacaagcttcccgctaaaaaacttccatcagcaccagattgatcattttcggcgttgcttgaagcaaaacgggatctgttttgttgtgattcgatttgcgacaattaagcggctttttgtttttccggcaagccgattaatcgcatgctgggatcaccagagcaccggtggccgtaagtcgattcctttaacaaaaatcattcaacacggatttgaactccatccgcagttgcaaccggtcgtgccgtttcttgacggcgttgactggttgatcgaaacgaaagtaggtaatttgcgtggctgataatcaaaacatgtcgcgaatggcgcgacgccgcgaagataaactcactaatggacccaagccgcccaagaaattgtggcggcgtattctcaagtggacattgcttggattgcttgtcctgttcattgcaggcgtgggcctgttctcttggtatgccaaagatgcccctgaagtcacccaggcgaagttggaatcaggcggttccagcaccatttatgatcgcagcggaaatgagatcacgacgcttggactcgaaaaccgtgattacgtgaaagcttccgaaattccgcagcggttgaaagatgccgttgtttcgattgaagatcgccggttttacgatgaaaagttaggcattgatccggttcgaatcatcggcgccgccttcaacaacctgactggaaccagcgatggccttcaaggtggttcgactttgacgcagcagctcattaagctgtctgtttttagtaccaagtcttctgaccaaaccctacgtcgtaaagctcaggaagcttggctagcgatgcaggttcagcaaaaatacagtaaggatcagattctggagtactacatcaacaaagtcttcatgaattatggtcagtacgggatgagcaccggcgccaagttttattttaataaatcgctcaaagatctgacgttagcgcagacggcgtttattgccggccttccgcaaagccctgcaggctatgacccttacaaatatccgcaaaaggcaacccagcgccgcaatgcggttattgatgccatgctgcgggacaagaagatcacagcagcagacgctaaaaaggccaaggctacgccgattacggatggcttgcagccgaaacagcagcaaactaataccacgaccaatgacaagattgtcgattcttacctcacccaggtgatagccgaggtgaagaagaaaaccgggttaaatccgtatactgataatctggatatctataccaatattgacatgagtgctcagcgccggttgtatgacattgttaataccgatgactatgtgaacttccctgatgattctttccaaaccggggttaccatgaccgatccggataatggtgaagtgctggcacagattggtggccgtaaaaccggcgatgttcgccttgcctataaccgcgcggcgcaaaacacccgcagtaatgggtcaaccatgaaaccgctcatggattatggcccggcaattgaatatctgaactattccacgtatgagcaaatgctggatgaaccttaccagtatccgggaaccagtatttccttatatgactgggataaaaaatatcaaggccggatttccatgcggaccgccctcgaacaatcacggaatattccggcagtcaaaactttgagcgctgtcggtatgaccaacgccgtgaaattcctgaaaggcttgggcattgatttgccaagttcggaacaatacctctcaagtgcgattggcgcttcagttaacaccgtccaagaagctggtgcttatggcgcttttgcgaacggcggcacgtattacaaaccgtattacgtcaacaaggttgtgagtgctgacggcaacacgcagacctttaatagtcaaggaacgcgtgcgatgaagtccagcacggcgtatatgattacggatatgctgaaaggtgtcttgactaagggtaccgggacagcggcagctatttccggacttcaccaggccggcaaaaccgggaccaccgattacagcgatgccgaacttaaacaaaatccggcgttaaacgcaacgggaattgctaaggacgcttggttcaccggatatacgcgcaatcgggtcatttcggtttggacaggctacgataaaccgacgtcgcatggcattagttatgctgagcaggagatctcgcagaaaatatacaaagcgctgatgagttatacctcacagaatctggataatcgcgactggaccaaaccagatacggttgaatcctacaacattctaaaaggcagcaatccgggaacagcaattactggcggctcaggtaataccacgaaagaactgtacgtccgcggtcatgggccaagcagtcgcaaagcggtcgccgagtcttcatcctcaagtgccacttccgaatcatcttcgtcacgggctagtgatgaaagctcaagcagtgaagtttccgaaagcgttgaatcaagtgtttccacaccgagtgtcacaacgccaagtgcctcgcaggcttcacaagaagaatcatcttcaaatagtacgccttcatcggcaagcggtggtggctcctctagcggcaatcagtaaggcatttaaactgccgactgaatactaaaaagctcgacgttactgccaaatgttttggcggtggcgtcgagtttttttgacgtggaaacttgattggattttgggctctttcgagttcacacttcatgtcaaaaggtcccactactttgatgcaggcacatcaaacagtgggaccttttctataacgttaatcttgcggtgctaagtgtaagacatccaaatgatgttgttttaacaacgcttcaccatatgggtcattgcggtagtcatgcgcataaacaatgcgcttaatcccggcttgaatcaaagccttggtgcaattcagacacgggaaaaagttcacgtaaacggttgcgccgtgagtactgacaccgttggctgcgcattggataatcgcgttcatctctgcgtgaatcgtgcgaatgcagtggccgtcacgcattaagtgccctgcctcatcacaatgcggatcgccactgatggcgccattatagcccgtggcaatgatgcggtgctcctgcactaaaacagcgccaaccgtggcccgctcacaagttgaccgttccgaaacttgttgcgcgagttcgagaaaataatgatcccaactttcacggtgaacccttcgtttagatggcacaattttatctgtcaatgcttagctgcctccttaagcggcgcgtaatgctgtgctaaaaatgaccattcggaaccggccggtatttttgggtcgcgggcgcgtaaatgctcgcgaccaaaacgaatcaggctgcggtgcaacttgatccaggtagacttcggcattaatgcttccagtcgcttctgaatctgaactggtgtggccttaggcgaaactaatcccaaccccttcacaatccgactgacatgtgtatcgacggccacgccaggaatgccgaacgcatcgctaagtacgactgtcgccgttttcttgccgacccctggcagcttaaccaaatcagctgcgtcagctggaaccttgccgccatatgactgaaccaaaatggcacttaatgcctttaaatgggctgctttcgtccggtacaacccgagtcggctgattttttcggcaatatccgtcaccggcgcagcggccattgcttccggagttggataagccgcaaacaatgccggggtgacagcattgacggcaatatctgtcgtttgcgccgacagcatcaccgcaaccagaatttcaaaagggttcgctgcgtgcaatgtcggttcgggatcaggatatagtgccatgatttggttaaacaattgcctagcctctacgtcagtcatgaatgcgcctcctagttggctttcaccgcttttacccgatgaaagtatgatctgatctgatttgatggtgaatctaaagctcctgatgccgcttaatgtcagcttggacttgttgcgcggttttgagatggcggcgttcccagtttagcaaaatgcgatccatatattttaatgagtacgccgaattcaaaaccgcctcgcgtaatgccaacaaaatgacctccggcagataatgatcagtggtcaaccaatcccgaatggtttcctgctcaatcggggaaagcggccggccaaattcaatttcgatttggttgaaaacgtttgtctgggcatcggcatttggttgcgtcatcgccgtgctggcggtttggccgctattcggaatttttgcaagtagcggactgagatcatagtaatcacgcatccgcccttgattgtcaggaacgctttccagcacgatcgcttttttttgaatcaaggtttcaatggctgtgtaaatcgcgttaggtgcgacattcatctggttggctaatgctttgagatccggtgcctgatgatgctcggattgccattggtccaaaaaaagatacgtcagaaattcggtctgtgtcagccccaatgctggataatggtcaaacagcaggttcgagacactgaactgtcctgcttcagtataagtccttaaatcagtcattcttgtgaccctccaaaaaaagccggcgcgttggcgtccgacttttgcgtgccattacggcttcaaacgattgatcatgcgtgggaatggaatggcttcgcgtaagtgatccagcttgcagatccaggtaattgcccgctccagacccaaaccaaaaccggaatgcggcacggatccatacttgcgcaagtctaggtaccattcgtattcatccaaatcaagcccggctttttcgatggcagcctttaatgtgtcataatcggtttcacgttcggaaccgccaatgatttcaccataaccttcaggtgccagcatatcggcacagacatattgctgcgggtcatccggatccgtcaacatataaaacggcttgatgtttttcggataattcaaaacaaacaccggctgatcgaattggtcagacaggtaggtttcttcaggcgaaccaaaatcatcaccatacttcacattcattccggcatcctgcagcatttcgatcgcttttttatagctgatgcgtgggtatgggagcttggtgtattgtttgaggacttcaggatcgcgaccgagcaaatgcagcggataactgcagttgtccaacaccgcctgaactaagtaagcaacgtaacgttcctgaaccttgaggctttcttcctgatgacaaaaggccatttccggttcgatcatccaaaattcggtcaaatgacggcgggtcttgctcttttccgcccggaacacaggaccgcaagtgaagactttaccataagccatagcacctgcttcggcatacagctggccggactgactgagataagctttcttatcaaagtaatcggtctcgaacaattccgtcgttccttcaggtgctgaatcagtcagaattggcggatccattttgataaagccttcgttgttgaagaattcaaaggtcgcacggatcatttcgttacgaatttgttgaatggcaaattggcgtttggaccgtaaccaaagatgccggtgatccagtaaaaactcaatcccgtgttccttaggggtaatcggataatctgcagagtcgccgacaagttcgatatcgcgcacttcaatttcgtagccaaaatgactgcggctgtcttgatgaatgacgccggtgatccacatgctggactcttggcgcagctctttggcgagtttaaacacttcatctgagacgtcagctttagaaacaacgccttgaaaatacgccgagccatcgcgtaactgaagaaaagcaatcttgccagagcttcgtttgtcagtcaaccacgcgccaatttttacttcttcgtttacatgttcctttgcatcaatgatgcgaatcttttcggtcatgccttaactccccactttaaaaatataaaattatttccggacaaattcctgaatgcgccgcgctgcttcgcgcagactgttaagatctttacaataactgatgcgcgcatgatccggcatcccaaaggcgcgccccggaacaatcgcaaccccggtttcattcaacagagcgctgataaaatcatcaacggtgccataatggcttaattgcgctgcccgcttaatattcgggaaaaggtaaaaggccccttgtggcttctcgcccatatcaaatcccggaatttcggccaacagatcatagaacagattgaggcgctcttcaaacgcttgacgcatcttttcgacaacgctctgatcaccggtaagcgccgctacagcagcgtattcggagacggctgcaggattagaggtggtatggctgatgaaggttgccatggcttgcatgagcttttccggaccggccgcatagccgattcgccacccggtcatggcataagatttggaaacgcctgaaattaaaaccgtattatctgcaatgtcaggatcaatactgatcatggatgtataggatgtgccattgtaaatcagatcccgataaatatcatcagtgactaccagaatgtgatgttttaaggcccagttgccgattaaagtcaattcggtgcgattatagacgacaccgcttgggttttgcggcgaattgatgatcaacgcgcgcgttttgtccgttcgcgcagcttcaagatcatcaacgctgactttatggccaactgctggcatgaccaagtgtgggatgccgctggctaatttaatctgttcctcataggaaacccaatacggaaccggaatcaacacctcatcgcctgggtttaaataaatctggaataaggcgtataaagcaaactttgctccagtagtcgcaacaatctggcgcgccggatagcggaccccatcctgggcaaaaatccgatcgctgatggcttgttttaattccggaataccggttgctgctgtatagaagctagcattgccggcttgaatggcagcaactgccgcgtcatcgatggctttaggggtcggaaaatccggctgaccgatcgataagtcaatcacatcggcgcctttcgccttcagttccttagtctgattacttaatgctaatgtcgcggacggtgcaacgttgaggattctttttgctaaatgcacgagggcgcctcctacagtgtcgacaccactcaggatgtcgaatcatgctaatttatagatttttgatcgcgttcagctgttcgccgctgcgaaaactgtacgtcacgtaattcagtttaccagactttgacagatagccaatatcccaaacgaattccgagccacgtttacctaaggaagcgtttaaaatcttcttcgggttgttatcacttgtcgcttgttggatcgcctgttgccgggtgataccggatttttggtttaaaatgtcgactttgccggtttttttctgaataacgacgtagacggacttatttttttgcgttcgtccggcaacgcttaggtagcttttatcgcggttataccaccaaaagccgttaatcgttttcaggtcggcccgattggtggcaattcgttcagcttggctgcgtaattgctgataaggcgagatacttttggcataaataccgataaccgcgatgatgagaatgatgaggccgctgatcaaggaaaatttaagccaatcaaaacgtcggtgacgccgcatggattgttccctcctttgttgggtgagtgagttgtaagtataaggttggccgatgctgctgaaacgcgatcaccggcgcaggagtcggagtgtaaggaccttggtcgcaatggcctaagcccgggccatcacgcccaaggccacttacactccgactcctaagcgcgccggttcacgctcttagccacattttgacatactctggcatatcgtttagaggcatggtcatgggtttaatattcggtaaggatttttgcatctttttaccgtattgcgtagtgatgaagcgcggatccaagatgacgaaagcaccgcggtcggtttcggtacggatgaggcggccgaagctttgacgtaagcgaagcgttgctcgtggcagtgcatcgtcggtgaatggatcgccgccactggctttaatttgggcataacgggctttggtgatgggtgcttccggtgcgtcaaacggtaaccgagtcaagatgaccatttcgagtagtcgatccggatagtcgatgccttcaaaaaagctggctgcgcctaataatagactctgctcgccgactgcaaagcgcttggcaatcttttccgccgagccggtcacgccttgtgccaacagttctttgtggtcggcaatggggcgatggatcagtcgttgataaacgtcctcgatcaccgccaaagagttgaataacacaatggtttgatggcgattatcagcaagtagctcaattgcctgagcaaggtagtccgcataggctgatgctgacacctcactggcgtttggcgcatctgtcgcaaccaacaccttggcttggtcacgataatgaaacggactgcggagtttcagaaaactcgtttcggggagctcgccgtagcctagttgccgggtcaaaaaatcaaaggagcgggcagccgtcaacgttgcgccgacgaaaaccggtgccgtaaattgacgaagtaactgttgcaccgctgccccaacctgaaaaacatcccaacttaagcctaagcttgccacatccttcacctggctcaaggtaattgacgcaacggcagcccggccgttgattagctccggcaatcgtcgaagcatttcctgcagccgattgcgttgatcagccaaactcatgcgcaatgctgctagtgcctgaaaacgttgaccgtcactttttaaaaagaaccgtggccgttgattaaaatcagccgtcagtttacctgccgtcactgtcagccgaccaatgactttgattaatagtttaaccttatccgactgagtttcacgcagccagtcgacggcggccggatccaaacttaaattgacaaaaccagacatcgccgtcgttttaccgtggaaaaagtgccggtagatgtcttgctgcaaagtggtgacggttgtttgcgccgtttccgttaactgatgtagttgtcgcagaaccatttgcatcgccggctcgctttgatagaccgcaactaaggagtgagattcatccggatcgcttaactgccatagatggcgcaactgacgacgcaaatggcctaacgccatatgttgggcgaacgctgctgcggtgttatccgcgaaatgctgtgcttcatccaccaccaaaaatggctgtccacctgcaagttgctcgacatggcgcgcaagaaaggcatgattcgtgaccacaattaccgctgcgtccgtggccgtttgcagacgtcgataaaaatccaacgtgtaaaacggattggtaaacggcgtaccgacatcgccggtgtgccgaatctgcaaaaacaacggcgcacgatatgtcgtcagatgcaattcgtccaaatcacctgtcgttgtctgagtcagccaaaccaacaatttcatttgcagtaactgggtttgccgtgtcggtgcttcctgatgcaggctggcagcaaatttatttagatccagataatgctgcgggcttttaacttccacacttggcaccgtgcgccctagcaagtcgttgagggccggaatggctttctgcatgagctgggtttgcaaaactaaagttggcgttgcaataaccagtttgtgctcgggggttgcagcgtaagcataaggtaagagatagcctaatgtcttccctaaccctgtcccggcttctacaaataacggttgctcaggttgatgtgtatgggcaaagatggcatccatcattttggcttgtgccttgcgaaaccgataacgcggttgcaacagatgctttttggctaagtcggttgccggataagcgcctgatagtgcaaaatcggtcgtcggtgtcacgggccgccgcagcaccaacgagccgacttgaacgtaggcttttttaagcggattcggcggtgtcgcaatcaggttgaggtaatcgccggtttcgcgaataaatccgccgcgatgctgaatgagtgcctgctgggtcggagttggcagttcctgaaatcgtttggttaattgtaatagcaatttgccggtgctgatcgcgtcactgtcggcttgatgtggattatcgtgttgaatggccagatacgcggttaaatcactcaggcgaaaactgctgatttccggcagtagaacctgcgccagttcaacggtatcaatagcctccaactgcaattttggcaagccgacccgttcaaattccgcattcaaaaatggataatcgaaattcacgttgtgcgcaacaaaaaccgtgtttgtcagcaagtcgtgtaaaaccggtgccacttcgtcaaaatacggtgctgcgactaaccgatcgggattaatccctgtcaaccgttgaatggtctgcggcaccgagcgatcaggattaaccatttgtgaaattgtttgaatgattttgccatggcgcaacaaggcgcatccgaactgaatcatccggtcgccatctttgacgctggtgccggttgtttccagatcgaccacagcaaacgtggtgtcagcattcataaattcttatccattcccgtctaaacatactgcgtctatcatactatttcccgatggggttcgccaccaaatcaacaatcgtaccggttcgcaacaaaaccagataacgatgattaaccggtttgggttgcagccgggtcaatgcctgtgcataaaggttcagctgaccgcgataacgcgcaactaatacttcaggattaggttcgtgatccgttttataatcaaaaagcgtcaccccttcagcatcactgacgaaaccgtcaataatcccgtgaatcaagacgtcttcgccgggatcatctttcaaaccttcgaataaacgatccgctggcaacaacatggaaaatggcacttcccgatgaacttgctgcggtttggcttgcaacaggcgacccaagtcagtcgcaaaaaagcgcactagtgcggataaatcaatgcgggcggctacttccttagggatagcgcccgtggttatcagatggcgccgtagttcatcaagacttgtatgcgtcaccggttgggtcaggtctaccagttgcaacaacaaatgggtagccgtgccgacagcagttgcactgacgccacctgatgattgggttagaaataccggtgcggctaaatctcccagcggcggttggggtcccaaaaaccgatcggcactcaccagttccatcgtatctgggtcatcaaaggcgcgtttaatttccgagacactttggaagcctgcagtggtggtagcggcctgaaatggatactgctgcttgaaccagctgtttaagtcgagtgacggcgcttcagccggagctgattttgtagcggtggccgccggtttgacttgcggattaacctcgatttcaatggcaaattcggttgaatcaccgatgagagcaggctttacggtagtttcggctaaacctttgacttggggatgacgaatcagtgccggaccgatccaatccaggtaattcgtcgccgcgctgcgaacttggggagccagtaccagttcttcgctttctgcttctttagcccatcttgccaccgttttgtcggcagatgtgagttgttgtccgctcatcgttgccccaacaacatatagccgttgctgtgctcgggttaaggcgacatacagcagccgcatttcttcagcaagcgtctgattttggcgggcggcttttgcggcctgatactgcggtaattcgtattcaacccgggtttccggatccacccatttaacgccgatgccatttttggtcaaaatggccgcgccgcgttgatcacgtcgattaaaatgtttattggtttgcatgacaaaaacgaccgggaattcgaggcccttacttttatgaatcgtcattaacctaaccgcgtcttgatccggatcgacttgggcaggtgtggcgagatcctgatcctgtttctgcatgagggtgatgaaatgaataaaggcaaacaggcccttaaatccgcctgattcatacgtttgggcccggtcaatcaaggcttgcaaattggcctgacgttgactgccaccgggggttccaccgacataatcgagaaaaccggtttcttgataaatcgcccatagcaaggtcacaagatcattttcccgcgcaaggtcgcgaaaatgctttaattgctggaaaaattgtatgagtgttgcgtgcgtttgcttggctagcggcgtggatggtgtcgcagccaaaaaggcagtgaccgcatcatagtaaggaacctgtttggctgctaggcgaatgagcgctagttgatccgctgacagtccgacaattggcgaacgcaaaaccgcaactaatggaatatcctgcttggggttgtcaataatcttaagcaacgcaagcatgaccatcaattcagtggttttaaagaagttcttcgtatctgccacgaacagcggcacgccggctgcagcaaactgtgtctggatcagactgttttgcgtggtttggcgggttaacaaggtgatgtcacgataatggatccgacggtaagtttgattcgcccggtcccataacttcgcctccggatcctcaaccaaccgttgaatttcggcgatgaccatttgggtttgaccggtcgcgacatctaaaggctcatcatcgtctacactttcaggcaaatcaggtgcatcagtactctcgtcatcctcatctgaggtggccttgctgtataacagcattttgaccgccggatggcagtcgccgtaatccacggccccatacttcaaagcggcgcgatcatcgtagcttaagtcccctacctcgggatccatgatctggctgaaaatgagattggtgaatgccaatacgttcttggttgagcggaagttctctgccaaaataatccgttcgggagcggcaggatcactgggctgatcggcaaaagattggtatttatgaatgaagagttgcggatcggctaaccgaaagccatagatgctttgcttaacatcccctaccatgaagcggtcaccggggtcagttgtgctgacagctgctagtaatgcttcctgcagtggactgatatcctgatattcatcgaccatcacttcatcgaagctagcacgataattctcggcaatcggtgcaccggtttggggatcttgttgctgcagaatccgcaacgcgttgtgggcgatgtcgctataattctggacatgacgatctgctttttcagcagttaaggccgccaaaaactgtagcgctacttttgtcagcatttgcatcattggctgaaccgtctgcagcagatccttgatttgttcacctgtcagcgcaaattccggcgcgacttgtttttgccacgtggttttggccgcgtcacgtaattgtttagccgcttttttggttgctttatcattatcatcaagccctttcctggcgctcgaccatgtttcaaattgatgatcagccaaaacggcgcggaccgtgtcataagtcggggcggcattttccaataaatgttgcagtggcgccagatcagcttcgatttggcgctgccagatcgggttgggtaattgatcggccagtgctgctgcttgggtgagatctgtggtgatttgcagtaatttttgtttcatccgcggccagatctgggtgttgaaggtttgctcccatgcctcgggtgcatacggttcggctaattgacgcaaataggcttcaggatcggtcgtcgccgctgcttgacgcatcaattcaaacatcaagtcctgaaggccgctgtcatcacgatcaccgctaaaattagccgttaactgttcaaaagcggtggcatcgtcaccagcatagaattgctcgcgtaagtcattccagacgcgttcctgcaacatgtaacgttccgtttcatccgtgagtaaccgaaaaccgggatcaagatcgatgacgtaatagtaggtttggacaatttgcaggctaaaagcatccaaagtactgattttggccgcattcaccatcgcaatctgattggctaaatggcggcgatcttcggcattgagttcgtgccgtttttgcgtcagtgtctgttttaaagctgattgaattttggttcgcatttcggcggttgctgcgcgggtaaaagtgacgatcaacattctggtgatatcggcatgctgtttgaggatcttctgaataatccgttcaactaacaccgtcgttttgccgctaccggcagaagcagaaaccagcacatcatggccatgatgatcgatcgctgcctgttgagacgaagtaaattttgtcatgattgcggtgtctccttttgagaatctggtgtctgcttagggtccgttgtgaggcgattgacgacatctttccgttttaatttaggaacatgatgataatgatcaaagccggttgccggatcaaaaagcatgatgctttggtaatcactgcggctgacgacttctgaggattgaccgtattggaaaggtgccaggtcaatattgccggagagaatttgagtggcagcgtcgatgatcagtgcttgattgtgtgccaagtaagcgcgtaaatcatcgggcgttaaaatattcgactggctacggttgaagctgccatcctttttaaaccctaacggagcaacttcgctggcgccgccactttcgggtgaaatcgtgcgatcgaccgcggagagttcgtcaccatgattggcaaccagaaaacccagatatttgaatttcttgagccgctcaatcaccggttccaatgttggcgtgtatggaagcgttggatcctgaagatggaaatacagtgcgccggccggtacaaacggcgggtcgataggaacgtttgtcatggcttcaatgtacgtcagcatttgcaaggcaatcccgtaataggcatcactgtcattaaaccgatgctgggtactcttatagtcaacaatgataaagcggcgcgcattcggttcacgataaacatctaagcgatcgattttgccgcgaacgttaacgcggccaccatgcggcaacggccaggataaccccggcaagcctttggtgtccccgattcgtccaaattgcaattcggtgcgtatcggacgaaacccactgcgttgttgttgctggcgcatgttgaccagtacttggatcagtagccggcttaaacgtctggtcagatagagcatgcgatgcgtgctgccgagaatttcgtagcccggctggctggcaatgtcttcgacaagtggcggaatggcggcagcgatgacggctgggtcaacgtctgccagtgccacatgttcttcgcgtagttgggtcaaatagcgatccagcaccgcatgaaacagactgccggtgtcggctggtgaaagttcgaattccgggcgcggttgcaggagcaagccgtacttgagaaaatattcaaagtggttcagatagtaagtttcaagccgggaaaccgacacattcatgtcccgcccgtaaagttggatagctaaatccggatcaagttgccccgggtcattctgataagtgagactcccagcgaggcgtcgggataacgttgctaaatcggtttgtttcaacgccgccaaaacgctttgccacgcttgacccaatggcagcttttgttgttgggcatcaccagcagcgcgcacaaagtcactcaacattgcccgcggactgcctaaaacggtttcgactggcgttgtcagcgaaaccggcgcccaggcggttggcgttaggtgcagtgcatttcccatttgctgaaaataaggtgaggcctgattttcgctgttttcctgggcgttttgaaccggatagcttaacgtcaattcgtctgacgctgccatgaagcccaggtagttgataaatggatcgcctaaagtcgttgccggtccctgttcaggcaagaagcgatcatccggcaattgagcagccaacaattggcgctcctcactgttcaacacgccatcatcagtgggaacatccggcatggccgtattggttgcaccaatgacgaatacatgttttgccttcgctagccgcaccaatccggtttcagaaataacaaccgcgtcaagggtcgccgggatctgggtgtacgtggcactggcaaatcccgcggccagcaattcgtgaaactgctcccggtcaaatttggcactgcccaagatcgtgacatagttgtccaataacgcggtaaaagtggtccacgcctgttcatgggcgcggctgcgagtcagatcaccggcgtcactggcagtttgtcgccaagcgcgcagttgatcaacaacgccatttgcgtccaaccaacgatacaggtcacctgcagcctccgcccctgtttttgcggtctgccactgttttagcaacgttgggacggtttgggcgatcaacgttttaatcgcattgatctgcgcggttttagcagcttccggatccatctgcgggtcatcggcgtcaggattacgctgaaaatagcgccatgcagctggttgcgtccagcgctgcttcccggcaatgcccgtccgcactaggtggttatccgttgtgtccactgcatcccgaaattcggccagtgacatcccttccggcaacaatagctccgtgtgcagcagacgcatgacatcttgatactgataatcgtgtttttgaatcgcaaacagactttccatcaagacaactagcggatggtccttcatcggccgttgcaaatcggtaaactgcgggatcgaaaattcggcaaaaatcgccggaatcacggttgcataaggctccaatcgtcgtgctaaaatcaggaaatcacgatagcgcgcaccatgccgaactgcgcgataaatgtgctgagccacatggcgcagttcctgatacggatcggtcgcgatggccagatgaatttgctcagcggtttcagaagtcggagctgttgatggttgcaagtcagtattggcctcccaccaatttgcaacttgttgcatgccgcgactgatttgacgcggtgccgcaaattgatccgggcgaatcggaacatgcagcgttttcgctttttgataaagccgttggtaaagtcgaccggcgggcaaaaataagttcggagcaactggcggattaagcggatatggcttattcagcactaacccgagcgttacctcggcggccgtttcgagcatggtttcgactaacgcagactcagaagcagaaaatacgttaaaatcattgagatagataaacgtatggcttaggtcctgcgtgcgcatggcttgctgcaagccactcagtaaacttgcggtcgtggcataagggccaatttctgcttcatattggtcaagaatgatccccagatcgcgcaacttcgcgcgatgccgatcaccgggagctaaagccgataccgtatgcatcagatcttcggcagtgatacggccgatcatcaattcgcttaattgatcggcaagttgcgtcacgaaaccggtatgttgcgcttcaccggcataaatggtcaagtcgtcttgccgatcagccagaattttggccaccaacatggtattgcttgcctgatcaagccgtggttgttgataaagtggcgtgtttttcaaataaaaccaggccagacgcgaaaatgacagtacctgcacccgactctgagcgtacgcatccgcctcaccctgttgcaattggcgcaagcgtttgagaagatcgatttctgcttcgaatttaatatggttcggcactaaaaagaaaatctgattttgcggatcagcagcgagttgttcctggatcatggctgccatggtttgagcatgatcccttgttgcgtcacctaaaataaactgcagccccatgctgtgcctcctcaagtttcaatcaatggtgatgatgacttatgctttagtctagcataactaagtagtgtccgatcggcgtttgcgctatcataagtaaagaatattaacgaggtgtttatatggaaatcgggacgggtaaaagttacgcaaaaattattcttattggggagcacgcggtcgtttatggggaacccgctattgcgcttccggtcaaaagcatcggcttgtcagcgcgggtggcaccgttgcctgatggtcggcaagaggtgacgtcggctttttttaccggtgatttgaatgctggtcagctgaccaactttgccggcattgccatgctgattcgccggttgcttgtgttcttcgatgccagtaagcaaggttttcacctcaccattactagtgccttgccatctgagcgaggaatgggatcatcagctgcaactgcggtggcggtcgtgcgggccttttacgatgcgtttcagacgccgttaacgcgcacggcgttgttgaactgggccgatatttccgaaaaagcgctacatggcaatcccagcggcttagatgcagcaacggctagtgccgaaaagccgcagtggtttgttcggggcaaatcattgcggtcaatcatgatgccgcggaatggtgttttgctcattgctgataccggcattgcgggtcaaaccaaagtcgcggttgatcttgtcgcgcaaaagcttaaacaggcgcctaaagtttatcgaccgcttattacggacatcggcaccgcggttcgccaggcagcattagctttggcgcaggatgatatcatcacgttagggcaactattgaatcgcgatcagtcagatctggcggcacttggtgtcagcagtccggagctggatcgattgattaatgtcgccatcgatcatggcgcatatggggctaaattaaccggctccggcatgggcggctgtatgattgcccttgctgctgaagaccaggcgccgacgattattcaggcgcttaaagcagctaatgcggtcaaagtctgggaatatcactttgaaacgaaatgaggcacctatgacaacttacgcacgtgcgcatacgaatattgcgctcattaaatactggggtaaagctgacaagaagcttatgttgccggcaacgagcagcatttccctgacgctgaacgatttttatacagatacagcggtgacgtttgattcaacactttcagaagatcagtttgtcctcaatgatcaaccacaatcgccagtcgctgtcagccggtttttggatcacgtccggaagttagccaatattaaaacccgcgcccgggtgagctcgttgaaccacgtaccgactgctgccggtttggccagttctgcctcggcatttgcggcactggcactggccgccagtcgtgccgctgggttaaatttatccccgatcgacttatcgcgcttggcccggcgtggatccggctcggcaacccgatcgatttttggcggcgccgtcatctggcatcgcggttttgacgatgcctcttcatttgccgaacccttggcgattcagccgaccttgccgttacgcatgttggttgtcactgtttcggatcagaaaaaagcggtcagttcccgcaccggcatggctaataccgctgcaaccagcccttattaccaggcctgggtggaggctaacgaaactttgataagtcccatgatcacggcgttggctgaagacgattttgccacgatcggcgcgctcaccgaattgtccagtatgcgtatgcacgctgcgatcatggctgaagagccgccatttacctattttctgccagaaaccttacgcgcctggcaattggtgcaggaacagcgccgactcggtattccggcctttgtcaccatggatgcgggacctaatgtcaaaattctcacaacggcaccctatgtggatgtgctcatgaccgcattgcgtctggctttcggtgatcgcatcctcagcactaaaattggcccagacgctcaagtgattacaaaggagcagtttgatgacacagagtcagcaatcacatcgcaaggatgagcacgtcttcttggcggaaaaatatttcaaggccgatgctaatgccgggtttgatcaaatccggctgcttcatcgtgcgcttccggaaacggccttagctgatgttgatctgacgcccccgttaccttttggttggcgctggccgatttatattaacgcgatgactggcggttcgccacaaaccggtaaattgaatgcccaactcggtcaattagccaatgcgctggatgttgcgattgccagtggatcgcagtccgtcgccttgcatgatcccgagttgagttcaacgttcacgaccttacggcagcacaatcctgatggctttattttcgctaacatcggtgccggtcatgatgtacacgaagccaagaaggcagtggccatgttgcacgcgaatgcgctggaggtgcatttgaatgcggcgcaggaagttgttatgcctgaaggtgatcgcgactttttatggcaggacaacattcaagcgattgcagcgggagtctccgttccggtggtggcaaaagaagtcggtaacgggttcattcgtgaagacttgcagactttgcaacagttgggtatccgctatgtcgacttaggcggtcgcggcggcaccaatttcgccgttattgaaaatgcgcgccggccgcagcaggactttgcgtatatgcgggactggggtcagacgacagctgaatcgctacttgaggcccgtggcttgccgctgacgattctggcgaccggtggtgttcgttcgccgctagacgtggtcaaagcgcagcggttaggtgcccacgcggtcgggattagcggacttgtgcttcatcatttgatccaaaccggctataccgcaacgctcgcttattttcaggagttcctacaccagatccggcaactctatgcattgcttggcgtcacaaactggcaagctttgcaaattgctcccgcccttctcggcaccgagctggagcattatcgccgtgctcgcaatttgccggcgatttgaccgttaacagcagtaggaccgacaaaaaagatgatctaagagtcaaaagtcgcactcttggatcatcttttttaataccctttaatggctaaacgcgcagcccttttggataaaagtttttgatggtgccattgaccaatttgccgatcgcaaacggtttgtgttcaaacgtgagtaacacaaatcgcttaccagtggcgattgtcggtaaggtttcaccatggcgatagcgggcataaccatcctgatcgacctcgatgacggtctgaaacgtatttggcgataacgcggtcgccaaactatggctgggttcgaaacgttttttgcgaaaactgccaagttccaaacctgcccgcaccactttcacccggtcaaacggcagcatggttgctggcagcaatgacaagaaatcaccgtgacgatagaattgcccggttaacggctgatttaaactggtcgcaaaaaagtcgcggacctcatccattgccggcttagccaaaggtttgaccgaagccgctgcaggagtgtgcaccgttttttcgccagctaggcgtaatttagccacaaaatgaccttcaccgcgcagccgatgcgggaacaagcgtaccgctttggctaactcttggttgccatcggcccattccggtcgcccggcttccattcctggataggttttgatgggctcaagcgtcatgtcatagtttgtcaataaccatgcgatgatttgctcatcttcttccgggctgaaggtacatgtcgaataaatcaactcgccgctgggttgcagcattttaacggccgcttgcagaatctgcttctgtctggcagcgcattcggccggataatcgcgatgccaatattgaaccgcgtccggatctttgcgaaacatcccttcacccgaacatggtgcatcaaccaaaatccggtcaaacgtttgcggccaggccttcgccagcgtatcaggatcattattggtcaccagaatgttttggctgccccagcgctcgagattgcctgatagcaccttggagcgggccgggttgatctcattgctgacaagcaggccggtatcgcccagataactggccagttgcgtcgacttaccgccgggagcagcgcaaagatcaagaacccgttcacctgcttgtggcgcagcgaccgtgcccacaaactgagcgctgggttcctggctgtaaaccagaccggcaacgtgatcaatgtcattgccggcaattttgccataatatccccaaggactccaaggaacaggatcatccgttgcttcatccagcggccagggtttaacaggatcgcgccggaagccactcaccggtgctgcatcaaagctggccaaaaaagccgccgcatctgcgcctaataaacgagtatatttttctttaaaagcttcaggtagttgcacttgttcgatcctttctgcgaattaagtaacgcaggaaaataatagtggcgatcgttaaaataaccagaaaactccagatattggtccgggtggtgaagtagaaccaccaattggcaaacaagccgccgagaaacagactgatgcccacatgactggcacaactggacaaaacaccgcgtaagtatctggcgcgcatgttgatctccaaaccggatgtttgtaacggcccgatcaatgtgaccatcaataaacttaagattcctgctcccattagcagtaacacacagaataaagcagtttgcccataagcgcgccaccagctagccgcatcgctgtcgctaaaatgaacgcgatggacacgacttgcccgtaaaattgtcttcagtgccttactatgctgattggcgccatcaacataaattttaacgtgcttcaaggtcagaccttcattcgccatactcggcgaggcattcaggaaaactgccttgttaaggggactacccttgcgcgttccaactgtccccatgaccggaatgtactggccgttaacactcagataacgttgattattactgccggtataaagcttatctgctaaatcatggccgaccaccgccacgggcagacttgaggcaaaatcccccgttgaaaaccattgcccggtttccaccggaagactcgcgaccgacccgcgctgatacacgtaaaccagctgtttcgtcacaaactgtacctggtaaccggaaaaatcggttttctcaagctcagccaccgccttcgtcacacttcgcgaactgctcgtgacatattcctgcgccatttcagacatcccaagatgatccagctggctggcatattcattttgatcatgctgcgaccaaatcaacccagccaaaatcgccaagccgatccatagaaaatcaatcaaaaataattttttcacgagatcctcctgtgaagtgagctgagcgtgagccggcgcgcttaggggtcggagtgtaagcggccttggtcgcgatggcccgggcttaggccattgcgaccaaggtccttacacgtagacccctgcgccggcgaacgcgttatggcgccagaaaaccctcttttcaactaacaatgcactgtcagaaacagtccctaatccaccatccagcatcactgcaaccgatacacccgctcatgaatcgcatcgaaatggcccaaagcccgattcaacgcaaacaaacggcggtcaggcacctgctgagcttcctgccaaaatagccggctgttggtggccccttggcgctcaccgatcacaaacaattgcttatcgggaaacgaccgcgccatgatatgtaaaaagcgcacatcgttcggatccttatccgggctccacgccatgaccaccgcatcaacctgatcggcatataagaacaaggaagcattagcggtggcggttttaactgggactaagggttgctggccggtcacgttttctttgacccaagtgtgcgcgtccgttgtaatcgtggtatccccttgcgcccgcaacccggcgctaacgtaaccgttaccggctgcgacttccaaataccgctgggaaccatataaacggtgccagacgttaaagaagtcggcgtggacaaatgaccacatcccataatgaaacgcaatgtaacgccgaaaattatgcaacaaatgatccagttgttgcaactctgccaatcgagcgtcaggcaaagctaaagcatgttcgatttgcggcgtcgtcaatcctaaccaaggcaaggcacgttgcggcaagcgatgattcgctactgccgtttgccacgcatccattgccgtcatttgttgtttaagtggcaaaatgggcgtgtacttgcgcgctaactcatttaaccgggtccaataagtcatgtcaacctcgatatttaacgaatgctagtgaaaaagaaacttgcagcaaaacactcaaaagccgccataaacggcggcttttacggttaattttgacaaccaacctgttaatggatacccagtgccattttggcatagcgactgagccgttccgggccccatgccgggtaccaaaccagatggatttcgacactctcgatcccatcaatcgcagtcaaggcccgcttaatatcggcatccagcatatccgtcaatgggcaacccatcgtggtcagcgtcatttcaacggtacacttgccatcttcatccagatcaaccccgtaaatgagcccaagattaatcaaatcgattcccaattcaggatcgatcactgtctcaagcgcatcaagaatctgttgcttcattttatcaaaatatgcctgatcctgggtggtggcttcgtcatgatctgccatcagcggtcccttctttccaaaaaattgcagaaccttacgccttatcggccgctaaaacacccgcaacggcgtaatgttcttttgccatttcgtttaacacaatgtgcacatgttcagctggggcgccggtatctttaacaattgcggcagtgacatctttgacaagtgccttcaattgctccggtgagcggccttcgattaaatcaatatggactaatggcatagcatttcgctccttcaatcatcattggtgaaagttaatttgtttcattttagcatgcaaagccgttttgcgcacgttttcgcgaagcctagtatgggtcaagattctctaggcgttagtttagtgtcttgcccaacctagtgattgaacgctgatttttttgattatctgacggtgactacataaacgtaaacggatccgtggataacttggacggaatagctttgacgtcccaaccttctaccgctgcccattcattgatcaaggcggctactttgcctttcatgatggcttcgatgtgatggcctgggtcgatgacgggcaaatccgctgccaacatgtcatggccggtgtgatagtacacatcaccggtaatgaaaacatccgcgccggcttccttggcatcgttgaacgcgtcgccgccatcaccgccaagaatggcaacccgctgaacctggcgatccaagtcgcgcgcgatcacccggagtcccttaacgttgtaagcagctttgacctgttcaacgaaggtttcgagccggactggttccggtaaaaggccgatccgccccatattggcgccttcaccttcgttaataaacggcacgacctggcttaaaccgagtgcttcggccagccagtcattcatgccttcctgaacccgatccaaattcgtgtgggcgctataaaccagcaaatcgtccttcagaatctgcgcatacatggcgttttgcggcactcgcaggtcgaggttgtgaactggccgaaacatggccggatggtgggaaaaaatcatgtcagcatgaaccgcttcggcttcttcaaccacttccggacgaacatccagggtcaccaaaaccgttttaactgttcgttccggattgcctaattgcagcccgctaggatcccgttcccaggaaaggcttaaaggtgcataatcttcgaatcgattgataatctgcttaccgcttgtcatgtgcgtttaactcctccttaatgagtgccaggatatgctcctgttcgcgaatcttagccagtggtaccattcgtgcgtctgccaacccctcaagaacggcttcggtcttttcagcctcccgatgcatctttttcataaacaccggatttttctggcggcgcaaaatggggccgaagcgcagatctgcttctgaatacggaacatctggtttggttttaccagctgccataatctcgtaaatatgaccttcatcttcgacaatctgttcgctgataataccgtatccatgcttgtctagccagagacggatatcatattggtgacgattcggcgccagtaccaatgtttcggtgccgtccatgcgcgtactgcctgcgtcgagaatattggtaattaattgcccgcccatgccagcaatgacaatggtcgagatggcatcaaccggcttgataccggctaagccgtctgcctggcgcacgtcgatttgctcggttaaccccgcggcagccacgttttgtttggcgattgccaccggaccggcgccgatgtcgctggcaacggcgaattgaatgatgccgcgctgcacaagctcaattggtaaaaaagcatgatcggtaccaatatccgcaacccgttcgccgggttcgataaacgtactgatcgtttgcaggcgctttgataaatgtatatgatccattaactttacgatcccctcatctaattaacagttttcattataacaaactgatgcgaagatgctggtattcggtctaaaatcaattggtttgaacgcaaaaagccgctatctctcaaccgagagacggcggctttgtagacttgctttaattattcaagaaaatctttaagttgcttggaacgacttggatggcgtagtttccgcagcgcctttgcttcaatttgccgaatccgttcgcgggtcacaccgaagactttgccgacttcttccagtgtccgagtacgaccatcgtcaagaccgaagcgcaaccgcaaaacattttcttcgcggtcagttaaggtatcgagaacactttccagctgttccttgagaagttcataggaagcgtggtcttccggactggtggcgtcctgatcttcaatgaaatcacctagatgagaatcgtcctcttcaccaattggggtttcaagggataccggttcttgggcgattttaagaatttcgcggaccttttcagttggcatatccatttcggcaccgatttcttcaggtgttggttcacgaccaaggtcctgaagcagttgccgctgaatccggatcaacttgttaatggtttcaaccatatgcacgggaatccgaatggtgcgggcttggtcggcaatggcacgggtgatggcctgacgaatccaccaggtcgcgtacgtggagaacttgaagcctttgcggtaatcaaacttctcgaccgccttcatcaggcccatgttaccttcctgaatcagatccaggaattgcatgccccggccgacgtaccgcttggcaattgaaacaaccaaccgtaaattggcttcagccaggcgctgtttggcttcctgatcgccttgttcaatcttcagcgccagcgcgacttcttcgtccgccgtcagtaaggaaacacgaccgatttccttcaggtacatccgcacagggtcattgatcttaacccctgaaggtgcagacatgtcactcatttccttcttggaaaccttcttttgcttcttcaggctgatggttgccggctcgccgttttcatcgacgatcgcaatgccgttgtcttcgattttctgcatcaaatcatcaatcgcattgctcttaagctcgaatggcttgatcaatttagcggtcaggtcatcttcggtaatctgctttttcttcttgtaatctttgatcacagccttgacagcactatcatatgccttcgtggttgtgtgggtcttgctagcggtagtcttcttggccgtagttttcttggttgcggtctttttggccgtcgccttcacatcggttgctgtcttcttggcagatgcagccgttgtcttctttgtggtcttgcttacttcagttgctgtttttttctcagccattaaagttcctcccctagccttgttgttgcttcaaaagtttcatgagattcacatattgcaccgttaactcgccttgtttctgcttgtctcccaaacgttgcgcttcaacaatcgcctgtttgattgcctgcagccgggtcaccgtcgaggcagacgtgatcgtctgaattaactcgtcaatggttgcctcggtggcttcaggcaatgactgcatcgcaacatccgtcgccacgccgctgagttcgggatcaactcgatccagaaatcccgccaaatcaccgtctggctgttcatgcaaaaagttcagccatccggtaaaaagtgtctggaaataatcggttggaaatacgaatgcggcatttttcaaccgctgcatcaccaaatcatcatgccacacataatataataactgccgttgcgccgccgtgtaccgatcaagcgggcgcgccggttggtccgtgacagcgggacgcgcaacgggtggttgtgactgctgcggttggggcaaactttgattcaacgccgcgatcggcacatcggtcgtttcggctagctgtttaacgtaaactgctcgggcaaccggatcgctgatcttaccaatgattttcaatgcggcattcaagtaagtcagtttagcctgatcgttatgcatatcaacgccgcgggctaagaattgtaacataaaagctgttggtgtcaaaaccgacttgacttgcgcctgaaaagcttcagcaccgcgggctcgaatatattcatcagggtccatcccatctggcaaaactaccacatcggtttgcagcctaggatgatcggctaacatcgtcactgcacgctcaatggctctttggccgggttcatcaccatcgtaacaaacagtcaaccgtttgctcaaatggctgatgatgtcgacttgctcggtcgtcaggctagtacccattgacgcaatgccgtttttaacgccagcctgataagcagcgatgacatccatgtagccttcaaaaagaatcggtcccccgtcgcgcccaatttcggcttttgcgcgatgcaggttaaacaggacatcacgtttgttaaacaacttcgtctccgggctattcagatacttggcctgcgacttatcattttgcaggatccgcccggaaaaaccgaccaccttaccattgccgtctgtcaacggaaacatgacacggtcgttaaagcggtcaaacagtttgcctgcctgatcttcgacaaataaaccacttgcacgttgatcctgataatcgattttacggttattcaggaaagccaccaatagattgcgttcttccggcgcgtagcccagctggaattcttcaatcgtttcatcggttaacccgcgcttatgcaaatatgccagtgctgcttcacctttttcggtgttgaccagaatgtggtgaaataaatcggccgtatcttgcaggatgtgttgctgcttggcaatttccggatcaaccggtgcggcgtgaccgatttgcacattaagcgggataccggcgaaatcagccactttcttaacggcttcgggaaacgtgacattatcgtagtccatcacgaacttaaaaacattgccaccccgcccacatgaaaagcaatggaaaatctgctttgactcattgacggaaaatgatggcgtatgctcttcatgaaaaggacagaggccaaaaaggttttggccggttttacgcaactggacaaattgtccgatatagtcagcaatgttaactgccttcaggacttgatcgacagtggcctctggaatcattccggcgatatcagctcactccctttccatgacaggcgcaacagcaatggcgctcccgcttgactgttgcacgacttgaaccgactgaaatagcggtaaaaagtcgcacttctcatgtgaaatgcgacttttcaatagtctatcggcataataatacaagatacagtatagcgcgttctcgtcaaaaaggcaaatctacttaacaatcacctggctaacatcaccgaattggcgaataagctgggcgagttgctgcaaggtagccaagcgattagcccgcaccgcggcatcgtcggccatcaccatcgtggcgtcaaaataagcgttaatcggatcaaccaaggcttttaatgcttggtaatcggcttcggtcggttcagcatcgaaggtcttagccgtcgtcgttactgcttcgtgcaactgaccttcagtttcattttcaaatttatcgggatcgaccggagtatcaacagttttgttaccggtaatccgcaaaacccgtcctagggcttccatgaccgctttaaagtcatcatccgctgcgtgagctgtcaacagcttggccgcatccaaaatgccagcaatgtcagcgtcgctgcgaaccgtgaccgcatccacgatatcgtggcgaatcttttcagcttgcagtagctgcttggcacggtcaatgatgaagtcattaagcgcttgttgatgggccgcaaagtcaagtccgtttgttttccctgcagcagctaatgcttgggcaatcgctggctgcagtttagcgagcgcaaatggccagtcgtgtgcggcgatcatgcgaacgatgccgtatgcttggcggcgcaaagcgtatggatcgttggagccgcttggaatcagatcaaccgcaaagaagctcatgagtgaatccaatttgtcagcaatggctaatacggtgccgaccagactttgtggcaacgccccatctgcggcaatcggttcgtaatgctcggcaatggcctgggcaacagccggtttttcgccagctagttgcgcataatgctcgcccatgatgccttgcaattcaggaaattccccgaccattgatgtgactagatcaaacttgtaaatcgatgccgcgcggtccagatcagccttgtctgtggcagtgaggccaaactggtcagcaagcaaatcggcaataacttttgtacgcgccattttgtcgtacatcgaactgattttatcgtggaagctgacggctttcaggcgctcaacatcctcggcgatgctgcgtttttgatcttctgcataaaagaaggcggcatcctcaaggcgggcagtcaacactttttcatttccggcaatcacgttggctaagtgatcacggttaccattgcggacgccgatgaaggcattgaccattttcccgttcgcatcgcgggcataaaagtaacgctgattgtccttcattgaggtgatcagaacagcttcaggaatggccagatatttcttgtcaaacgtgccggcaaaagcagttggccattcaaccaaattattgacttcttccaatagatcggcgtcaaggtcgatttgccactgatgatcggtggcaatttgtttgatttggtcgcggataagctgcttacgcgccgctggttccacaatcacaaactggtcttttaaagcagatacatacgcatcaggattcggcaaggaaacgggtttgccgaggaagcgatggccctgagtcacacgaccggcttcaacatccagcaacttcatcggcacaacttcaccatccagcaaactgactagccagtgaatcgggcgaatgtattcaaaatcatacgcgccccacttcattcgcgtcgggaaagtcagactcttaatgacatccagcatccctggcagaatctcggcggcactttttcccttgatcgctttatgcaggtaaacataatcgacccctttgacggttttaaagacaatgtcgtctggggtcatgccctgaccgcgcgaaaagccgatcgcagccttcgtccagttgccatctgcatcttgggcaatctttttagccgggcctttgacatcttcttcaatatccgcttgtttcgccgccagatcatgaacaagtaacgcgagccgccgcggggttgcgtaacggtcaatgcggccatgttcaagatgattggcttttaaaaaagcaactgttttatcatggaattgattcaaactcggcgtgacaacatgggcaggcatgtcttcaaggccaatttcgatcagatagtcatgcgtcatgttattgcacctccgttttgtgctgcagcaatgggaagcccagctttttccgttcagccacaaatgcccgggcaaccttgtgtgccatcttgcgaatccgactcatatacccggctcgttccgttacggaaacagccccgcgtgcgtctagcaggttaaaagtgtggctgcatttgagaatgtaatcgtaagcaggatgaaccaagccgagatccatcagccgccatgcttctttttcataagcatcgaaaaattccaataacattttctggtcgctgacttcaaaggcatatttgctgtgttcatattcaggttctttgaaaatgtccccatacaaaaccccgtcgccccattcaagatcaaagacactgttaacatcttgaatgtaagaagccagacgttcaacgccataggtaatttcactcgtcactggcgacacttcaagaccgccgaccacctggaaatacgtaaactggctgacttccatcccgtcaagccagacttcccagccaacaccggcgcaacccatggaaggattctcccagttatcttcaacaaagcggatatcgtgttccaaaggatcgatgccaagcgcagccagtgaatccagatagtaatcctggatgttttccggcgacggcttcatgaccacctgaaattggtgatgttggaacagccgattcgggttttcaccgtaacgaccatctgccgggcgccgcgatggttccacatacgcggcattccaaggctccggtccgattgcccgtaaaaaggtatacgggctcatggtgccggcacctttttctacatcataggcttgcatcaacatgcagcctttgtcaccccagaatttttgcagggtctggatcatcgtttggatgtccatttttgttgtcatgacaacctctttcccggtgaatcgaagcggatcctggctcaggcaactgttttttaaacgcgaaaacgtccctacgccaagatatggcgtagggacgcttctgcgcggttccaccctacttcagacagttacaaaacctgcctgcagcttcatcatttggttcgaaaacgccaatcatatcgaccgccaccaggcttacactatccctgactcgctgaagttcagtaccgatatgaccttttttctcatcaccgattcaattttcttaataagtatagcatcgcggtaggtgctgtcaagcaactttctgaaaacagagcgtgaactggcgcggttagaagtcggagtgtaagtggcctcaggtgtgatagcccgggcttggccattgcgcctgaggttcttacacgcagacttttgcgccagtaaacgcgtttcagaaaatggacatgtcaaccaaccacttcaataaaaactaattaatcccagataactgatcaatgcttgacttgctgttatgccaaagttcctcaggcgtataggtatctttttcaaaaagcgtcaccttgccatcggattcaatccgggcattggcaccgagccattcccaagtcggtgccacaaaaaagttaacccgtttgcccttacccttgcttggcgaccatgaggatacataattatcgataaaatgtgtccgcatgaaccgcctttgcccgttatcaaactcgatttgcagtatgtttgcgcccatccagactttgacagctctgggtaatgtttctgccatgcttgccactccttttaaaacacctgctgaaaattatcttcacccaaaaattatcaataacgaaaccgcttacttatattcaatctaccataaacacatggaaaagcaatgactattctcgatgctcgttgtccgactgggagtcgttgggttgatgcgcgtccggcaggcgatcctgccagtgattcatttggtcaataaaccgcttggctttgggggtcacgccgaccatatcggtataaatgacatccagaatgcgttttagctcagctttggtgtcaggctttacatcaatgcgtttaacctgatccagattcaatgtgctgaagcggcgcagataaaagatcgcgcgggcactggcatgaagccgatggggatctttatcccagtgacgctggcagagtaaaccgccgtagctttcagaaaaatcgagcggcaaatcagtacgaccgtcgatcacacaaccgcgccaattgggctccacgccgtacgctttaagcatctgaacttcgatcacattagcgataatttgcggatcaagaccggtatcaatcaaatgcaaggcttgcttgatctgattaaaccaaaacccgactggttgcccatccggataagccagatcgagcaacccaaagatgtacgatgcgtaagcgtttagcgtgatatcggttgaaatctgccggtattgcgtggcatttttaattgcggacaaatacgagagacccgactcacgaatctccccgatgtagtcggcatgcgtaaatggcaaaatgccagcagctaaagtaaaaccgggcttgcgtgcccggttcaacagaaacattttcttaccgaactgatcggttaaaattttaaccaacatgtcggattcgcgataattttggcgagacatcacgagtccctcaaaggtttgcgcttgcttgaccattaccgcagatcctttgtgttatagccgagggatttgaggtaagcgttattgtcgcgccagtttttctggacgcgaacccacagcttcaagttcaccttatcacccagtaaattctcaatgtcccggcgtgcccgaataccgatttgcttcagcatttgcccgccgcgaccgataatgatgcccttttgactgtcgcgttcgacaataatgtacgcctcaatctgcagcttgccgccttcgcgatctttcatgcgctcgacctggacagctgtggcgtgcggcacctcatcgcgggtaagttcgaggactttctcccgaatcaattcacccacgacgaaatattccggatggtcggtcagctgatcttccggataatattgcggcccaactggcaaagctgcggtcaacgaggtcaataagtcatcgacattgttacccatggttgcgctgatcgggaagacctgggcgaagtcataatcatgctgatagctttcgataagtggtaaaagatcgtccggtttaaccaaatcgattttattcagaattaaataaaccggcttcttcacctcggccagttgccgcataatataggcatcaccggcacctttttgctcatccgcagcgaccatgaacaaaatagcatcaacctgattcagggtcgacaatgccgctttatccatgtagtcatcaagttcatttttaggcttatgaatcccgggcgtgtcgacaaacacaatctgggcatctggcgtcgtatagatgccgttgattttatttcgcgttgtttgagccttaggtgacataatggcaatcttttcacccaaaatccgattcatgaaagttgatttgccgacatttggtcgaccgataatggccataaagccagaatgatgttcgctcacgggtttaagtctcctttcgaaaatgctcccggcagtaatgcttgcggcgttgtttgttgcgaatcgccgcgaacgttggccagcgtgatgaccgcatcggcaggaaagaactcgctgatgacttgccggcatgccccacaaggtgaaaccgggccttccgtgtcagcgatcaccagtaattcatccagtttggtatagccagcgctcacagccgcaaaaatcgcactccgctcggcgcaattacttaggccgtaactggcattttcgatgttggcgccagaaaaaatccggtcaccgacgcggacagccgcgccgaccgcaaaatgggaataaggaacatacgcattttcgcgtgctgctaaggcagcggtacgtaaaacagacaacattaccaactcctcaaaaggtctaacaacggtggcccaaaaacataaacgccggcgactacggcgattaaggataccagcaaaacggcgccagcactcatatccttaattttttttgcccgtaaatcatagtgttccccaataatgaaatccaccagattttcaacaatggtattcaataattcgcctaagaaaaccagcagaatggctaaaatcaggacgaaccaagaaaatggcggtacttttagccagataccggcaataatcaccaaagccgcgctggtaaattcgcgtttgaaattattttcgtcgacaaaaaagacgcgcagcccatcgagcgcgtggcgggcgctttggataaaatgcttatttttgccgatctgtttatcgggtaaggccataagctgccagaattttcttttgaagcggaatcatcacggcttcatcttccggcttaatgtgatcatagccgtttagatgtaagaagccgtgaaccaccgtgtaccccagctcgcgctcaaagctgtggccatattccttagcgtggcggcgaaccgtcagtggatcaataaacagatcgccaatgttctttgccatgcctggaagtagcggcagatcgtcttcgccatcttcaatcgcaaaactaatgacatctgttgcgcgatcggtgtcgcgatagtcacgattaatcttctgaatgtcatcatcaccgacaatcgtaatggacatttcggtatcagttggtaattttaactgttgtccgcaaaaagcaaccaatttctgaatcagatcatgatgttgtgcgtctaataaatgatcatcatcgtataactctaagtccatcgcttactcctttgtccgtttctgcagctgtaaatcgtgtttgccgtaagcttcgataatcttggcaacgaccggatgccgcacaacgtcttgtgatgaaaattgcgtaaaggcaatgtggctaatcccttttagcagttgttccgcctgtagcagaccgcttttggcattattcggcaaatcgatttgcgtgatgtcgccgttgacgatcatttttgagccaaaaccgagacgtgttagaaacattttcatttgtgcctgcgttgtattctgcgcttcatcgagaatggcaaaagcgttgtcgagtgtgcggccgcgcatataggctaacggcgcgatttcaatgactccgcggtccattaaccgatcagtgtgttcttttcccaaaacggcgtacaacgcatcataaaccgggcgcagataaggatcgaccttttctttgagatcgcccggaaggaagcccagactttcccctgcttcgacggccggccgcgtcaagataatccgttccacttgcccagccttcatcgccgcaacggccatgaccacagctaagaaagttttccctgtcccggcaggaccgatcccaaaagtaatatcgttatgcttgatcgcatcgacatattggcgttggccaaaatttttaactcgaatcggttggcctttagcgtcccgcagcaaggtttcgctatacatgtcggcaaaatactccaatgtcccgcgtttcgccatggcaaccgcactggcaatatcctgcggtgacaacttaatgccctgcgacaacaacttactcgttgcttccagcagctgcaaagtcaaactaaccgtctccggttcaccgctaatgcgtaattcgtccccaaaaggcgaaatacgcacgttcaagccttcttcaatcaacgtcaaattagcatcattaatgccgacaaggttaatcgccatgtcgggattgctaagtcggaaaattttctccgaggtttcctgtgccaaatattggccccctaacaaatattttaagcggtaaagatggtattagtttagcatattttaagagcgcgagcaggagcgcttagaaatcggagtgtaagtggcctcagacctaaatggctggtctttgccatttaggtctgaggtccttacacgtagatttctgcgactgtgagcgcgtttccgcgctagaaagccagaggctgggctttggccatttgtgcttgaggtccttatgcggagatttctgggcctgcgaacgcgtttctgcgccagaaagcgacagtcccttacacttcgcccatgtgcaacctaaatgccaacactcgataacgcgcgcaatcaccacaataaaaagccggtgctaacaccggctttgtcgttaactaagtttttcttttaccacgctgctgacgagaccgccatcagcttggcctttaaccttgggcatcagcgtcttcatcaccttgccaaagtcttgcttacctgttgctccgacctctttgattgttgcatcaacgatgtcggcaacttggtctttgcttaactgggctggcagaaaacgttccacaaccttgatttcagcttcagtttcctgtaccagatcatcacggccgccttttttgaattccgaaacgctttccttgcgctgctttaattcagtcgcaagaacgctcttttcttcatcctcggaaagctcatggccgactttgatcttttcattgaccaacgctgttttcaacatccggacgacgctcaacgttaccttgtccttggctaacatgctttgtttcatctgagcattaagctcatccattaaagccactattcaccaagtcctttattaatacttcttacgcttacgcgcagcttctgacttcagcttgcggcgtacgctaggcttctcgtagaattcacgcttgcggtattcagcgagtgtaccagacttggatacagtacgcttaaagcgccgaagagcgtcatcgagagattcgtttttcttaacaactgtcttagccatgtgatatccctccctccgacacttgtgtaaccactgacggatatcatagccaatagttcgtttattagtatacaaaactgacaaccacgcgtcaataagcgattccagatttttatataaacaaccgctgttattgacaaagatgttgtcttaactaaatcttaacgcctttaccggtcacaatcaaagatttgctagcgtctggtaacttgttcttcaacattcacgtgctcgtttgaattatgctatgatagcgttatctaagtagcgaggtggcattatgacccaagaattgaatttatatatcatgtcagattcggttggcgaaacgggactgcgacttgcgcaggcggttgccgcacagtttccggaatttgaagcgcattacgtacgatttccgtttattcatacaaaggaaaagatctacagttcacttgatgaagcaaagaaagaaaatgcgttggcgatcatgacgtttgttacggacggtttcgcccaactagcaacgcattatgccaaagaccaaggcgtcatcgcgatcgatgtcatgtcgccgatcatcagcggcatcaaatcaattacgcatgaagaacccaaccacgttccaggtgccgtgcatgatctcaatgaacgttattttgatcggatttcggcgatggaatttgcggtcttgtatgatgacggcaaagacccgaaaggctttttggaagcagatattgtgttgctcggcgtatcacggacaagcaaaacaccactgtccctttttctcgccaatcgcaatctcaaagtcgccaatttgcctttggtacccaatgcccatattcccgaagaaatctggcaggtcgatcctaaaaaaattgtcggcttgaccaccgatgcttccgttttaatggaatttcggcgtcagcgcatgattcaatatggcttgaatccggacactgcctattcggcgcgtgatcaagttaatcaagaattgaagtttgctgaagatctctacaaaaaaatcggctgcatggtgattaacaccgcacaccgatcgattgaagaaactgcaaccttgattttggagcacatgggcttagatgaatttgaaaataccgaaacccattaatccatcaaccggcgcaaagcttccggttgaaaatggccgcttttgagccacttgatttcctccccgtatggcgggacctgatgtttcttatctggcccgacatacggggtttcgagtatcttgggtaacttttccaatgcgggatgatgggcaattcgatttaaagcgtcaaacccgattgttccaaaaccgatgttggcatggcgatccttatggctgccccgtggattcttggaatcgttcacgtgaatgacactcagccgatccaaaccgatgacgtgatcaaattcatttaaaacaccgtcaaaatcatctttaacatcataaccggcgtcgttggtatggcaagtatcaaaagtcacgcgcaacttttcgttataagtcaccccatcaatgattgcggcaagttcctcaaatgaacggccgatttccgttcctttccctgccatggtttcaagcgcgatcgtgacgtgttgcttagggtcaataatgcgattcaagcctttcacaatttgcttgatggcggcttcaggaccggcgcccacatgcgcaccgggatgaaatggcatggcataagcgtgtaacgcgtccgcccgggcaacttcttcccgcatgaattgcaccgcaaattcaaagttctcgggtttcttcgtattgccaagattaacaatataaggtgcgtgaataacggtatgactgatgccgtctttggtcatcgccgccagcccttcaggaatgcgcatttcgctcgttggtttgcgccgcgtgttttgcggcgcacctgtataaaactgcagtgtattggcatcataactagccgcttcttcaactgcccctagcaacatttttgtgcctttcatactgacattggcaccgattaacatttaaaaagccccctatgtatgatcaaccagcaatcgtttcaattgagattgctggtgatcagaaaaaatttcatcaaaaaacccggctgttttccgggttcatgttagcgcggttaatccgtttttggctcgtaaaaatggccgaggattttgaccgagtccgtaattgacacaaacgcatacggatcgctgtgacgcatggcctgctctaggtcatacatttcggcccgggaaatgatcgtgaacagaatggttttttcttcgtgatggaaggccccttctgcatcgtgaacaatggtgatgccgcggcgtagcgaaccttgaatctcccgaacgacctgctttggccgggcagtcacaatcatgacctgcagccgttgctggcgcgtgtatagcgaatccatgacccggccattgatgaaaattgccaacgccgaatacaacgcatgcggccaatcgttgacaaaaccggcaagaaagataatcagcacgttgaacataatattgatcgtgccaaccgtccgtccggtccgtttacgcagaacgatcccgagaatatcgataccgccagtggaaatattattgcgcaaagcaaagccggtacccaagccattcacaaccgcgccaaagataccacaaacgatggggtctttagtcagcggtgttaataccccaagcaaccgaatcatgatcgtcgaaaagataaccgccaaaaaggtgaacaccgtaaagcggtggccgattgccttccatgccaaaataaaaagtggcacgttcaagaaaaatagcagcgtcccagttgaaaataaatccgttgtcgccagcgaaaagaatggcaatgcaatgtcaaagttgaaccattttcgcaccacggtcgccaaaagctgggccgcaccggtaatgccactggcaaaaaccccacccggttcccaaaacatattcaacgcaacggcgacacaaatactatagaaaaatgccgctgataatcgtgaccaattttgatgtcggcgaattagccgatcaatctcttccatatcaaaaaccgctccctgtcacccataatcatgtcgtgatcaagtataacaagggcggtctttgattgctaccaaatcaaaaaatcggtcggtttatttattttgacgggtgtcataacgcgttccctggcgcagaagtctgcgtgtaaggaccttggttgcaatggtcaaagcccgaccatcacgcccaaggccacttacactccgacttctaatcgcgccagctcacgctcacattaacgcgttccctggcgcaaaagtctgcgtataaggaccttaggcgcaatggcctaaacccgggccatcacgcctaaggccacttatactccgacttttaatcgcgccagctcacgctcacttgaatagttgtcgatattggccgtagccttctttctcgagatcggcaaccgggatgaaacgcagcgctgcggaattgatgcaatagcgcaagccgccttttgcaattggaccatcgttaaaaacgtggccaaggtgcgaatcagcctcgggactgcggacttcgacgcgttccatcccaaagctctgatcccggtgttcggcgagctttgtaatcggtttggtaaaagatggccagccacaaccggcatcatatttatcttgggaggaaaatagcggttcgccgctaacaacatctacatagatgccatcttgataaaaatcatcatactgaccggaaaacggccgttcagtcgcggctttttgcgtaaccgcataagcttcaggtgacagttgcttctttagatcggcttttgacggccgttttgctttatcgaacataaaaaacacctccgctacaatccattatagcggtaggcgtttcgattgtcagcaattaaattgcataacaactttaggcgaaagtgacgccccttattcggttaagttctcgtcgccttcatgctctttttccggatcgacatctggccgaacttcaatacctaaatccttaagctgtacgtccgcaactggtgaaggtgcactggtcatcggttcgctggctttgctgttcttcgggaaggcaatgacatcgcgaatgttggtgcggcctgtgagcagcatgacaaaccgatccaatccaatcgccaagccaccatgcggcgggaacccgtaatcaagcgctgtcagcaggaagccaaaactcttttgggcacgttccggagtgaagcccagcgctttgagcatcttttcttgaatcttccggttgtgaatacggatggagccgccgcctaattcatagccattcaacacaatatcgtaactttgggcgtgcgctgcatgcggatcggtatcaagcagatgaacgtcttcctcgtttggcatcgtgaatggatgatgcgccggaacccaacgttgaattccttcgtcatattcgaacagtggccagtcaaccacccagcagaagcggaactgcttgttgtcaatcaaaccaagatcatggccaaaatgggtgcgaagataacctaacgaatcagcaacgacttttgccttatctgctacaaataaaaccagatccccagcatgggcgccaaccgcttgtgtcagcgtcttgccgtcaccgaagaacttggcaattgggccgctaatgccgtcagctgtcactttcatccacgccagacccttggcaccaaagcgtttgatgtaatcctgttgggcatcgatcatttttcgtgaatatttatcggctccgccaggcaaaacgattgcccgcacttggccgccattttgcacagcacccgcaaaaactttgaaatcagaatctttgactaaatcggaaacatcctgaatctgcatgccaaagcgaagatccggcttatcagagccatatttatccattgcatcctgccaggtaatccgctcaaatggtaacttgacgtcaatgccttttacatcgtgcatcacctgagcaattaggccttcagtaatatcttgaatttcttctgccgttaagaaactggtttcaaggtcaatctgggtgaattccggttggcggtcgccgcgcaagtcttcatcgcggaagcaccgggcgatttggtagtaccgatcaaatccggcccccatcaacagctgcttaaataattgcggtgattgtggcaaagcatagaagctaccagggtaaacccgcgatggcaccagatagtcccgggctccttcaggcgtgctagcagttaacgtcggcgtttcgacatcaataaagccattgtcatctaagtaatggtgcacactgcgcatgatgtgagcgcgggtgaagatgttcttttgcatctcaggccggcgcaagtcaaggtagcgatactttaatttggtctcttctgttacggcgacattgtcttcaatataaaatggcggcgttttggccttgttcaaaatagtgatgtcatggacttcaacttcgacatcgccggttttcatttccgggttcaccgcttgcggcttgcgttgcttgaccaccccgtgcacttcgatcacatactcggagcgcaccgaattggccactgtcaacgcgtcttgatcaaattcctcagaaaaaacaagttgaacgatgccttcccggtcccgcaaatcaataaaaatcaaactgccgagactgcgacgtttctgcacccacccttttaaggttacttcctgatcaacataatcggtggtcacatcaccggcataacaggttcgtttactcatactactttgcctccgttacttgcgtataaattttaccaaaatctgccaacacatctgcttggggaaaagcttgttgctggccggttgccatatttttaatctggacggtgccggctgcgcgttcgctttcgcctattgtcaaaaccagcttcgcatgcgctttgttggctgctttaaactgaccctttgctttgcgacccatgtaatccatttcaccggtaaagccttgttgacgcaaggctgtcagcatttgcaaggcttcttggtcagcaccttggtcaatggtaacgatgaaggcatccggttgcgctgcttcttggtctgattgcatcaacagcatcaagcgctcaacgcccatagcaaaaccaattccgggagtctcgggaccgccgagttcttcaaccagcccgttataacgaccgcctgccaagatcgtcgtgtagccgccaccaaagactttatcatcggacatgacttcaaaaatcgtgtggttgtaataatcaagtccgcggaccatggtcgcatccacatcaaaatcaatccccagccctgtcagcaatgtcttcacgcgatcaaaatgctgttgggcttccggcgtcagataatccagaattgaaggcgcattggcaacgatttcctggtcatgacggtctttactatcgagaatgcgcaacggatttttttctaagcgaactttagaatcttcagaaagctcatctttgaacggcgtcaggtaatcaacgagcgccgcatgaaatgctttacgcgtcgctgggtcgcccaacgaattgatgacaaacttaagatgtttggcacctaaagcttcgagtaactgcttggccaaggcgagcgtttcggcatcgagcaccggagaatcactgccaaaagcttcgaccccaatttgatggaactgccgctggcggccactttgcgggcgttcataccggaacatcggtcccatataataaaccttgtaaggctttgcatattcaggaccgtataatttgttttcgacataggctcgcacgacaccggcagtgccttcaggacgcaaggccatcattcgatcgcctttatctttaaaggtatacatttctttggtcacgatgtcgctcgtgtcgccagcactgcgcgaaaatacgtcgacattttcaaaaatcggcgtgcggatttcacggtattggtattgggcaaaaattttacgggcaacagcttctacctgctgccaacgttcactttggccaggtaaaatatcggctgtgccttttggacgttgataattcatgagggacctcctgtagtctgagagatgtgatggggttgggtgatcgggtgggttttagtggttggcttcgtgaggatggtttggttgagggtgttcgcaggagcctgcgtgtaaggagctcaagccctaaatggtcaaaccacacgactatgggattgaaactatagacattggggggcaatccggttccgaaacgcgctcgcagtcgcagaaatctacgtgtaaggacctcaagcctaaatggccaaagcccagccatttaggcttgaggccacttacactccgatttctaaacgctcctgctcgcgctctaaaaaaatgcacccctcgattgctcgaagggtgcggacacggtaccaccttgtgttttactttgccataacggtggcgttccggaatttgatcacctcgggagtgtcttttcgatcggtcccggctttcaccatctccgggtcgcttaaagttgatctatcctactccgtcacaggtcttagttattgtttaaagcatacggtttgcagaaagctttgtcaacggcgtttctattcttttcttatcgctgacttttcactttagcgtacggcttacagacagttaaaccgtctttaccgcctttttaccagccgatttgctataatgaacttaacgatttttagagaatggtgaggctgggtcatgaaacctatcggacaattgaaaaaatggccattgatcattttgctggcggtgttgtttggcgttggtgccgcgacgaccagtgtcatggccaatacgcaatatatgacggtcaaggccgacacagttaacgtgaggctggggcctgggcttgcttatggcattatgggtcaggttaagtcgggcaatcagctgacgattatcggtgccaagaattcctggtaccaagtgcggcttgccgggaatcgaattggttgggtggcatcatggctggtcgatcaaagcgaagctgccacgaccagggcaaaagttgccaccgtcaatcaaccggtcaatgtgcgcgaatatgcgagccaggatgccaaacaattaggctcccttaatgccggcgtgagtgttaaggtcgtctatcaggaaggcaactggacgcaaatcgcatataacaatactgcagcgtggattaccagcagcagcgtccagctgaccggccagacaacgaacctcgcgcaacctgcccaagcaaatctgacgcagacccaaagcaatccctcgctaaaagtcacgaccaacacaacgactaatttacgaaatgcagcaggtatcaatgcgccggttgtcgaaaaactggacaagggcacggaactgaccgttatcaagcaacaggatgattggtatcaagttaccgcgcctgatggcaaaaccggttttgtggctagttggacagtcagcgcacctaatgacggtcagacgcaaaaagccgcaaccaagctttccgaagcgacaattgttcttgatccgggtcacggcggtaccgataccggcgccattgccaatgatggctctgattatgaaaagacctacaccctgaaaacggcagaccttgtcgccaatgctttgcgcgcagccggagcaaacgtcatcatgacacgcaccacagatacgtttgttgatcttgcgccgcggccaaccaccgccaacaacgcacatgcagatgcgttcatctcattccactttgactctagcccatctaaaaactctgcatcaggcttcaccacctactactacagcagtaaaaaggatctcgcgctggccaagtcgattaatggcgcgctgactggcttgccgctggagaatcgcggcgtagcttttggtaattatgaagttttgcgtgataacaagcagccggccattttgaacgaaatgggctacatcaacaatgataaagacttcaaacacatcaaggatccgacgtatcagtccaaaatagcgacggatatcgtcaatggattgaacgcctacttcaaggctggcaatcaccaataacgtttcatttgttttcgaccaaccaaaatacccgctaaggcagctgcggttgccttagcgggtattttggttgcaactatttacttacggaacaaaggcggaatttcttccaaagtattcaccttaaagtccgcttgcggtgcggcatttaacccatcgacattgaagtaaatggttttgactcctgcgttgacgccagcatcaatgtccagagaacggtcaccgatcatggcggtaactgccgggttcagctgaaaccggtcaagcagatactgaatcgcatccggtgccggtttgcgcggtaagttcagatcggaatccacaccaccgagaaacaaggtatccgcatgatcattcgctaagatttgccatgcgctgtgatcgcgatgcgttaacaacagattgttcccaccttggtccttgattgcctgcaacactggcagcgccgccgggtaaggatgaatgtcatgaaggtaagcacgagcacggtgatggtagtcagcctctaattcatccactgagcgccctactttgccaccgaaatcggttagaaactttttgatcgaagtctttttgactaggcggtacaaagcatccggttcaatttgtccgccattatccaatacgaggcttctgagggctttcatcatgccgggataggaatcatacagcgtgccgtcaaaatcccaaatagcattaaccagcattacttcgcctccgtatcaaacagaatggtgactggaccgtcgttagtgagactcacctgcatattgccaccgaactcaccggtcgccaccgtgacccccagttgccgtagtttggcattgaaggcttggtacagttgctcacctaaagccggatcagccgcattggtaaaactcggccgattgccacggcgggtatcggcatataacgtgaattgggaaatcgacaaaatctgaccaccgacatctgctaaggccaagttcattttgccggcaccatcactaaataccctcaatttactgattttttccgccagatagtcactatcggcttgggtatcgttcggaccgacacctaataacacgacaaaaccgtggtcgatggctccgactgtcttcccctcaatggtcacttgggcggcaagactgcgttgtacaactgcgcgcataaatgtctctccttttctcgttcactttcatttgaaacctgagctgtctcgctgtggccgaaaaagcagcaggaacaaacatctcagtctaagctggtgatgttgctcgactgctgccttcgatcaaccattggcccgtttaacttcataaatatccgggacatttttaactgcgtccatcaacttgtccaagtgagcaaggttacggaccccgaccgtaacatgaatgtcagccattttgtcatggtcgactcggccattgatattattcaaggctttggtttgggcgttgagaacctgcagaacatcactcagcaatccgctgcgattgtatccgtaaatttcgagatctgtgttgaagagctgcttttgatcctcttcattctcccagcgaacctcaatcagccggccggacatttctttggaattttgaacgttggggcaatcagcacgatgaacagtcacaccgcggcctttggtgacatacccgacaatcgcatcgccaggaacaggcatgcagcacttggccagatgaaccagcagattatcgacgccttcaatcaccacgccatcttcggaatgggtttgtggctggtggcgttcgctggaaactgtcgtcactttttgatttttcgacaagatcgcggcttctttagctttacgatctttttcagccttctcgtggcgatacttctcggtcagccgattggcaatgactttcggcgtatattcaccatagccgatcgaactcatcagttcatcttcggtttgaaaattcagccgctgcatgagcccggacaggttttccttggttaggaactctttaggcgtatacccttcctcttgcagctcgtgttccagcatatcacggcctttttcggcattttcgcttttatcggcttgcttaaaatagcgcttgatcttgttgcgggcacgggaggtataaacaatcttgatccaatcacgactcggagcgctgccactggccgtcagcatttcgacaatatcgccgtttttgagcacataattcagcggtacgattttgccgttgacctttgccccgactgtatgattaccgacttcagtgtgaatgagatagccaaaatcaagtggattactccccttaggaagctcatagacgtcacccttgggcgtaaatacataaacccgatcggtaaaaatatcgcctttgacactttccatgaaatcagccgcatcgctactttcatcctgcagttcgaggatttcacggaaaatatccagtttcttaccagccttgtcatactgaactttactggtctgaccttctttgtaagcccagtgtgccgcaacaccatattcagccacatgatgcatttcttcggtgcgaatctgtacttctagcggtttgcccatgggcccgatgaccgttgtatgaatactttgatacagattggcttttggcattgcgatataatctttaaatcgccctggcattggcttccatttggtgtggatggcacccaaaaccgcgtaacagtctttaatcgtttcggtaatcacccgaatggctagcaggtcatagagctcgtcaaactgcttgtgtttgtcgcgcatttttttgtaaatggaataaatatgcttgggacgaccatagatttcgtatttgatatgcaagtcagccaatgcttttttgatttcttcaatggcttcttggatataagcttcgcgttcggttcgcttgctgttcatcaagtgggcaatccgatagtactgttgcgggtttagatagcgcaacgacaaatcttcgagctcccacttgatggtgctgatccccaaacggtcagctaaaggcgcataaatctccaatgtttcattggcaatccgccgctgcttgtccgggcgtaagtgttggagtgtccgcatattgtgcagacggtcagccaatttgaccatgatgacccgcaagtccttggccattgccaacaacatcttccggtggttctcggcgagttcatctttatgcgcgacatacgtgactttgctcagtttggtgacgccatcaacaataaccgcaacatcgtgcccaaatacttcttcaatgtcacctaacgtaatgttggtatcttcgacgacatcatgtaaatagccggaagccactgtctccggatccatttttaattcggcaagaatcccggctacctgaatgggatggataatgtaaggctcaccggacttgcgaacctggtctttatggacgtatgcagcaaatttataggccttttcgacgaatgccaaatgttcaggattcatataagctttgcacaacttcatgacatccggttgggtaagttcaacttcttcggccattccaattcctcctaagcgctcaccagcgcggttagaagtcggaatataagcggccttggacgtgatggccgttttttggccattgcgttcaaggtccttacatgcagacttctgcgctggtgagcgcgttaataggcgcaccgacattatgagaagggcgataaacggtctgttccgacttggccgggacaacacgcttatcgccgcttcgttacgcttgattaatcgcgtcagttcgcgcatgatcgctgcacgttgttgatgaaacaatagtcgcacagctggtttcatctgttcttagactacccttaaattataacgattctctggcaaaatgctagtcctttgccattgccagtaggcttaaaacgatgtagatcggcggaaaaaagtacccataccatttgtagcgccataaaaccatcaacgtaaacaaaacaggtaaaaccagaagccaccaccagcctaaatgatggcgatgaatcattttgccaatccaccaggcactcaacatattgatcaaaatgaacagcacaccgacacgaatggcagtgctgagatgcagtaacgggaagacccaagggaggagcaaggtcacgaagacactccaacaaataatggtgttgcgcggaactttgacccaattcatgacacgactcatcagtgatagtctcctttatcaatgattcaattatcaatgattcaatttttaattaagaaagctcggtgagaaccgagacagcactcagcaagtacagaggcgccgtttctgcccgtaaaattcgtgggccaagaccggctggtgtgaagccatttgcttttaacccagctaattcagccggtgaaataccgccttccggaccaaaaacaacgcataatgatgccggcttttctgccaacgctgctaccagtgccgcatgttcgccttgcttggcactttcttcgtaagcaaccagcttgactgccgcgctattgcctacatcactaagcttagcatacatcgccacttcaggaaccagattgcgatgactttgttctgcggcattctgagcgatggtcgccagccggctcaattttttggcaacccgttcggccggccagcgggcagtgccccactgtgcattaaaaaagccgatcttggcagcgcctaattcggttgctttttggacaatccactcggctttatcgcctttgctgacaccgcagacaatttcaacggcaatcggcagttcaacgggttgcgtgacatcctcgccgatcaaaaccgtcagcggatctgtgctttgaatcgtggcgtgataaacatggtgttcaggatcggctaactcaatcacatcgcccacctcatgacgcaacaccttaatggcatgcttggcaatcgctggttccaatgttaacgtctgcttttcatgcaacttatgtacggtgaaaaaccgttgcatcagtcgtcctcctcttgaatcacggcatcgagtgccacccagccgcctgtttcacgccgttgggcaatcgtaaacccattggcctgcaaagtctgcgtgattaaggcagctttgtcggcaataatgccagccagaagaaaatgacccttgggcttcaagcgttcctgaacctgcggaattaaaggcactaaaacctcagctaaaatgttggcaacaatcaaatcagcagacatggtgatcccttgtagcaaatcatttgcctttaccgtgatgtggctgacaggattgagttcaatgttagactgggcatttttgacggcaacatcatcgacatcggttgctaaaatacggctgacacccaagcgttcggcagcaatcgccaaaattccggagcccgttccgacatcaatcatcgtctcaccgccgcgcaccactgattccagtaatcctaacatcaactgggtggtcgggtgcgtaccggtgccaaacgccatgcccggatccagcgtcagcacgatttcgccattttgttccggggtgtaatgttcccatttaggcacaatggtcaaaaaacgcgaaactcgaagcggatgataatactgtttccacacattggcccaatccgcctgccgcacatcggtcaacgtgaccgttgccgctccgggatctaatccgaattgcttcaatgctttgacttgcgccgcaatgtgatcgcgctgttcaatgagtgaggtagctggatcaaaatagccaatcacctgggcgcctgaagccaaatgcggaatagtggtcgggtcaaaccaggttccgtgagcatcaattgtcgcctttttgaagtcagcagcgtccttaatttgaatcccttcggcaccggcttccatcaaaatattactaaccgcctctatcgcttcagtcgaggttgttaccgttaacgctgtccaatcgttgttcatcgatgtctccttttagtgccgcctatcatccacttgcagttaacactcactcatcaacttattaatactttggatacggcaaaaagatccgattgttggcgtcaggttgttgcgccagaatctcttcaaacgccgcatcgtcgaaattcaatgaaaaaagatcattgtcagacgtgccatcgacaaaatccatcagatcgctttcaccatcgtccagcaaatcctgtaagtaaatgaacaacgcatccacggttgcgacgtcaatgcctttcttgccattaaaaccgaaaatagccagatagtcatcggcataatcttcaccatgcagccgggtttcgtcataaaaaagaattgcatcttgataagtgaccggtccgtcatcaatggtcgcgccgttttggtcttcaacctcgatgcctacctcaccctgtgccgtcatagtgatttccaattcaatgacgtgggcatccttatcccagttcaaactaagatcgccgtcaaaatcgaactgatccattttctcgccgattgcatctaacatattcagttggctcatgcttgccatcctttcattttccgatcctggtctcgccgcggcaagcccgacacaaacggattgccggacacgtaaaatcgcaggggtgcacttgtccagggttccttattggggatgccgattcgcggaccgatcacgatattccgtgggcgatacgctgttggcgttagttttaattgaccgtcatttagcacagtcccatcgagctggcgatcaatcgctaacgcctggcataactttcccggcccgtttgtaagcccaaccccggtttgatgacgccggtgcgccatgtccgccagtccagcaatcggttcaagcgcgcgaatcaaaatgcactcaggaacatcagctgcctgggtcacaatattcagcaaacagtattgccgcatttgatacacgtaaaccgtgcccgcttccaagaacagactgtgattgcgcttagtatgccgattgccaaacgcatgtgccgcttcatcgcgaacaccgaggtaagcttcggtttcgacaattaagccgctgcagttggctaaacttaacttcatccccagcaattgttgggcggattgaagtgttggtcgtgttgctaaccaaggaattatcatgcttaatatattagcctagcttcagacgaatgcaaagggctaagtggctttgccttcaaaacatcgccaggtataatagtaaccaactggaaaggaagctgaacatggcagaaaacttagcattgcgcgcgcttatcagtcaacaagccgacacactggtctccgaactctacacagacgacaaggtcaatgcccgcctccaaaaatggttagccaaagtaccggatccgggtgtagctgacacttatagctatttgctatcagagtcgcgggatttttccgaagaactactttatcgaatcttaagcaaattggtcgaagacggcgcgcttacattgcctgaccaaaaataatggctagcaaaaagaggcaaactagcagtcttaatgggctgttgtttgcctcttttttgcgtgtgaccaggtacggctagaaagcaaggcgtggtcggactcagctcaggtctctgtactatgtccatgccatgctagcgtcatgctctaaatgccaccgaaaactacttaagcttatccttaatcgccgcaggaactgaatcagctgaaacggtttgtgggccagcaatgacccgtttttgcgaaatcttggctttaacgtacgtccctggtgttaatggcttgggatcagccgattctggagatgagaacccgagttttcgttcttgaccatcttttgtaatccagacgaaatcgtattcatacgtgtagtattgtttgccattcactttataaggcgagccatcatcattcttggaagcttcctttttgccttcagtgaccacggcataagcttcaaccccattataggtactgttccaatactgataaccaaaaaagcccaaaacgagaactgcaagtaacgcaaccacacctataactcttttcatggataatcgctcctttttgttaccaacattatgtcaatccaattgaaaagttgcaactatctttaccgcctttagggttttcttaaatcgtgacaaaaatgtcataaacgtaaggtgggcaaggaatacataggtatctgtgttagttgtatcggtttatatagcgtcattttaaggactaaatacggacttgaccgaacatttttgtaagaccaaaacaacaaaataattactcttaatttagctttaatacttttgcaagtatcgttcggcggaaggtaatctcgaaatatctgaggattgttggtgtgacaacaaaatcagcctcggagacaaagatcgtcccgaggctgatatgccttcttgtccaactactaaatggctttaacgcgcatctttgggtgaatgcttcactggcggatgattcttattgtttttattcggactgcgttttaatcggctgaagactgactgaaccgccttgaaacgttgcggatcgcggcgggcatttttgacaaactggctaaaatcatgatcgccaatgccgacttccggttcgtcatcttttttatgctttaaccaaggcatcatgacacctccgactcctcgcgcattcgatgtgagcggttggcgcctctcaaaataagcagcatggcaacgaccaatccaatcaatgcgaagacactataattaggaatcaaaataaaggcaataaaggcgcataacccaatgatgttgcccactgttagcaatcgtgaatgttgactcacaaaatacgacagtagatgaaaaatgatgccaggcacggtcaaccaccacagatggtccgcccatgtcatcagcgttgcgccaacgcttgtaaaagaaaatccgttgggcaaagttgtcacgatcgcaacaatcagcatcacaagggcaaacgccccgtaaatcaaatcataaagtgccggtacttttttaatggaaattttcaagtgtcgatcatcccttgttttagcagtaactgtattatacaagtttgcagaaaccattgcacgatgatggatcctgtttatacaaaggttattaatcttctgctgcagaattttgatatgagcgagcaaaaatgaaacggaccggatggaaaccgaccgcgtgatgtgcgggttcgcatagtcgactttggaaccagactaatggcgaaaaaaagcgtgataacaggcgttaaatcccggtatcacgctctttcaatctcaggagagtacaggatttgaacctgcgcgccggtattagccggttcgacggatttcgagtccgttgcattaccactctgccaactctccaaaacacaagaactagtataacaaaatgcctgcgctttgggaagcaattctcttgaaatttgtttgactaacttcaaagagactgaatcttggtgctgatcatttagatgagtggtgacactgtgtcaccttctaatcatgtgacgtttgcagctgttttgcatgatttgattatgcatgcctttgtaaaattactaaatacaagtctaaatatcatctataaataaattatgttattaaattatttaaacttgtacacaatccttttgtaccatctacaagttttattttgttgacataaattgttaagctgtataatatgcttctaaaggtgcaaacaggcgccttcgactttcagctcttcgggaagttaatgcccattttatcgttgttgtgaaggttcacaggtgaaatgacaagtaggaatcgcgatctgtcggggcagatcggattatttttaaataattaaataaacaatttggaggaaaagttaagtgaagaaaaagccgatttataagcgaatttggttctggttacttgttgtcgttgttatgattattgctggcggaatggctgggggtaaaggtaacaacagctcaaaacaaacatccagctctagtcagactgaaagtaaaactgctgatgcgtcaaaatcaacgccatccaaagctgaatccaaagaacctgatgtgccggccgattatcgctcggcattagccaaggcaacatcctatgcaacgatgatgaatatgtcgaaacaaggcgtttatgaccaacttacctctgagcatggtgaaaagttctcagctcaagcagcgcagtatgcgattgatcatgtcaaggcggactggaataagaatgctgttaaaaaagctaaaaattatgctgacacaatgcacatgtcaaaggctggcatactggatcaattgacttctgaacacggcgaaaagttcaccgctgaagaaggcaattatgccattcaaaatgtcaaagcagattggaacaaaaacgcgttggagaaagctaagtcataccaaaaggacatggcgatgtcacctgatgcaattcgtgaccagctaacttcagagcatggtgaaaagttcaccgctgaagaagcaaattatgcagttcaacatcttagtgataagtagccgcaactctttttaaacctgagttacactgaaacaaccttcgttcaatgatcgagcctaaatcaagctaggacttggtttgggggcaagcttgcctgtttgcatcaactatcaaaagacacccgtgagaaaataactcaccggtgtctttttgtctttttagcattttattctgattcggattttgacaacgcaatcatcgagatcaaggtgccttctttaatccagacgattcaaaaaatctgtcaaaaaagctaaacgcctttgcgcctgcccaaaaatatccggctgatagcgcgtgagcacttcttcgtcaaaagcactgtgcgcaatatactggtcatagcgcagttcaatttgaatcgccgttattccctgttggtgcccataatgacgcgtgatgtcgcctccgcgaaacggaaaattattttcgacagtccagccctgctcgattaaccgatttgttagtgcttgccgaaatgttttgctggaagtccggtcgtgatcgttgcctaagataatggtttttggcttaacgcccggataatacggatattgagcaaagctgtgcaggtcaattaaataagcatggccaaattttgctttcttttgattcagcaacctgcttagccgatggcggtaaggccagtaaaatatgcggacgcgttgctgcatctgcgcagtcgttaacggttttgcgtatagcggatggtcaaacgtgttgcgttgatagatagtggccgagcgataatcatggtgcagatcgtaagtcacggcgcggttgggatcggcaacgtagcgattgacgtgattgatcaatgtcgtaaacccagcggctggtaaaaagcgatagagttccggcaaaaaccaatctgtgttggctaacacagctgtcggcagcagcgcctgtttcatggaatcaggaagccaagtgccgctgtgcggtaaactgataacgacctgtgaatcatgatccggattcagcaccgtgtattttgcgttttggtcattcaaatatgaacccccccccttattgcaaacgatgcaccgtaaaaaatcagcaccgaacgattttcgcccgatgctgattagcctttttacttgattaagtgcgacattacgattcgcggtggccttcttcaggtaaaagaatggtttgactctcaccatcatcataagccatcacggtgtccgggaagctgggatcgtatgggaatggcagatccacggccatttccgtgtcggccccttcctcactaaaatgaaccgtgagcttaccttgattgttctgcagatcaaagcgcagtaagttgttcagtggcaccacgccttgtaagttgcggtcgatgatcatccaaatactatcgataatttcgcctggcaagttcgaaatgatgccaaatgtcgcgaatcgactgtgatttgcttcaaacatgacttggctcctttcctcagtcctgtgtggcaatatccgcaaactgtgcattgacaaagtctgccaacactttgggatcaatgccaacggaacggccgactttgccagctgatacaatcatttgctgctgattttcggcctcttgactgataaagatcgggtacttgtggcgttcatgaatgccaatcggtgtgttagcgccgtgttcatagccagtcgttttcacaaggtcttttaacggcaccatacccactttgcgattgccggagaccttgcttagctttttgtagtcgacatgccgatctaagggaacaacgccaaccactggcccggtcttgttgccggtcaataccaacgttttataaatttgatgttccggaacatcgaggtgatcgacttccaactgggcaacgtcgcccacttcttcggtcggaaattcataaggcacgtaggtaatgcccgctttgtctaacattttttcgaccaaggttttttctgtcttatgatgtttagccattgcgacccctcctcacgaaatttccatctgacctacttgaaaaccttcacttaaaatactagggcaattgcagcgaaaataccaccatcaagcgccggtgtatgccattaacgtgaacatatcatagtccttgatcttatcgcggccatgtaagtcgcttaattcaatcaaaaaggctgtaccaaccaccacaccacccagttgctcaactaggcgaatcgttgcggcaatggtccccccggttgccagcaggtcatcacaaaccagaacccgttgacccggtttgatggcatccttgtgtaaatacagggtcgcttcgccatattccagatcgtaactggccttaacggttggccgcggcagctttccctttttccgggccggtgcgaaaccaatgcctaacttgtaagcgaccggacaaccaacaataaagccgcgtgcttccggaccgacgatcatctcaacgcctttgtcctgggcgtaagcggcaatttcgtcagttgctgcggcataggcctttccgtctgccatcagcggcgaaatatcgcgaaaaataatccccggttccggaaagtctttcacacttgcgatgtaatctttaaaattgatggtcatgatcctacctcactgtctgtatgctccgtcagcaacatcgcttctaactgggctcgcggcatggtttgcagctgctgcgcgagcgttagaaattcctcgcgcgctgcataagccttggccgtctgcagtggcttcttggccggtgctgtgactggagaaataaaagcaccatctattgtaacaaagtcaagttcaaaaaacacctgaatcgccaagatcacctgatggaccgtcaagtgcacggctttagcgattgccggaatgtggtgcttgtcaaaaccggggtgggccttgagaaaatgcaaaacagcgccgaactcaacgcgcgtcggaatggccactaaatgactgggtgcgccgtaaaacataatggcgactggtggttggatttgctgcataagcgcgcgcagttgtgcacgattctgcggtaaatcaaccaaaacggcgttggctaatggcgatgtgacttgctcagccgtcagcgtcgggccaccaaaggagaattgccgctcaaactgctgcttaactttcgcatcaaaaaagacataggtgcgactgcttttgaattggctgccgtcaacagaaggcattcgccaatcaatgacttgcggttgcttgacttcataatcttttagcatcagctgcaggctcgtattgccttgccaggtgttctgatccagtctgacagcaagcttgacggcttgggcatcaaccagcgttgcagcggcctcaccaaagccaaaaccgatgacattaataccgttatccacctgaaaccggagatgcgcgttttccttgccaatttgtttcacattttgaatcacttgtggccgaagtgaaaaagtcggttcgggattgccctggccaaaaggcgcaagttggcgaatcaattcgtaatgagccaacgtcaaatcatctttttctaatcgcgcagcaatcggcagcgtcggctttggcacggttttgagcatcgttgctgcagccgcctccatctgcgcatgaattgcaggtagcgcctcggtcttggccgttaatccaaccgccatatgatgcccgccaaacgccaccattttgtctctaaccggttctaaagcgttaaaaagatgataggcttcgatggaacgacccgagcctttggcagtcatgccatcatcagcgatattcataattaatgtcggcttgccagtcgcctcaaccactttactggcaacgatcccgacaacaccttcgtgccagccttttttcgccagcagcaaggtcttggcggcttggttttccggagtctgtgccattgccagtgcttctgtagcaatcttgctgactaatccttggcgttcctgatttaatttaccaacctgttgcgccagatcagccgcaacatcctcttcaaaagtcgtcagcaaggtgacgccgggatttgcatctcccatgcgtcctagtgcattcagtcgcggaccaatcacaaagccgactgttgtttcgttgacagtttccggggcaacgcccgcctcttttaagatcgcggcaatccccacccgcggctgagtttgaatcattttcaaacccaactgtgcaatgacgcgattctcatcggttagactaaccaaatccgcgatcgtccctaaggcagccaaatcgacgctttcaagcggcggctcgccaagcagcgcggtcgccactttgaacgccacaccggcaccggaaagatcgccaaacggataatgaccatcaggatgcctcgggtgcacgaccgctaccgcatgcggcaggtttgcgggtagttcatggtgatccgtgaccacaacgtccatcccggcttcctgagcggcgtcaatcacagaagcgccagccacgccgttatcaaccgtgatcaccagttgcgtcccagttttctgcaaataggcataaacttcggcatttgggccgtaaccgtcagcaaatcgatccggaataaacacatcaggttccgcgccaaggctctgcaatgtttcaagcataatggcgctgctggtcaggccgtcaacgtcatagtcaccgtaaatcgtgatcttttcattatgttcgattgctttcaggattcgcgcgactgccttatccatgtcatgtaacgcaaatggatcgtgcagccggctgatgtccgggtgtacgaatgcctcgtagtcagatttatccttaatacctcgctgccataacaaagtcgccaaaaaggccggcacgcctaatgtctgactcaattgttgaacggccgctggatcgggttgtgcggcgagttgccactgatactgcgtcatattgtttcgttcctttctaaccgatccagtataccagacaacccgccacgaattaaccgcttgccacaagttttccattgcaccaatggcctttttaacctcttctattgcttctttgctaaacccatccgttcgggcaagaaaaagcgtgatataattgaattgttagaaagccctactccagtcagcgactttaaccgggcaatccgtaattgaagggttgtctttattagacaaagcgtaacggattaaagcctttcgcagaccgttacgatttttaaggaggaagcaccatggcaaaatctcaagaccaattcaatgaaaaggccggcaagaagattacagtttctgacgaagcagtcgataaggcagctaagcaaattgagaaagtcggttatgtaacggaaaaagacgttccggaaatgatcgaccgcgattacacccgggcattgtcaaagaaggtttccgctaaacttcacagcgacaacgacgatgattacttctacgaggagccttttgattacgaaaacgggcgaatcgccaacatcatctgggatatggataaaatcaagacacgtgaagaagccatgaaaaccttggcaaatgaacttggtttaaccgtaccgaagatcgtcatgcgcaaagttgacgaacaggtcttctaaaactgaatgttgacaaaatcgatgcccgcgcaaggcatcgattttttcttactgttaaatgatgcttctgtatcaagaaggacctaatggcgggcattgactgatacccatgtgtgcggccttataataagctaatcatgcaccattttgagaattgtgtgataataatgataaagaaaggacgtgaaagtcatggctgatcagcaagtattggacgacttttttgctaaagctaaagctgcgttggatctgccagccgcaacctacgaagacgcctatcagctcggcggatccgagttggctgacgagttagctgcgctggttaaaaccggccaaaagaccgcaaccaccagcggctttgaactctataccattgagcaagacccgctgccgattgctggcgtttacaacatcatcttggatcgtcaggatcgccctgtcgccttgactttcacggacaatgtgtttgtgacgccatttaccaaagtcgatgccacgatcgccaaacgtgaaggcgaaggctcccaatcgttggcaagttggcgggcagctcatgaggcgtttttccgccacgaatatcaggcaaacggcattcagtttgatcccgcctcatcaatggtggttgtcgaagagtttcacacggtttatccgattgttcaagcgaggtgacgaacatgagtcttaaaaatcgcacggcattagcggaaaagaaagtcacagggaaactcgaggacatccctcacccgactttagacgcgactatctacatccttgttttcggcattacggcgctcggcggattggtttcctatggcgcataccagttcttcaaaccggaacgcaagctggcgcataaggcaaaacatattgtggatgatcatcagcgtaagaatgagggctattagactgcacgaaagtagattaaaacaaccagacgccacggatcaccagcgcctggttgtttcgttactgtgagttattgtcagctatcaaaaatgcagagctgccgtttagaggaacagtctcagtaaacgttacagatttaaatgactacaaaccgctatttaccgcggctttcttcgtcattcatcttaagaatgctcataaacgcctcctgaggcacctccacagagcccaccgctttcatcctcttcttaccggctttttgtttctccaacagtttgcgtttccgggtaatatcaccgccgtagcatttagccagaacgtttttacgataagccttgacggtgctgcgggcgataatcttgttgccgatggctgcctgaatcggaatttcaaactgttgccgcggaatcgttgtttttagccgagcaacaatggccttgccgcggtcataagcaaagtctttgtgaacgatggtgctcagagcgtcaaccggatcaccattgagcaggatgtccattttgaccagatcactttgacggtaaccaataatctcgtaatccagactcgcatagcctttagtgctgcttttgaggtcgtcaaagaagtcatagataatttctgataacggtagttcgtagatcacattaacccgatacttatccagataatccatcgtaacaaattcgccgcgcttacgctgggatagttccatgaccggtccgacataatcgtttggcaccataatcgaagccttcacgtagggttcgcgaatttctttgatttcactggcatccggcatgtcagctgggttatcgatggtcttttcggttccgtctgtcaggactacctgatagtccacacttggcgctgtcatgattaaatcaaggccatagtcgcgttccaggcgctcctggacgacatccatgtgtaacagccctaggaacccacaacggaagccaaaaccaagcgcctgggacgtttctggttcgaactctagcgccgcatcgttgagctgtaatttttccaatgcttcgcgcaaatcattaaacttcgcattatcgactgggaaaagtccggagtaaaccattggcgtgattttccggtagccttttaatggttcttttgccggccgatccgctagtgtgacagtatcaccgacacgagtatcctgaatcgtcttaattgatgcagtaatgtagccgacatcccctaccatcaaaaagtcgcgcttaacggctttaggcgacataaccccgacttctgttacctgaaactgcttgccgttgctcatcagctgaatggtgtcaccgaccttgacctgaccttccttaacgcggacatcaagcacaacgccacgataatcatcgtaaaccgaatcaaaaattaaagcttgcaagggtgcgttgatatccccagatggtgcaggaatgtcttttacaatccgttcaagaatttccggaacaccgagcccggttttgccacttgccaaaatcgcatcagaagcatcaaggccgatcatttcctcgatttcttctttgaccacatccggctgggcgctgggcaggtcgactttattgatgacaggaataatttccagatcatcgtcaatcgccaaataaacattggcgagcgtttgggcttcgaccccttgagtggcatcgacaactaacagtgccccttcacacgccgccagactgcgactgacttcataactaaaatcaacgtgtcccggcgtatcaatcaagtggaaaatataggtttcgccatttttggctttatagtgcaattcgaccgcgttgagtttaatcgtaatcccgcgctcccgctcaagcgccatatcatcaagcacttgcgcctgcatgtcacgcttggcaatggtgtcggttaattccaaaatgcgatcggcaagcgtcgatttgccatgatcaatatgggcaataatcgaaaaattgcggatatgcttttgtcgttccagcatttcttcatgattcatctttaatagtgcctactttctaagcgaacgtttgattcttattatagcagagcgtgagctggcgcggttagaagtcggagtataagtggccttgggcgtgatggcccgattttggccattgcgaccaaggtccttatacgcagacttctgcgccagggaacgcgtttcaagcagagcgtgagctggcgcggttagaaaccggagtgtaagtggccttgggcgtgatggcccgagtttggccattgcgaccaaggtccttacacgtagatttctgcgactgtgagcgcgtttccgcaaccagacaagttagattgaagttgccagacaaggatatcaaaaaatcggttccagcgacaagttgcctccagaaccgatttttttgtgtcaattaattttagcgctttatttcccgcctttaaacgcttctttaacacggtcaaacaacgtgccattatgcggcgtgacatcttcaccgctggcagcagcaaattgcatcaatgctgctctttgtttctcattcagatgctttggcgtttgaatttcgacggtaacaatttcatcgccggttccgttgccgcgcagtcttggcgcacccttaccgcgtagtctgaacttagtctggctttgggtacctgccgggatcttcaactcaaccggtccatgaaccgtatcgactttgatttcgtcgcccaatgcagcctgcgcaaagcttaatgggatggtcagatagatttctgcgccgtcccgttgatactttttgcttggtgcaactcggaaaacaatgtacagatcaccgtaaggcccgccgttggtccccgcttcaccagcttgttgcagccgcatttgctgaccgtcttcaacgccggctggaaccttgacatcaatagtgtgacgttcttgttcatgaccgctgccatggcaagtcgggcacttttctttgatttctttaccggtaccgccgcagacgtcgcaaacctggcgtgtcatcatcgtgccaaaggccgtatttcgttgtacctggatgtaaccggtaccatggcacttatggcacgttaccgggctggtacccggtttagcgccactaccatgacaggtatgacaaacagcttcgcgatcgtaggagatcttggtatctttaccaaaaatcgcctcttcaaacgtcaagtccatccggtattgtaaatcggcgccttgacgcggtgctgacggattcgcttgggcaccaccaccagctccgccaaagaattggctgaagatatcgtcaaagccgccgccaaaaccaccttggccaccgaaatcgccaaagccgcctgcctggcctcctcctgcgccggcgttgccaaatccctgcggaccatcagcagaaccatactgatcataggccgcacgtttctggggatcagacaggacctgataggcttcatttatctctttaaacttttgctctgcacctggtgcgtgattgagatcgggatgatattttttcgatagcctgcgaaaagccttacgaatggtgtcatcatcggcatcccggctcacaccgagcgtctcataataatctttctgatccgccatgagttcctcctcgattcagatcgtgactgaaaatgccaattcagcatagcataattcaaacaaaaagccaaaaccgcgccgcggcttcggctttttgctgatgatctgcgaccttacttcttatcgtcgtcagaaacatccttgtaatcgccattgatggtatcatcgtcagacttcttgtcggtaccgccttgcgttgcaccggttgcagcaccactcgcagcgccgccttgtgcctgctgattcttctgggcgttttcataaagcttaacggtcatgtcctgaaccagcttgttcaagtcgtcccgcttttgcttcatgtcatcaaggttgttttcttgttgcgctttcttcaaagcttcctgagcatccttgactttcttgatgtcttcttcaggaaccttgccgtcaacgtccttgagcgtcttgtcggtctggaagagtaactggtcgacatcgttcttcaagtcgacttcttccttacgcttttcgtcggcttcagcgttttcttcggcttccttcttcatgcgttcgatttcttcatcggacaaaccgctagaactcttaatggtgatgttctgtgacttgcctgtgccaaggtctttggcagaaacctgaacgatcccgttcttatcgatatcaaacttgacttcgatttgcggaaccccacgtggtgccggcggaatatccgtcaattcaaagcgaccaagcgttttgtcatctgctgccattggccgttcaccttgcagaacgtgaatgtcaacagcaggctggttatcagctgcagttgagaagacctgactcttggacgtcgggatggtcgtgttacgatcgattaacttggtgaagacaccacccatggtttcaatacccagtgacagcggggtaacatccagcaggacaacatccttaacatcaccggaaatgacaccaccttggatagcagcacccaaagcaacagcttcatcagggttgatactgtgatctgggtctttgccggtccattctttaacggcttcctgaaccgccggaattcgtgtagaaccaccgttcaagataaccttgtcgatgtcagcgttggttagcttagcatccttcaacgcattttcaaccggttgcttggtcttggcaaccaagtcagcggtcatttcgtcaaactgagcacgcgtcaaagtgcgttccaagtgcaacggtccattagggccagcagagataaatggtagactgatctgggtctgggtaacgccagacagatccttctttgccttttcagcagcatcctttaaacgttgcatggccatcttgtccttagacaggtcgatgttgttgtccttcttgaattcggaaaccaaccagttgatgatcttgttatcaaaatcatccccgcccaaatgggtatcgccattggttgacagaacttcaaagacgccatcacctaattgcagaatggaaacatcaaaggtcccaccgccaaggtcataaaccagaatcttttcatccttgtcgcctttgtccaagccataagccaatgctgaggcggttggttcgttgatgatccgctgtacattcaaaccggcaattttaccggcatccttggtagcctgacgttggctgtcattgaagtaagccggcacggtaataacggcatccttaaccggttcgcccagatagtcttcagaaaatttcttgatgtattgcagaatcatcgctgaaatttcctgaggggtgtattccttgtcgccaaccttaactttgtagttggcttcgcccatgtggcgtttgatcgaaacaatcgtgtccgggttggtaattgcctgacgcttggcaacttcaccgacttgaatttcaccatctttaaacgcaacaacagacggtgtggtccgattgccttcaggatttgtaatgatctttggctgattgccttccaaaaccgcaacagctgagttggtggttcctaagtcaataccaataactttactcatattgttataccttctttattttcagtttaattatttagcaacaacgaccatagcagggcgtaaaacgcgatctttgagataataccctttttgcaggacctgcgcgacagtatcagctgcgtgtttgtcatcagccgcgactgtttgtacggcctgttgggtattcggatcaaatttttcgcctgtgccatcaatggcagtgatgccgttctctttcaaagcgcgttccaagtggtcataaaccatctggacaccctttttcaatgaagcagcactatcatctttggcctcggttgcaagcgcacgttcaagattatcgacaactggcaaaatcgcctttgctaacttctggccgtcatacttcagcagtttctgttgctctttttcgaaccgatgattcatattttgaatttccgcggctgcccgcagatatttatcttcgaattcatcacgttcttttttcaactgctcgccatcatgttggctgctttttagttgatcattgagatcagcgatgctttctttcagaatgtcttctttaagcgaagatcctgacgcttcagcaggttgttttgcctgtttggcggtatctgctgcagtttgctttgcttttttttctgccatggtatcctccctttaaaccatatttgctggcattcatggatccacactaacaaatattttttaatttttattgatcaaagttggcataataatccgtcaaccgttttgccagctcttcacggaaaacatccagcagtccgatcattttcgaataaggcatctgcgtcgggcctagcaaggcgatcatcccggtgccgtggtcaccaacatcgtagctagcggtgattaaactgaggttggccaaatcaattggcttaagctctggacccaagcgtacttgaaccggcgtttgacgaatcggtccgccaagcagttccgtcagatcaccgtgatcagcgtcaatcaatgacataatctttttcagttcatggatatcggaatcgcctaggtaatccatcagattcaaccgcccgccaacgtaaaagcgctcggaagcagcagatttcaaaacgttaccgaagatatccaagaagccttcaggactggtcagatactgcattaacatcgaaggcacatcggttttcagccgctgtgcaacttgaattagtggcagtccaacgagttgatcattgacaattcgaatcgccttttcgagctcatcggatgagatgttttgcgatacggtaaagacctggttttcaatgttaccgttattcgtgaccaaaatcgccatgacttggtgattgcctaatggaacaaggcgaaaacctgtcagcttgatattggttacttcaggtcccaagctaatggccgtgtaactcgtcagattagacaaaatttgcgcactttgcgcaacaatctcatccatcttattgtatcgctggctaaatgcctgcttgatagtcgccagttcttgatgcgaaacacgcaccggttcaacaaggtgatcgagataataacgatagccttgcgttgacggtacgcgcccggaactgctgtgggtcttggtgatcaaaccggcatcttctagcgacgccatatcattacggattgtggcggaactgacatgaatgggcagctcgcgcatcaatcgctttgaaccaaccggctctccgctttcagtaaacaggcggatgatttcttttaagacgagcacttgccgtttcgtcaacattttctcacctcacctttagcactcgtttcgcacgagtgctaatacactgaataatataccaagcactgttagcaaagtcaaggcgacattgctaaaatcttcagtgttttcggtgtttctagccagtggcggccattttttcaagaaaaaagagccgtttaaataagcggctcgtcaagcaaaaactgttgaaagacttcgttgcctaaaaacttgcccttgttggtcagccgaatgaaaccatcatcgcgctgtaacaagccttggctttccaactcaggtacggtctcgccataaacggcatcaacggtcagatgatagcgctgatagaagcgtttttcacttacgccgcgcatggttcgcaagccaaggaacatttcttcttcaatttgttcggaaaccggaaccaaatgatgggccaaaaccggtaaatgatcggtgtgaagcggcgttaggtactgtttgatcggaccataattgtgataccgatcgcgcccaagataaccaaacgcaccagctccaaagccgaagtacttgtcattttgccagtaaagcagattgtgttggcattgataaccatctttggcaaaattactgatttcatattgatgtctgccgtgtgcctccattagatcaatggcatcctgatacatatcggcttcgacatcctgcgttggcaagcgcaatttgccttggcgcatcaaattataaaagatggttttccgttcaagaatgagtgaatacgtcgaataatgcggtaaatttaaatcgagggctttttgtagactatttaaaaaatcgtcccggctttgatcaggtaatcggaaaatcaaatcaatcgacagattatcaaaaccgacttttctggcgttggcaatcgcgacatacacgtccttggcgcgatgaatccgtccgatccgtttgaggacatcgttgttaaaagactgaaccccgattgaaagtcgattgacaccataatcatgtaaaacctgcaacttatcggtcgtcagcaaatcattggggttcgcctcaaacgtgaattcaccagaattgaagtgcaagatgtcgcgaatgccttggcaaagtgtcgctaactgtttgggcgtcaacgttgtaggtgttcctccaccgacatagaccgtttcgattttctcatcaggatgctcagccatgaccattcgcatttccttaagcaacatcgcaacatagtcatcaaccggctgtccttcaatgaagactttattgaagtcacagtagtaacaaatatgttcgcaaaacggaatatgaatatatgcgcctgccatttcaacccttcctcgcaaaatactgacggactgccgtttcatctttctttaattgggtaatcaggccttctgcattggcaaatttcacttcaccgcgtagatagtggtaccaacgaacctgaacagttttgccataaatcatacggctaaaatccagcaaattaatctcaagcgtcacatcgcgatcactgccaaacgtaacattacggccgatcgaagccatccccagataccaagtaccatccacgtttactgttacggcataaatcccgataccaggaagccgctgctgacctaatgttgccagattaattgttggaaagccaagttctcgaccacgggcttcgccatgcaccactttgccagtcgttaaataagcgtaccctaaaagctcgtttgccgtatcgatatccccttgatccaacgcatcacgaatccgggtcgagctgatttttgcaccatcttcggccaacttaggtacgctaataacttcaaacctgccgtgcgcgtagtcgggcagcaacgccatattggcaatcgcgcgtttaccgtaagtatagtcaaaaccggccacaactgtatcagctttcaggcccaccaaatactgatccacaaacgcttgcggcgataaggcagcaaattccggtgtaaagtgaacaaaatacaacaaattcacgcctaattgccgcattagatcaatcttttcgtcacgcgttgacagatactgaatcgttgttttaccaacgccgcgataaacaacagccggatgaatatcaaatgtcatcacggctaacggcaattttttggctaaagcaatttgctttcctgctttaatcacggcttgatggccgcgatgtacgccatcaaaaaaacccagcgttaaaacaatgggctgtggcggcgccgctgatgcttgcaacggcgggtgaatatcaatgacttccatcaaaattatctctcattcttctcatttgctaaaaacataatatccgggcgatactggtgtttttcgaaccgataaatggctttcaaaacgccatcgtaacgtagccgaacccgtggtccatccaactgaagggtcaaaaatcggccgtgtcggacatcgtcatactggtcgtctgtcaaatcaactttcggcaactcagcaaacgcaatgtcaatcggttggatcactgacgctaaggtgccttcagtaatatgttgccccaaggcttcaagactgaccgcttgggctaatgtaaagccgccgcttttaatccgcgtcaattggctcattactgcagcgacgcctagcgattggccaacatcaactgccaaggtgcggatataggttcccttagacaccgcagcctcaaaacgaaaacgttggatcccttgagttgcgtcgaaaatcggttcactggttcgctcaaagcgttttaccgttacctgacgttttggccgttcaaccgactcacctgcccgggcatattcatacaaccgtctgccattgactttgactgcggaaaacatcggcggcacttgggtaatttcgcccgtcaattgggtgagtgcctgatccagttcatgcaccggtaccggcttcaccatcggcgttcgcttcaccacctcaccatcaagatcttcagtggtcgttgcaaagccaagtgtgatttcgccggtataaattttgccactggccattaattggggcacagctttggttgccgcgccaatcgcgagcggcaaaacaccatcaacgtttgggtcaagcgtgccggaatgaccgatttttttaatgtgaagaagcttgcgtgcatgataaacggcatcggcactggtcatgccggtcggtttatacagcggaagaatgccgttcatgaatttggcccctttcaatttttaaaattaaaaaacgctgactattgtacgccatcacgcttttggcttggtatacatactgcgatgatgcttggcatgcaccgcatgtcgccatcctgcccaaatgaaaatcagtactaccaaaatcgaaaagagccagtccggcgttttaacgttgatcataggtaaactcaatccaagtttgatggcaataagaccaacaaggacatacgccgcggtttccaattcaggtacccggtcaatgaaggtcgtgatcacctgggcaacgatccgcatcgccaaaatacccaggcagccaccgattaaaacaatgaccggattattggagacggccaaagctgccaagatcgaatccaccgagaaaacaatatcgaggctttcaatttgaaaaaccgtaccccataaaccatgggcacgtttagcctttttgtctgtattacttttaggatgacgaaccgcataaaaatagctggcactcatccataccagatacaaagcgccaagtgccttaatcggccaaaactgtaataagtaagttcccagtccgatggcaatgaagcgaaacagatacgccccgcccatgccatacatcaaggcctttttgcgatccgactcggccttaagctgttcagtctgggcagcgagaacaaccgcattatcaacggagagcatacattctaaaaggattaagctaaaaatcgtgactaagccgctgaccgaaaaagccagctgccagttgtggatagaaaagaatggtccgtataaggcccctaaaaacttgatcgtgatccttcccttctcaatgtttattattataccgttcaagccaggaaagctaaagcggctattgcgagaaaaagaagactgctcgttgcatgatgatgttattgaaaattggtgcaccaaaaaaggatccagtctttgcgactgaaccctttctggttgaacaacgctattccaaattcttgcgccgcacttcgttaattaactgatcaatacgggcaccatactgaacggatttgtcttgagcaaattcgatttccggcaccttgaacagccgaatccgctgcccgacttcacgccgaatcagtccactggctttatccaaaccggtttgggctgcttcgactttatcaggtgcatcatcgagaatgctgtagaaaatggtggcatgttgcagatcaccggtcagtttgactccggtaatcgtcacgcctttgacccgcggatcgttaacatcctttaacaagatatcatcaacttcacgttggatctgagtctcaactcgaccgatacgatgcttcatctgcgaattacctcctgttgagcgtgagccggcgcgcttaaaggccaaagtgtaagtggccttgggcgtgatagcgctctttgtcattgcgaccaaggtccttacacgcaggcttctgcgccggcgaacgcgttatggtggagcgttcgtcaacttttcacagccagcaaacgcctatcccttaaatgacttccgtacactgtttacttaaccggtacttcttccattgtaaaggcttcgatctgatcaccgactttaatatcattataattctcaatggtcagcccgagttcaaagccttggcgaacttgcttgacatcatctttaaaccgacgaagtgaaccaagtttgccttcatacttgacaataccatcacggatgaggcgaacgccggcatcgcgggtaatatacccagagtcaacgtaaccaccgacaaccgtgccgactttggaaaccggaatcgtttcacgaacagtgaccgtaccgataaccttctcttcataagttggttccagcatgcccttcatcgcagactcgacttcttcgattgccttgtagatgacactgtgcaggcgaatatcaacatcatcctgttctgcctgcgccttagccattgctgtcggccgaacgttgaagccaatgatgatggcattacttgctgcggccagtgtcacatcactttcattaatcgcaccaactgcttggtggataatgttgacccgaacgcctttgacttcaatcttctcaagactacctgccaaagcttcaacagatccttggacatccgccttgatgataacgtcaacttctttaagttgaccttctttcatcgtttcaaacagattgtccaacgtgacatgcgttgtgttcttgcgttcttcttcttgagcccgttttgcccgttcttcaccggccgcccgcgcagtccgttcgtccgcaaagacaacgaacttatcagcggattgcggcacgtcattgagtccggtaatttcgactggcatggatggcaacgcatccttgacccggcggccatgatcgttggtcatagcacggacacggccaaaggtattcccgacaacaatcggatcgccggtatgcaacgtcccttgttgaaccaagaccgttgcaaccggtcccttacctttatccaaacgtgcttcgatgaccgtaccgacagctcgctgatcagggttagccttcaattcgagcacatccgcttccagtaagatcatttccaataattcgtcaatgttcttaccgaatttagctgagattttgacaaaaatcgtgtcgccgccccagtcttctggaatcagcccatattcggtcaattgctccatgacgtgttccggattggcacctggtttatcgattttgttgaccgccacaatgatcggcgccttggcagcctgggcgtgatgaatcgcttcaatcgtttgcggcatcacaccatcgtcagcagcaaccacaaggacaacaatatcggtaatatcggcaccgcgcgcccgcatgttggtgaaggccgcatgccccggagtatcaaggaacgtaatcaaccgatcacgtaatttaacctgatacgcgccaatatgctgcgtaatgccaccggcttcgccttcagtcacgtgcgtatgccgtaacttgtccagcaaggttgttttaccatggtcaacgtgccccatgatcgtcacaactggcggccgtggctgcaagttgtcttggttcttgttttcttcttcgaacactttgtccaaatcggaaatgtcttcatgaaccttttccttcgcgtcaataccataatcggtagccaaaagttcgatggtatctttgtccagactctggttctggttgaccatcacgcccaacataaacagtttcttgattaattcagctggttcacgatgaagaatcttgcccagttcctgagcattcatcccaacttcataattcaagacttctggtaacggccgctctttgcgctgtggcatttccttcttcggctggctctgctgacggcgcttgttcttcttgttgcgccggttgctgttgcggttaaacccgttgcgattcccaaagctgttgccgcgaccaaagttgttattcccaccaccgcgccgactattgcggttgtcctgactgccgaccgttgctggtttggcagctggcgtaacggcagccggttttgtaaagcgttgattggtttttgcagctggttgttcggtgcgaggacgctgttctgtccgttgcgaccgttgttccgtctgtggccgctgttttgcacgagtcgattcagagcgttcaggacgtttactcgctacagccggtttagcttcttgttgacgctttggctgttgccgttcggattccggcttgacgaatttcccgccattgcctgcaacgggacgcggattgccattggctgcggtcggacgtccggcacgtggcattgggccggtcacacgctggttgtcaaaccggcgattacgatcgcgccgattgcgatcattcgggcgattgttattcgcagaacggttgttattgttgctgcgattggtgttccggtttcctgtcttagcagccgctgccggttgctcgccaccgcggttgtgattcccggacttatgcgctgtctgggtgccccgtggccgcaaaatcgttgacttacttaaaatgattttaccgtcagcagttttgttggaccgtgccggcttatgctcatgccgggtcggtttttctgcagctgcatgctgattatctttagcacttgtagacgctgctgacttggtcggtttagcagccgctgatgttgaaggtgttttagctgctgaagacttgctcaacacccctttgatttttgcttcttgatcttgatcgatcgaggacatgtgattctttacttcgatacccaagtttttggcaatatcgatcacgtctttattatcgacgtgcatttctttggcaaattcataaacgcgttttttgcccatttcttcacgctccctgcaatttaggtgagcagctcttgcatcttcttggcgaagcctgcatctgccacggcaatgattgaacgatcactaccgatagcctgtgataagtccattttggagaatactgtcaccaaaggaactttatagtagctgcttttatcggaaaacttcttgcgggtattggcacttgcatcactggcgacgaacaccagctttgcatcaccggaacgaatcgctcctaacaccagttggtcaccggtggtaagacgactggcgcggcgggccaatcccaataaatttaaaacggcttgtttttgcatggttacttgccgaatagttcctgacgtgccttttggtgatcgacataagcaaaaagatcatcgtaaaaggccgggtcaatggtgataccgaaggctgcgtcaatcagtttctttcccttagcctgtttcacagcatcaggattcaacgccacatacgcgccacgtcctgctgctttgccagtcggatcgattgcaacaacattttccttgtttttaacgatgcgaacaagttcttttttgggcatcatcgtattgcttagcaagtccttgcgcattggaatcttacgctttttcatggctcgcctccttatgcctgtgactggtcatcagcgtttggggtgaccggtgttgcctcggatgtgtcatccgattgttcggcttcggttggttcatcgctagctgcctcggtgttgtcgacctgatcatctgacgcctctgctgcttcagcttccgcctctgacaactcatcgtcatccacgaattcaacttcggactctggcttaatatcgatcttataaccagtcaactttgcggcaagccgcgcattttgaccttttttaccgatggccagtgacagctgataatcaggaacgatcacggttgccgaacggtcattatcttcatcgttgaactgaaccgcgatgacctgggccggattcaaggcattggcgatgtaatcggcaggatcttcttcccactgaacaacatccatgttttcgcctgacaactcattgaccaccgcctgcactcgagcaccgcgcgggccaaccgtcgtaccgacagcatcgacagcatcattagtcgcccgaaccgcaatcttcgtccgatcgccaggttcacgggcaatgttgacaatttcaaccgtaccatcgaaaatctccggaacttcttgctcaaacaagcgtttaaccaagcccggatgcgtccgactaacgaagacttgggggcctttgctggtattttcgaccttggtcacataaaccttgatgcgatcgtgcgcctcatacttctcgttcggcatctgatcttggcggcctaaaacggcttcgatcttacctaaattgacgtagatgaaccgattatcgcgccgctcgacaacgccttgtaaaatttcatcttcatactgggaatattcatcataaacaatactgcgttcggcttcccgcacacgctgcataatgacctgcttggctgtttgtgcagcgatccgtccgaaatctttaggggtaacttcgaatttgattttatcgccgatttcgtaagctttattaatcgccaacgcatccttgagacttacttctaaccgcgaatcaaaaacttcatcagtcacttctttgacagcatagacatggatgtcgccttgtttaggatcaaattccacatcgacattttgtgcctgattgtaattacgcttatacgcggaaaccaatgcggcttccaaagcttcgatcacaacctctttcttaacacctttttcttgctctaaggcgtcaagtgcttggatcatttcctttgacatgcttttcttacctccactagaattcgatcgccaaccgtgcagaagcgatcaattttcggtcgatgacctgatcgaatttgcggcttttatctttgaccgttaatgtcaactggtcaggtttcagatctttcaaagtgccttcgaagattttcttaccgtccagcttcttgaatagcgagacatgaatatagtcgccgactgcctgctcataatccatctcacgtttcaacggtcgctcggcaccgggactggaaacttcaaggaagtattgttgcggaatcggatccgggtccatactgtccagtttctcggacaaagcttcactgaccaacacacattcatccagtgtgatgccacctggcttgtcgatatacacccgcaagtaccagccgccgccttccttcacaaattcgacatccgtgaggtaaaaatgatggtcgtccaaaatcggtttgaccaaagcggtcacggtttcaacaaccgattgcgtactcaagccaccgcctcctttattgttcactcaagacttttgattctaacggttgccagccaaacatcgtgacgttcgccaataaaaagagtgagcatcgctgctcactcaccgccagaaccttactttactattgctacaataccatagatagccgccacttgcaaacaggcagtccgttgtggtagtaagcgtcactaccaacttcacatgattttgctactttgaggttatgccaccatcatattgcctgacaatttaaaataatccgtcaaaaagcgagagttggttctcgtctggtaaatcgtctagcacatggttggttgtcatgtaatcaatcagcgtcttggagactttaccacgattggcaagatcttctttagacaggaacggtttctcttcgcgggcagcaacaatctgtttcgcgacgttatcgcccaaccccggaactgcgcggaacggcgccagaatcgtgtggtcatcctgaatcagaaaatcatgcgaatcagacttagtgacatcaatcattttaatcttgaagccgcgttccagacattcgttggcaatctccaacacggtcaggagttgcttttctttcgtcgaagcatccatccctttgtcagtgatttccttcatggcggccttaaccgcttctttgccgtggctcatcgcggccaggtcaaagtcttccgcacgcacggagaagtaagccgtgtagtacaccagcggataatgaaccttgaaccaggcaattcgtaacgccatcaaaatataagccgtggcatgggccttcgggaacatatacttgatcttcaagcaggaatcgatgtaccagtctggcacattttcattttcccgcatggctttttgccaatcatccggaatcccgcgccctttacgcacgtgttccataatgttaaaggccactgagtcatccatgccccaatgaatcaagtccatcatgatgttgtcacgacagccgatgacttcttttaacgtgacaatgccctgcttgatcaattcctcggcattacctaaccacacgtcggtcccatgtgaaagaccggagatttgaagtaattcgctgaaggttgtcggtttggtttcttcgagcatgccgcggacaaaccgagtaccgaattcaggaatgcccagtgtgcccattttcgagttgatctgttcaggggtaaccccgagactttcagtgccagagaaaagcgccatcacaccagggtcatcagtcggaattgacttcggctcaactccggataaatcttgcaacatgcggatcatggtcggatcatcatggcccagcacatccattttcaaaatgttgtcatgaatcgaatggaaatcaaaatgcgtcgtcatccaggctgcgttttgatcgtcagccggatactggatcggggtaaagtcgtaaatatccatatcagccgggacgattagaataccggcaggatgttgcccggttgttcgtttaaccccggtatcgccttgtgccagccgatcgatttcggctccgcgcagttgctggccagtgtcacgttcataagctttgacataaccataagccgttttgtcagcaaccgtaccgattgttccggcccggaaactgtgatcctcaccaaacatgaccttgatatagttatgggcgatcggttgataatcaccggaaaagttcaaatcaatatccggcaccttatcgccgtggaacccgaggaaggtttcgaaaggaatgtcgtgaccgtctttgtgcagctcagcgccacacttcgggcagaccttatcaggtaagtcaaaaccggaaccaacttcgccatgcgtaaagaattcactgtattgacacttagggcagcgataatgcggcggcagcggattgacctcggtaatgcccgccattgtcgccgccagactagagccaaccgatcctcgcgaaccgaccaagtaaccgtccttgtttgactttaaaaccagtcgttgggcaatgttgtagatgaccgagaatccgttaccgatgatactttttaactctttgtccaagcgttgctcgacgatttccggcaaaggatcaccgtataattcatgggcggtggtcatgacatcatgcttgagtttgtcttccacaccaggcacatcaggcgtatagagtttggttttgactggcgaaatgtcatcgtcaatccagtcagcaatcagattggagttggtcacaaccaactctttggccttttcagcacctagccagttaaaatcatccagcatttcccgagttgagcgaaaatgcacatcaggcagactgtgacgattcagcgggttggcaccgccttggctatgaatcagaattttgcgataaatggcatcgtgttcatcaaggtaatgagcatccccggtgaccaccaccggtttctccatatcttcgccgattttgataattttttgcaaaatatcctttagatgcgattcgcctttgatcaaatctgcttccaacaatggctgatagaccggtaatggctggatttcaagataatcatagaaagcagccttttcccgggcctcggcttcccctttttgcatcattgccgtgaaaacttcaccattggagcaggccgatccgacaagcaaaccttcacgcaatttttgcaactgactgcgtggcacccgtggtacgcggtagaaatatttaacattggaaagtgaaaccagcttgaacagattcttcaatcccgcctgcgtcttagccaaaaccacggcatgactcggtcgggcagccttgtaagcatcgcccgctccaacccgatcattcagctgattaagcttggtcatgccataaagcttggccgcttccttttccaacgcgtaaagcaaataaccggttgcctcggcgtcggcgttggcgcgatggtggtgttccagactgaccttatatagcttagccaacgtatcgagcttatgattcttgcgttccggatgcagcatgcgcgacaattccagcgtatcaataacaggattctcgatgtccggtagtccgtggcgttcatacccgttatccaggaagcccacgtcaaacgtcacattgtggccaaccataatggccccgtcacaaaattgctggaaaagtttgaagacttcttcttccgacttcgagccatgaaccatgtcatctgtgatatgcgtcagattaatcgtcaattccgacaagggaaaaccgggatcgatcatttcttcaaattgatcaatcacttggccatctttcatcttaaccgcggccaattcaatgaccttgtcatagactgctgacaatccggttgtttcaacgtcaaagacgacatattcggaatcggcaaggtcgcgaggttcgttagcgcgataagcgacaggtgtgccatcgtcaaccaggttaatttcaacgccgtatagcatttttaatccggccttatctgccgctgtgtgtgcttctgggtaagcctgtaagccggcatgatccgtcacggcgatggctttatgaccccattcttttgcgcggttaacaaaatcggtgatcgaattcgttgcatccatttgactcatgttggtatgcaaatggagttcaacccgtttttcaccttccacgtcatcagtcggatcagggtgtgaaacggtttgaatgtcctgagcattaatcgtcaattcacgggaataattatcttcctgaacgctgccccgtacgcgtaaccattggcctttttgaattcgggcaaacatcgcctcatcatcagcgccgttactaaacttcttggcaatgaaactggaactataatccgtgattttaaagattaataattgccgtttggagcgtaactcacgcacttccacatcaaaaacgtaaccttcaacggtaaccgaccgctcttcttgtgtgatggttaccatctgctgtggcgggtcactcatttttagctgacgacccatttgaactgggccatcagtgctttcttgtttctgcttggcggcttgacgcttaaccacttcagcagcagcttgtgccattttggccgtttgggcggctttttgggcttcgaaggcggccactgactgggcagcctgctcttcatcaacgtctgcctgcatccgcaacccggtgaatccgacttgctgataggtttcctcaagcttgcctaagccttgatgaatcaagtattggcgaacctgttcgttttccgcggtgatcaccgcacgaccattgaccaaggtcggaacctgcttttcacacaactcccgcacgatcccggtaccgatttccgcattttgcacgacaaatcgccaatactgagccagcaattcatcggttaaaaccggatgagccaccgcaatggtcaagttagttttggcaatttgtttaaacgcaagcggcagttgcgtcgccagtggattaaaaatctgaaacggcagaatcgcagggaatcccagcgtaaagtcataccgctgcgattgctcgtggatggtcacgccttggaccacaccttctgccagtgccggatcatttttgacatccgctggcaaatcaagttgatccagtaatttttcaaacatctcatgttgggataaagccaaattgtgcacccctcttagatggcagaaactgggacaacccgccgcgtggtgatcaatgccatgtcgaaattgctttcaacatggcgatcatcggattggcgattttgccccagcatcatcgtaatcaattatgcttttgcttgttcttgtttatgcagctgggccatgaggattttgatcgaactgatcagctcttccttcttgacttcaatggtctcgccggttttacgcaactttagttcaacaatctcgtcgaccgcttttttcccgactgttacgcgtaatggtaccccgatcaagtcagaatcagcgaatttaacccccggtcgctcattacggtcatcaaccaaaacactgtaaccagcctcttcaagcatactttcgattgaagctgtcagcgtcttttgttcctcgcgctttagattaaccggaattaagtgaatgtcaaatggtgcgatcgtcgttggccaaatcaagccatgatcgtcagcttgctgttcggcaatcgctgaaagcaagcgcgaaacaccgatcccatatgaacccatgatgatgggttggctgcggccattttcgtcgagaaaattggcacccatggtttctgagtaacgtgtgcccaacttaaagatatggccgatttcgatcccacgggtaaacttaagcacgccctgcccatccggcgagacttcgccttccttgacaaatcggatatcagcaaagctttccggcgtgacatcgcgatcaaagttaacatttagaaaatgggtgtgcgccttattagcacctgcaaccaggttcgtcaagccgcttaaactgttatcggcaataatccgcacgtctttgtcgacgttaacgggaccgatattgccaacttcggcatgcatgaccgtctcaacctgttcaggggttgccatttcaagaaagtctgcacctaaaatgttctttagcttggtgtcgttcacttcataatcaccacgcaccaaagccaggactggcgcgccatcaaccataaacaaaacggccttaatcagcttttgttctggtaccttcaataatgcggcaacttccgcaatggttttggcatctttggtatcaaccggttttaattccgcctgagcttctacgccttgcttaggtagcgccatgctggtggccatttccaaattggcagcatagtcggaactatccgaatagacgatagtatcttcaccgatgggcgcaatcgcggagaactccttggaatccttaccgcccatggccccaccatcaccgataatggtgcggtagcgcagccctaagcgatcaaagatattggtgtaagcatgctccatctggcgataaatcgtatccagatcctgatcattgctggtaaacgaataggcatctttcataataaattcacgaccgcgtaagacgccgtagcgtggacgatcttcatcacgaaacttatcctgaatttgataaagaaccagcggcatgcgcttgtacgattttagttcattgcgaaccaagtccgtgaaggtttcttcatgggtcggccccagaatcattttacgatcctggcgatttttcaacttaaacaggttcggtccataagtttcataacgtccggattcttcccagagttcggctggcaacaagaccggcatcttcatcttaaccgcgtcaatctttgtcatttcatcatcaatgatggcctcaatgcgagttaggacgcgttcagcgagcggcaaataagcgtaaacaccagcttgaacttggcgaacaaagccagaacgcaacatcattttatgtgacttcgcttccgccgaactcggtacttctttttctgtgggaataaacatccgtgattgtttcatgtcagcctccaaagctagtttatttaaaagtaacgcataatgtcattaatcgtgacggcgagcatcaacaagaccatcaaacccagaccgatcatcgtgaccacaccttcagtttccggtttgagtggcttgcgccgaatgatttcgatcaggtttaatagaattttcccgccgtccaagaccggaatcggcagtaggttggaaatgcccaaaccaaggcttaggtaacccatgaagaacaacaagccagccagtccacctttagcactttggctggtcatagtataaataccgactggtccggcgagcttattaagtgaaaaaccaccagtgaccattgacttcaagacatcccatgtgcgaacagctaggtcccatgtctgggtaaacccataagtaaaggcgcgcgccggtgacttctcaacgggcaccatcacgccaatcttacctttcttatccggtttaatcgcaatattttgtgttttgccatcctgcttgacagtaaacatgactgatttgccggcatgtttgctgacctgtgttgaaagatccgtaaatgaatgaatcttcttaccatcgatggattcaaccctagcattcgatttaagtcctgcttgagcagccggataatcgggaagaacggttccaacctgattggtattcaaaatctgcacaccaaaaatcaggccataaatgatgaacgtcaaaatagcgagaataaagttattcatcggtccggcaaaattgaccaagagccgccgccaaaccggtgcattttgaaattgcacgtcttccggcgcaatctggacttctgtgccatcttcttcgatgatagtggcgtcatgatcaacctgccaactttgcaaggcatcttcatcaccattcggataaccttcgatgacaaggtccttgaccaaatcgacgcgactgacctgaaccggcatgccgccttctaatgttgttttgtcactggcattaatgcggacaactttaccggcatcgttcaaaatcaagctcagcatcgtgcctggtttgatatcatcttcatcgtcctgccagcctgccatacgcacataaccgcccagtggcaacaggcgcaatgtgtaggtcgtattattcttatgtgacgcccaaagcttcggacccatgccaatcgaaaattcacgcaccagaataccgctgcgttttgcaaagtaaaaatggccaaactcgtgaaccaccacaagaatgcagaagataacaataaaggcaatgattgtggtcatatgtgctccttaaaggttagacaatgccaaagagatgcaacattggcaataccagcagtagactgtcgaatcgatccaagatgccgccgtgtcccggtaaaattttcccggagtccttaacgccataaaaccgtttcaacgcggattcaatcaaatccccgatttgcccgataacggataaacacagcgcaatgcccatcatcggccagaatgtatagtattgcggtaaaaacattaagtaaatagcagcagtaatcaacgccagaacaatgccaccgatgctgccttcaatcgttttgttggggctaatcgccggccataacttgtggcggcccaacttgcggccgatcatatacgcaccggtatcagtgagccagacaatcagcagcgcaaacatcaacgtatccagtcctgcatcattccgcacgctgatcaagtaatgaaaaccggtgccaatgtaaaagaacgagagcaccgagacgccgatatcgtcgaaggttgtccgatttttggtcgtgaccgttaagaatagcaacaaggcaaccgcaacataaatcaaatcgatacggcccaaaaaggcaggcagccagcggaaaaagctatttggcaaaaccacgaccaagacaccaagcgccgcaatcaggaaatccggcgaaagaataatccgcttccgcataatatagacttctgacaaagcgatcaatgccaaaaccgccccggctgtatcgatccaaccgccgcccaggattaaaatcggaataaaaatcgctaaggcaacgaccgccgttatgacccgttgtttcatgataataaatcctccatcaccatttcattaattgattatttttttaaaccgccaaagcggcgatcgcgtgcttggtaggctgcgattgccgactcaagggcagccggtgagaagtccggccaataatcatccacaaaaaccagttcactgtaagcaatctgccacagtaaaaagttagaaatccgcaactcgccactggtccgaatcagcaggtcgggatcagctaacgggcccagaaatcctgtcatcaaagcagacgaaaaacgggaatcatcaatttcctctggcttgagtgcaccttcctgaacctgtttagccaacttttgagcggcgtgaaccaattcatcacgaccgccatagtttaaagcaaagttgaggatcatcccagtattattagctgtatcagccatagctttttcactcgcttgacgtgtcggctcaggcaagtcggccagctcacccataacttcaactttaacattttccttaattaaatcaggcatgaagtcattaaaaaagtcgactggcaagcgcattaagtaattgacctcagaacctggccgcttccaattttcggttgaaaaagcatacaaagtcaaaaccttaacgccaaggcgactcgctgctttggtaatggttttaacattttgcatgccctgcttatgcccggcaacccgcggcaaaaaccgccgcttcgcccagcggccattaccgtccataataatcgcaatatgcgcaggaatacgtgaaagatcaagctttactttagaacccttggctgtggccaaactggcgcctcctcacaacgtccatggtaccctcaagcaccaaatgtcttaaacgattgtagcagaaaaaagacaagagcgcgagccagcgcgggtagaagctggagtgtaagtgggcttgaccgcgatggccgggctttggccattgcggtcaaggtccttacacgcaggcttctgcgctggggagcgcgtttccatgcagcatcggctaacagtgcttcactcaacaccggcagttgaaagcgaaaagccttgtgccattgcgaccaaggtccttacacgcagacttttgcgccagtgagcgcgtttccgtgcagcatcggcgaatcctcctcacacaccagaggtagaagctttggccattgcggtcaaggcccttacacgcaaacttctgcgctggggagcgcgtttccgtgcagcatcggttaacagtgcttcagtcaacaccggcagttgaaagtgaaaaaccttgtgccatcgcgcccaaagcccttacacacagacgcctacactcccatacaccaccaaaaaacaaaaaccccagatttcctctgaggtttgcccacaaccattaagcttcagtgatctcaaacttcggtaatttctttttccttcgctgcggcaatatcatcaatgcgcttggttgcttcatccgtgactttttgcatgtccttttcaagccgatgcaattcatcttcggtgatatcgccgtctttttcctgacgtttcagcttgtcaagtccttcacgccggatattgcgcactgcaattttggcattttcggaaaatttaccgacttctttagcaatttccttccggcgctcgcctgtgagttgcggaatcaccagacgaatcacgtcgccatcattagccggattaatgcccaaatcactggcattaatggccgtttcaatgtttttcagcgcagatttgtcataagggctgatttgtaagacccgcgcttcaggaacagtgatggctgccatctggttcaacggcgtcggtgcaccataatattccaccgtaatctgattaagtaaactggcgttggcgcgacctgcgcgaatattgcctagttcgcgctgcaatgattcttcggttttgcccatattggtttttgcctgttcgataatttgatttgccattagcttctcccttcgattgtggtgccgatcttttggccttccacaacccgtttgatattaccgggctcattcaagttaaagacaactaagtcgatgtcattgtccattgacaacgtgctggcggttgagtccatgactttcagatccttattgataatgtccatgtgcgtgagactttcgtacttcacggcgtgggtatctttattaggatcagcggagtagacgccatcgacgttgttcttcgccatcaaaatgacatcagcaccgatttctgcagcacgtaacgctgccgttgtgtctgtgctgaagtacgggttgccggtaccgccagcgaagatcaccacccggcccttttctaaatgacgaatggccttgcgtcgaatataaggttctgcgatctgccgcatctcgatcgacgtttgtacccgagtcgggacaccttggctttccagattatcctgcaaagccagtgcattcatgacggtggctaacatgcccatgtaatcggcttgcgcgcgttccatgcccatctcggcaccggtttcgccgcgccagatattgcccccgccgcaaacaatggcgatttgcacacccagttcatgcacctgcttgatttgttcagcgatcgtcgcgatgacgggcggcttaatcccaaaaccagcctctcctgccagcgcttctccgctgatttttaaaacgatccgattatatttgaccatgtatcttatccctccgttggttgctggcactattttaccatagtcgcagcatttctgcggcaagaagctgcagacaactgccctgttttaccagctcttcaactggatagctaaaaattcatgacgcccgctgacagtcaatttttccttgcccaaaacgtgacgccttcattttgccatagaaaaggggccctgcctcgtcgacagtcccccttttgttgggccattaacccttgatttggtccatgacctcatcagcaaagttttcttgtttcttttcaataccttcgccgacttcataacgaacgtaacccttgacggtgccacccttagcagcaacgtacttggcaacggtttggtccggatccttaacaaattcctgatcaaccaatgaaatctcgctcagccacttgttaactcggccttcaacgatacgagggacaatcttttctggcttaccttcgttcttggtttcttcagtgaaaatatctgtctgatgctttaattcatcagctggcaccttgctgcgatccagatactcaggattgatagcagcaacatgcatcgcaacgtcttttgcagtgtcgtcatcggcaccatccagaaccgtcaaagcagcaatttggccaccgttatgcaagtaggcaccaaaatgttcattgtctgtcttggtaacgacctggaaacgccgcaaactgatcttttcgccaataaccgcggtcaaggcaatagcaccttcatcgattgtctgaccatcactcatcttggtcgccttggcagcgtcaagatcagccggcttattagcagcaatcgccgctgctaccttgttgacatagtccttaaactgatcattcgaagccacaaaatcggtttccgagttcacttcaacaatcgcagcggtgttaccgttaatggcaatttctgccaaaccttcagctgcaatgttgccgctcttcttagccgcttttgccaaacccttttcacgcaagacatcaatcgccttgtccatatcgccgtcagctgcgaccaatgccttcttggcatccatcattccaacctgggtgcggtcacgtaattctttaacttgtgcagcagtaatttgagccatggatctgatcctccttgattgtaaaaaagctgcctgcagatcttgcagtatgcgaaaccctcagacagcttaatgtttaattaattagttagcgcttttgttgtcgccttcaacggcttccacgatatcttccatggagtcagccttcttatcggcagctggttgctgatcctggtcgtcgccttggtcttcaccctggttgccttcaatgatcgcatcagccatcttggaagtaatcagacgaacggcacgaatcgcgtcatcgttagaaggaatgatgacatcaatatcgtcaggatcggtgtttgtatcaaccatcgcaacgattggaatgttcagcttttgtgcttcctgaaccgcaatcttttccttgcgtgggtcaacaatgaacagcacatccggaatccgtggcatgtcttcgatgccgccaaggaatttttcaagcttttcttgttgcttcttcagaagtgaaacttctttcttaggaaggacatcaaaagtgccatctgtagccatcttcttgatgtctttaagccgcttgatccgggtttgaatcgtgttccagttggtcagcgtaccaccgagccaacggtgattaacgtagtattggccagcgcgggttgcttcttcagcaatagcatcttgtgcctgcttttttgttccaacgaacaagaagacgccgccgttttgggcttcttccttcacgaaattataagcatcgtcaatcatcttaacggtcttttgcagatcgatgatgtagataccgtttctttccgtaaagatatacggcttcatcttaggattccaacgacgggtttgatgcccgaaatgtacaccagcttcaagaagctgtttcatgcttaatactgccatgtttttgttcctccattatggttttattcctcttgacaacgtcagctcgcaggtggacttcaaaggaagcaccccactcacgatcagtcagtcaatgtggtttgtgcataccgcactcgacaaagtatacagacttttcacgactttgacaagccctaccacttgacatgatgtgcggttaaaaattgctcttttttgtgacgactttgatgtttaaaatgccattccgccgacagtgcttcgtgcttttcggaaaacgcttcctggtacaacaaccgaaccggtcgccgcgatgccgtatacttcgcacccttaccggcattgtgcgtggctaatcgcgcttcaacatcatcagtaaagccgccatagaaggttccatcggcgcataagaggacgtaaaagtaataatacttactcaccatgcaacaacctcctgacgactggcgtatagctgccatctgcctcatgcacaatcagtggcggcatgattcgcaagccatccggtcgtccggctttgatggctgcaatcaaaaccatgtttgcctctcgatcctcgcgcggatgaatgaattgcaactgcttaggcgccaaaccggccgcggtcaaggttgctaacaattccgccaagcgttccgggcggtgaacaaaataggctttgccttgatacttcaacaagtcggcactgacttttgccaccgtagcgaagtcagtggttaattcatgtcgcgccaaagcaagatgatcattcgggttggtgatactttggtcactcaccttaaaatagggaggattacacgtcacaacatcaactgaatcctttgcgaccacctgagttgtctgtgctaaatcacccacgtgcacatcaacatttgttaaatgattcaattcaacactgcgacgcgccatatctgccaaccgcggttgtaattccaccatggtcacctggccatctgtttcgcgtgccaaaaaaagcccgaccgcaccattgccagctgctaagtccactattcggctgtgacgcttgacttgggcgaaattggccagtaaaactgcatctaatgaaaacgagaaaaccgcggcactttgtataattttaatgttgcgactggccagcacgtcgactcgttcacctggcaataatgacatctccaacacctttttcctccgaaagctggtttacaatggtataatttaccacaaaagtttaaccatgaaggaagaataagccatgttttatagttttctgcgttatgtcgtagccggtttactctggctcatcaatggacacgttaaggctcaggataagcaacaattacctgacgggccatttgttctggttgcgcctcaccgctcctggctcgacccggttttcctcgcacttgcctcctggccgcaccatttttcatttatggcaaaaagcgaattgtttaaaaatcccctgctgcgctggttacttgttaaagttggggctttcccggttgatcgcgcgcatcccgggcccagtgccatcaaggttccggtccgtgctttaaagcaggaaaataaggcgctaatgattttccctaccggctcgcgttactccgcggatatgaaaggcggtgcgattctgattgccaagttggcaaaagcgccgattgtaccggctgtctatcaaggcccgggaactttttggtcattgtttaaacgcaaacctgcaattgtccgtttcggatcaccggttgagcctccaaaaggtcggctgactgacgaagcgctcgcaacctttagcgatcagttgcaagaaaagtttgcggcattagatcacgcgatcaatccggattataagtacatccctgataagaagaaatatctggaagaaaaagaacatggtgacgtttaaggttcgcttgtcgaacctttttcgttggatgggcttgtgttgaaccgtttgatgttatgtgcttttgggtgtagtacccggtgaacgttcagccccctcaacgcgttcgccgatacaggagttggctcacgctcacttcttcataacgcgctccccggcgcagaatagaaaggacaagtatccttatgaatctttggaaaagaatgacccgtaagccagacttggcggccgcacttaaagctgatgatttactgacacgaagcttaacgacgcgagatttgattgcattaggcattggtgccgttatcggtactgggatttttattttgcctggtaccgttgccgctacaacgagtggcccggcaatcacgatagcgttcattctggcggcggttgtgtgttcattggctgccatgtgttatgcggaatttgcttcggcactgccggtggcgggttcggcttatgcgtatggcaatattgttttcgggcaggtttttggctggatcattggctgggcactcattcttgaatacatgttggcagttgctgcggtttcgactagcttttctgcctactttgccagtttgctaacgggttttcatatccatctgcctgcagcgattgccggaccgttctcgcctagccacggtacttatgtcaacctgattgccgtccttgttgtttggttaatcggcattatgctttcgcgtggcatgcagtcttcgatggcgatcaatcgactcatggttttagttaaattgcttatcattcttattttcgtgatcgtcggtttcttttacgttcagccggcgaattggcatccttacctgccatttggtgccaaaggcgttctcgccggggctgccatggttttctttgcttaccttggctttgacgcagtgtcggcgtcagctcctgaagtaaagcaacctcaacacaccttgcctcgtgggattatcggtaccttgatcatcgccacagtcctatatgttttagtcgccattgttttgacaggaatggtgccatttaccaaactggacgttgctgatccagttgcgtttgcgctcggtgcggttcatttacgcggtcttggcggtttcatttcggttggtgcactggcaggcatgttcaccatgatggtcacgatgatttacagctcatcccgattgatttatgctattggccgtgatggcttgcttccccgttggttcggtcatattagcggacatctaccagaaaatgccctctggacagtggtcgccatcatcgcgatcatgggcgggctggtgccgctaaaccagctggtcaaccttgttaacattggcacgctgattgcatttgcgtttgtttccatcggcatcatcccgttacgtcgacataaagccatcactaacgatggctttcacgttcccggttacccagtgacgccaatcgtgtcgtttctcttttgcctgttgctcatgacccaattaagtgttgaaacctggcttatgagtctcgcgtggtttgcgtttggcttggtcatttatttcagctatggcatcagacacgggcacgtttccgaagcaaaaatcaggtaacaatcaacatcatatttacttaagagaggaaaataatattggtcaataaacaaacagcaacctgccttgttgatggtcaagtatatgccatcagtgatgggcttttcttaagtgatctggaaaccaaacttgtcaatatcatcaaaaatgattatcccaaggccactaagaacagttttatctgcaattcgcatttattaaattatcggcttgaacggatgcgacgccaacaacgccaagatgaacgggcacatgaaaaaatcaaccgcaaaatgtcgcaagcgttggtcaaggatgattttcaactgaccgatgtttacgacaacatggaagcaacgaacacattcggcgaacgaattgctgacgcggttgccaagtatgccggctcatggccgtttatcatcctcttctccggcttcatggtggtttggatgattctcaacacggtgggcatctttggccataagtttgatccgttcccgttcattttattaaacctctttttgagtatggtagcagcgttgcaggcaccgctcattatgatgagtcagaaccgggcggctgagtatgatcgactcgaggccaagaatgactatcatgttaatcttaagtcggaagaagagattcgcttacttcattccaaactggaccacattattgccgacgacaacccgaatttatttgaaagtcagcgcctgacagttgaggttatgggcgaaatggtcaaccagttgacggaaacccgccaacagcttgaactacttaaagccagtcaggatgaaaccgacaaggccgtgcacgaggaaaaatcgaaaaaataaaacatccctatttggcgtggcatgtgatgcctacttaccaaacagcggatgttcttttttacaccaaattttcggataaccatcatttgttagtggattcagcgccactgtcaccgacttgcagatgatacatttcataatagcgaccatgtttagccaataaggattcatgcgtcccacgttcgacaattcgcccggcattcagtaccaaaataaggttggcatcctgaatagtcgaaagacgatgggcaatggctatcgtcgtccgtccctgtcgaatacgccgcaagccctcctgaatcactgactcggtttctgtgtcgatattggcagttgcctcatccaagacgagaatcttgggattcgtcacaaccgtgcgggcgaatgaaatgagctgccgttcgccgctggaaaactcgcttccgccttcaataaccttggcagaataacgatccggtaatttattaatgaagcgatccgcctgaacgaattcagccgcttgctgaacctgctgatccgtaatctgatcattaaacaagcgaatattgctactgatgtccccataaaacatgaaggaatcctgcagcaccaaacctaacttcttccgcaattcttccatcgggtaatcacgaatgtcgacatcatcaatcaaaatctgccctttgccaaactcgtaaaagcgcatcatgacattgataatcgaacttttacccgaaccggtatgaccgactaatgccaccgtctccccagggttggcaacaaaactgatatcatgcaaaatatcgtgcttgccatcataggcaaaactaacatggcggaattcaattttgccttgctgaatcaccgcatgcgcgtcagggtgctgggcgggcgcgtactctttgctatccaaaatccggaaaattcggctaccagctaccacaccgtcttgtagaaacgacagattatccatcatgttgaccatcgggttgaagaagttagcagtatacgtggtgaacgcatacaccaaaccagcttcaacataactatgcatggaaatcagcccgaacgtccacaaaaccgcaatcaatgcgaatgaatataacaagttgatcacagacgacagcagcaaggagttcactcgaatcatggccttacgagcatccaggtattcctgattagttgcctcaaactcacggctgatccgattctcctgccgaaattgctgaataatgctgataccttcaatcgattcattcagctgggtattcaactcggaaagcttttcgcgcatgtgccgataaactttggagctgtacgtgctgtaataccagacaaccactaacaaaatgggtaagaacgcagccaccaacaacgcaattttaggatttgctgcaaacatgatagtgaaactactgataaccgagaacaagccgacgataaccgccaaaataacgttccagaaatcagagaaggtcatggtatcattcgtgacgcgcgaaacaatcgaaccagccggcgtctgatcaaaataccgcatgccaagtgtatgcagtttagcaaacaactgtcgccgcgcatcttcaagtccccgttcagcgcccatgttgaataaaaaggtctggaagaactgaaagacggcttttacgaaggtgccaaatgcatataagaccgcaaacaataggagaattttgacggtcgcactttgattcgccaaataccgatccataaaaatctgcaggatctttggcagtaagacgttcatacctgccaataacgccgcagcaacaatcgcaccgatgaattgacgtttgtatggtcgggtaaagcccatgagtcgacgcataatcttaatctgttgtcgcaccgggatacttttagaccatgcactttcgtaacctttacttgccacgtacgtcaccttcctccgctgcttccatttcctgctttgcccacatttcggcataccaaccatgtttggccaacaattgggcatgtgtaccacgctcaatgacttggccgttttccaaaacaataatttcatcggcatgcatcactgagctcaagcgatgagccgcaatgatcgttgttttatgcgcgcgatcacgtttcatgttggtcagaatttcttcttcggttttcgcatccactgctgataaggcatcatccaggatcaacaattcaggcgcattgatgaccgcccgagcgatggccaagcgttgtttctgtccgccagataagctgacgcctttttcgccaaccaaggtttcatagcctgatgtgaattttttgatatcatcatgcaccgcactttccttggcggcattttccacgtcctgctggcccttttcaaaggcggaaaagcgaatgttgtccgcgaccgtggttgaaaacagaaaattatcctgagggacgtagccgattgaatcaagtaacgcatccagtgaataatccttaatgttatggccgccaaactcaatgaacccatcgtaattatcgaattcacgcaacagaagtttgaaaatcgtactcttgccggcgccgaccttcccgacaatcccgagcgtgttgccttccaacaaggtaaaatgaacccgactcaaggccacttgctgatcattggggtaactaaacttgttgatctgataccggatattaccatgcgccggcgtggtaatcgcgtctttggcttcgagaattgtcgagcgctcctgaagcagttcgttgacccgatcataactggcattcccgcgttcaagaatgttaaacaggcgaccaatcgcaaacatgggccagactagcgccgaaacataggtcacaaatgaaaccagttggccgaccgaaatttggccgtgcacgacttgccagccgccgtaaatgatcgtaatgacataagtaaggcccataatcagactagtcgtcggatcaaacaacgcatcgataaaattaacccggcgattaatctgcacggttcgatcgacaatccggttaaagtcggctgtatcctccgcttcctggccgaatgtcttaatcactttgataccgctgacactttcctgcgttttatcattcaaccgcgaaaatgccgcctgcgactcggaaaacgccgcatgcagtctggtgcccagtttacgtgccatcacggccagcagaggcatcggcaaaatcgccacaatcgtcaggcgccaatcgaccactaaaatcatcgcaataatggtcgtacctcctgtgataaacgaatcaaataatgtcaagattccggcaccggccacattctgcaccgcgtttaaatcattggtagcatgagccatcaaatccccggtgcgatgtttttgataaaaagtcgcgtccattttcataaaatgccaaaataaacgggtccgcaacgtgcgctccaactttgcggccccgccccagattgcattacgccatccataacggaagagatattgcgcaattccggagaacagcagcagccccagcataagggcaagataattgcctgtcagccgtgatttactcattgcatcaaccagatcgccgatgacctttggcggaatcaaattaaccaaggctactaatagtaaaaaagtcacgcctaacaggtaacgccgccactcttgtttaaaataccaccctaattttctaaaaattcccacaaccatgctccttaaatcgccaacctaattcgcgcgttcagaatcaagctgcttgttttatgaaataaatgacttatgttttctcataagcgccgttagttatgaatattctctcatgatagcacaaacatcgttaggacgcgaaaacgcgacgacagaaagcatctctgtcatcgcgttttcttagcaattacttagcattacgttgggcttgtttcatttgcgccatcatttggttcagtttcttagcagatggcttttgccccatttgcatcatcatggtgcgcagcatgtcttcgttcacaggcggattatcttgaaaatactttttcatatatgcccgtgcgccgaagaatccgcctgctaagccgaccagtaacgcaatgatccccacaagtattgtgattagcaatgtgcggcctccttcaagtttcatttctcattgtactaaagcgctttgttgttgaaaagactaatctttccgccagccatgttcgcgttggattttttggacttttttgctggtgatttcttgtccttttttgtcaaaaacctgtgtgtgctcgatttgatcgcgtaaaccggcacgaaaatcttttaaataagcttcacgcagctgttgacgttcgattttttcctcaggtgtcaaccctacgctgcgatctttcttggctaattcattgatccgatccagtcgttcttttggttgttgtgccatcatgttgccccctaagttttaatatcatcacttaatttagttgaaccgcgtggtagtgataatttgcggcttcatgatcaggatacggcgcattttgtaacatcgcaacatattctgcggcacggcgccgagaagagaaggctttgagcaactcgataggtgctaagcggtccgcgtagtagacaacataaatcaactgatcgttcatgagccttcacctcgagtctttcgtggcgcggtggtggtgtgaagctggaaattccccgttaactcccataacgcgttcaccggtgcagaagtctgcgtgtaaggaccttggtcgcaatggccaaagcccggccattacgcccaaggccacttacactccgacttctaaacgcgccgattcacgctcaaacaaaaaaagaccgtttccggccttttccaagattaacgacgcttttcgcggatacgtgctgctttgccgcggagtgcgcgtaggtagtagagttttgcccgacgaacttggccgtgacgggtgacttcaatcttttcgacccgtggggagtgtaatgggaatgtccgttccacaccgacaccgtttgagattttacgaacagtgtaggtagcggaaatgccaacaccgcgacgtttgattacaacgccttcaaagagctgaatacgttcgcgttcgccttcgacaatcttagcgtggacgcggacgttatcgcctgcacggaagtcaggaatatcgtcgcgtaactgtttcttggtaatttcttgaatcaatgggttcattggtctttctcctttgccgacattcataatcatcccgaacagcggaatgccgttgatatgtgacgtatcacaatcaataagtttagcatgtccggtgatgcgtgtaaagataaaattctttacaagattggctagccgctatgtttctaaacaaccagactgcctaatccaaaaacctcgtagcatttcgggcctaattttgctccgaatcttctgcgttccgggtgcttgcatttaaccgtctttctgctgctttagtagcctcttctgttttaacctcgcgtaacagttttttggcggcatcatcaagctcgacttgtttaagtaaatccggccgccgcagataggttcgacgcagactttcctttaaccgccagcgcgcaatcagctgatggttgccattttggaggacttctggcaccttcatgccgcgatattcaggcggacgggtatattgcgggtattccagcagtccattttcaaaactgtcggtgtaggcactttcgtcattacccaaaacacctggcaaaagccggacaatggcatcaatcatgaccattgccggcagctcgccgccggttaggacatagtcgccaagtgaatattcatcggtgacaagtgtccgaatccgttcatcataaccttcgtaatgcccacaaataaagactaggtgactttcttgagagagttcccgtgcaacttgctggtcgaactttttgcctgccggatccatcaaaatgacccgcttaggtcccggatggcgctgattaaccccgtccatggcctcaaacagcggttccggcttgagcaacatccccgcaccgccaccataaggcgtgtcatcgacatgatggtgtttgtcgtggctataactacgataatcaaccacatcaaagttaagcaaatggcgttcaagtgccttcccgatcatgctttcgcgcaatggctcaaacatatttggaaataagcttaaaacatcaatctgcatcgtcaatcaacccttctggcacgatgacgtgcgcttccttgtgttccagatcaattgactgcaccacagactttaaaaacggcaacaaaatttcgcttttaccggcacggggaatcacccagacatcattaggaccggggctgagaatctcgctaacttgaccgagtgtctgaccatgctcatcaatcaccgtcaagccgataatatctttatagtaatagctgccggcttcgagcggctgtagggcagcatccgtgacctgcagttttttccctttaaacggtaaaacctggttaatatccgtatagcctttaaacgtcagcatcgtgaggcctttatgcttgcgaaccgactgaatcgtcagtgccgttttgggcgaagtcgcaacataaactgtcttccccacctgaaaccgctgttccggaaaatctgtcgtcacaagtacgcgaacctcaccgcggatgccatgggtattcacaatcgtaccaatatcataatactcgggcatacatttcctccttatgtctccaccagtcatgtcaaaataaaaagaccgacgcggtatgcgccagcctttttattttgtatgcggcgcatccaaaatattgagccgcacccgcttattgtacgggcttttaacactgtatacaatggttcggattgcctgggcaacccggccctgtttgccgatcacgcggccgacatcctcaggtgcaacagctagatcaaaggccatatactcgcctgtttcatgtgccgtcacctttacggcttctggtttggtaaccagcggggtaacaatggctttgatcaaactaccgatatccaccatttaagaccgcccttatttcttagcaaagcgcgcttcatgatacttctgcatgatacccttgctgccaagcaagttacgtacagtatctgaaggttgtgcgcctttttgaagccaattcaaaatatcttcttcatttaactttaaatcgactggattagtcaacgggttgtaatagcccacggcttcgatgaaacgaccgtcacgcggcgagcgtgagtctgctacaacgatccggtagaaaggcttacgctttgaacccatccgctttaaacgaattttaactgccactaagtccacctcctgctcatttatcaaccttgatagcatagcaaaaaaaaattaagctgtaaagccttttttctttacacggaaaattgttcggcttatgaatggaatcgcttggcctttttaagccgcttcttcttgttgcgcttttgcttgcggaccattgagttcatcgccatttttcctagtttgccagaaacaccaccacccatgagtccgtcaaggcccttcatattgcctttgctcatctggttcatcatttgtttactttgattgaactgtttaatcatgcgattgacttcaacaaccggtcggccagagccaccggcgatccgccgccgccgactcggattcagcaaatccggattttcccgttcctgcggggtcatcgaataaacaatggccttcatgtgggcaatgtccttaggatccattttgacatttgccaacgccttattattcgccatcccaggaatcatcttcatgatgtcctcaagcggccccatcttgctaatttggtccatctgatcgagaaaatcgttaaaatcaaacgaattctcacggatcttctcagcgacttcttgagcttgtttttcatcatagttcttttgggctttgtcaatcagcgtcagcatgtcgcccatgccaagaatccggttggccatccggtccggataaaagacatccaaggcgtccatcttttcgccttgcccgatgaacttgatcggcttgccagtgaccgcgcgaatcgacaatgctgccccgccacgggtatcaccatccaacttcgtcaaaacaacgccggtaatatccagctgttcgttgaagcctttggcaacatcaactgccgcttgaccggtcatggcatccacgaccagtaaaatatcatttggatgcgcaagtgctttgatgttcttcagctcgttcatgagcttttcatcaatctgcaatcgaccggctgtatcaatgaggacgtaatcgtttttgttctctttggcggtggccaagccttgccgcacaatttcaaccggatcggtatcggtgcccatctcaaacactagcacattcagctgcttgccgatggtttgcagctgatcaatcgctgcagggcgataaacgtcggccgcgatcagcaaaggtcgcgccttctcgttgtccatcaaatatttggctagcttgccgaccgttgtggttttcccggccccttgcaacccagccatcataatgacggttggaatatgcggcgccttgttcagcggcaccgctgcctcgcccatggttttgactaactcgtcgttgacaatcttaatgatttgttgggcgggggtcaggctttcgagtacttctgtaccaactgctttagtgcggacgtttttgatgaacgtcttaaccacatcaaaattgacatcggcttccagcaacgccagccgaatctcccgcatggcctcgcgaacgtcgctttcactgaccttaccttttcgccgtaatccgctaaaggctttttgtaaccgttccgataatccttcaaatgccatagtatccccctgctatttcgcggtttgatccgcgactcgttctaataatgtgctcaaaaccttgtcgtccgggtaatgggtgcggacatagcccaccagcgcatccaccgcctcattttgcgcttggtaattggcaaaaagatgcagcttcttttcatattcttccagactggcttcggttcggcgaatattgtcgtaaaccgcctggcgcgacacgttgaattcagtcgcaatttcgcccagcgaataatcatcgccgtaatacaaagccaaatacgcatgttgtttatccgttaataacgggccataaaactcaaacaatgagttcatgcgataatttttttcgatttccatcatgtcattcctttaatcccatgattgccggtacatcagttctccggccgcttgaacatggtccttgtataaggataccggtatcgccggaaatggtcaattagcagtggcaaatagttggcgcatctcacgttttaaaaaagacgacaagctagacgaacggtcattaagcacttaaaatgtaatcggtcacaaccgccttatcgtcatttagaaaggacaagatttcacatgccaaaaacggatctaaaaatgacagcagctggttttaaaactaccgatgatttagttgacgctaccatccatctgcttgatgagaacgactatcactttctggcgatcgcactagcgcaagagctggtgtatcatcgtagcgaccaagataaagtgacgttgattaaagaatatgtccaacttgtgtagatatagagctacattcgcacattgtctgttctctaacaggacggatcgacgaaagcggattcacatttccggttttgcctcatttcgtggtacactgaacatgtgaaaaattggagggaagaatatggtcgcaacctttatttactgggccgtgtttgctgtccttgctgcttggggattgtggagtttggttttctcatgtgtttacctgagcaaccatgaaaacggcaatttatggttctttgctattatcaacaccattttcggtcttttaggctggttatttgcatggatcatgagcaatacagcatggcaacaatactggtttgcaagtaaagtccaaccatctgcttggttcacctacctgctaatcggctaccttgtcttggttatcttgcaagtcatttttggccgggaaaagaaggtccagacagcctaaatcatcaacgcgctggattgacgcacgttaacgcgttcgccggcgcaggagtctgcgtgtaaggacctcggtcgcaatggcaaagttcgccatcacgcccaaggccacttacactccgactcctaagcgcgccggctcacgctcatataaaaaagcgttgcacttgaacgaacgggtgcaacgcttttttctgttcttttgattgccttgacttaggctttgacttcaatcaggcccttaaacaagccggtcacgaacttcgtcggatcaaatgcctgcaagtcatccattttttcgcccagccccactaacttgaccggtacatgcagctcattgcggattgccaagacgatgccgcctttgccagagccgtctagcttggttagcacaatgcctgtaatttgggtcgtctggttaaactctttcgcctgattcagcgcattctggccggtcgtggcatccagcactaacaagacttcttgcggcgcatccggcaattcgcggacgatcacgcgtttaatcttgttcaactcattcatcaagttgactttgttttgcaagcggccagcggtgtcgaccaacaccacatcgtagccttcttcttttgcccgcttaacgccgtcaaaaacaacggctgcgggatcgccgccttctttcgtggccaccaccggcacatcaacgcggcggccccattcttgcaattgttgaatagcgccggcacggaaggtatcggctgccactagcaagacgcgcttgccttcttctttgagctgatgcgctagcttgccaacagtggtcgtcttgccggcgccattaacgcccacaaacagaaagacagttggcccttcttcggcaaagtgcagctggttatcttcacctttgccggcctcaccatacatatctaccagcttctcaacgataactcgcgaaacggccttgggatccttcgcatttttaagcttaacctcttcgcgcaattcatcgctcaaccgaaccgctgtttcaaacccgacatcggattcgatgagcatctcttcaaggtcatcgaaaaagtcttcatccaccgtccgaaagttggcaaataacgcattaagcttttcgccaaaactactgcggcttttctcaagaccttcgtcatatttattttcttcaggcgtttccggctcttccccggtgaacgcttttttaatcgcatcaaaaagtcccattaacttgtcgcctctttctgtgattgatccagactgaccgccataatccgactcacaccggattcttgcatggtcacgccgtacaagacattggccgcaaccatcgtgccgtgacggtgcgtgatcacgataaattgcgtcgcactggcataatggcgtaagaactcgccaaaccggttaacgttgacatcatccagtgacgcctcaacttcatccaaaatcgaaaatggcaccggacggacttttagaatcgcgaaaagcaacacaatcgcggttaacgcccgttcgccacctgacagcaatgacagtcgcgtcagcttcttgccaggcggttgtgcggaaatctcgatcccggttgccaacagatcatcaggatcggtcaagctgagatgggcatgcccaccgccaaacatttgtgggaaaatcgcttcaaacgcactattcgtctggtcgaacatatttttgaatcgtgttttgacagtttcatccaattcgtgcatcgtctcttcaagctgctgtttagcggccaaaagatcgtcttgctgcttggtgagaaactcgtagcgctgattgacttctttgaactgttcaattgcattcagattaaccggccctagttcatcgatcccgcgtttcaagagctttaacttgctctttaattcgggaatcggcgcgtgatccggcgccacggcagctttggccgcttcgtaagtgagctgataatcctcggctaacgtgttcagacgagcatccaggcccaacttcacccggttaagggccaccgcctgttgttcggaggtcgccatcgcctgatgctgttgttcataggtcgttgtaattctggcagaaatctcgcttaacttgccacgattggccgccttggtttgagtcactttggtttgctcggccttcagctgcttcagttcctcttgtaacttggcaatcgtagctgtacgactggctttttcagccgccgtttccttagccgtggccgtaatgtgctcaatgcgttgctggagttcagtaatttgttcatttgcatccctggcctgcgtttgccattgctgatgctgatcatgcagcgtctgcaagtcattggtcaccacggccagcttcgtcttcaacgcattttcggctgctgcttgcttcgaccgggaatcggccgcagcagtcgcagcagttttcagctgttcaatttctgcctgagcctcttcgatgtcacgagcaatttttttgccagcttgacgaagctcggtcattttggtacttaaatcagcctgagccgtgttggcttgttgtgcggccgccaactgtcgctgcgcctgtcgtaacgtctctgcctgcgcagtgtgttgactggtaatggccgttagatcggccgctaacgcctgagactgcgcttgagcgtcctgccacgcagcttgggcaacattctcctgcttggtcagttcggtcaaggcggtttgcttctttttgagatcttcaactaatttctgcagttgggtcttgagatggcgagcttcttgattgcgggccagcggtgaggcttgccggccttgtttgacctggccgcctgtcagcgagccacctggattcaaaatatccccagccgtcgttacaatacgataacggtgatgagtggtattggcaatggtaatcgcgtgcggcagggtatcgacaatcaagacactgcctagtagattagccatcacggactttagatcagccggatattgggcaagctgcagacccgtgcctaaaaagccgtctgcgcctttgacaagctgcaaaaccgcacttggcagctcacgtggccgcatcacagcagcaggtagaaaagtcgcccgaccagctcgctgttgctttaacaggctgatggcgcgttgggccgccgcttcatcgcgggtgacaatagcttggagattgctacctaacgccaaatcaaacgcttgctggtaagcggtcggtacttccaacaattcagccaccgcaccaatcacacctggcaaggttgctttatgcttcagcacaacccgaacgccgttataaaagcccgcatagtcttcattcaattcagatagcgtctcataccgtgcacgtgcgcgttgataagtcgccatttcgtcttgataagtttgctgctgggcactgcggttttgttgcagctgattcaacttggttttagcttcttcaacggcagtttgttgcgtttctgctttagcctgtaacttttgctgctggcttaacagcgtattgaccttggcctcctgatcctgcgcctgcttgctcagctcatagattcgccgatcgtgcgccgcattttgactcgccgcgagttgctggtctttttgtaaggctgcctgtgcatttttattgtcagcttgagctttcaacaaatcaatatagtgattctggacagactccaactgacgattcaaagcagccgggtcttggctggcttgcttttgctgtgccaactgttccttgaggttttgctgctttttctgggaggcatcaagctgcttggttaagtcggccagtcgctgatttgcctctgttagcgcctgctgagcgtgggtcaaccgatcttttaaatcagccaaggttgtcgccgcattggccgagcgttcgctagagaggttcgcttcaccgctaagattttcaagcttcatcgaacgactcaagacctggtcattcaactggttcaaccgttcttcatgctgatgatccaccgcactcaactgttcagactgattttccagatccttaacctttgccgtcagcgccgcaatggtcgccttggtcactttagcttcgccttgggtcttctcctgctccgccgccagctgttcgatttccagtgccaaaagtgtttgatgaatctttttatagtccgcagtttgctgctgatagtccttggccagtgaggcttgctctcgcagtggttcaacctgatgcttcaactcgacaataatgtcattaatccgcgccagattatcgtcattgttggctaattcgcgctcagctttggttttctgttgcttatatttataaacgccagcggcttcttcgatgatgccccggcgttcttctggtttgctattaaaaatcgcttcaacccggccttgcgagataaacgaaaaactctcacgccccaagccggaatccatgaacagatcgacaatgtccttcaatcgaacatcttgattattgagcagaaattccgaggtgccatcgcgatacaatcggcgcgtcaccgaaacttcggctggctgatttttaagataaccatcgctgttgtcgaaggtcatggtaaccgccgcacgattcaaagcaggtcggctgtccgtacctgcaaagataacatcacccattcgctcgccgcgcaggcttttggcactttgctcgcctaatgcccagcgaatcgcctcggtgatgttactttttccactaccatttggcccaacaatcccagtcagaccggatacaaaatcaatttcggttttatctgcaaatgatttgaagccattaatgatcaaacgctttaattccatgatgaccccattctagttcttactttttcaagcgggctaaagccgccttggctgcagcttgttcagccgcttttttatttttaccgaacccggtccctaatactcggccttcaacttcaacatcaacgtgaaattggcgttcatgagcaggacctttttcatccaggaggtgatacacaatcgccacatcaccattttgctgcagggtttcctgtaatgcagtcttatgatcctggttagccgaaaactcaccggcatcaatcttaggaaaaatgatctgttcggcaaatttgatattggctttacggccttgatccaagtacaaggcaccgttaaatgcttcaaacaagtcttccagcaacgtcaatcgcttgcgggcaccggctttttcttcaccttttcccagtttaatatagcgatcaaaatgtgcctcttttgaaaacgccgaaaaggctgcagtttgaaccgcggcagcacggatacgggtcaaatcaccttccggcttgtccggaaacttacgatacagatagtcagaaacggtcagttcaagcaccgcgtcaccaagaaattcaagtcgctcgttatcttttaaacctaattctttgtgttcattaacatacgaggaatgcgtgaaggcttcatccaatagactgagatcgtgaaattcaatcccataacgctgacgcaattcactcacaaactctgaggcaaccatgaagagccctcctttttatcaccttctaattatacaagagcgcaccaaaaaagacacctgcgattgcagatgccttttagaggtaattgagtttcgactacttcttggcggtgctgttgctggtaacagctagcttggaccagttcaagtagttagccgaagcatagtcaacactcgcgttcttcacccgtttgttaaccgggaagatttctgcccggtacaatgttggaatagcaaatgcctcgtcattagcatatttctgccatgctttcaatgctttagcacggtatgtcggattcattgctttctgaccatcaatgtcattcaacaacttggtattctcagcagagacaaaccgtgtgtagttaaacggcgctttagctgagaacagatccattggtgaaggatcggacgaaagactccaagcggccgcataaacatcgacactcttatcatctttttgaatcttgtcgtagaaggagttgaattcgattggacgaccggtggttaacttaacacgcaaaccgatcttcttccactgctgaatgtagtcctgtgccaatggttgagccgttgagccaccagccatagtagcaaagttaatcgtcagcttcttgccattaggatcggttcgatagccgtctttgcccttcttataaccggccttatcaagcaaactattcgcttttttgatgttcaagtcatagccattgatatcggcatgcacatctttaccgaagacaggtgggatcaaagttgttgcacgcgtccgcgtaccattgtagaacttagacgccacttcatcattgttcagtgcataacccatggcctgacgaagactcttattggccatctttgcctttggattataaacgttttcgttcttgctatcgtcccacttacctaacttaaagccaaggtagttgtaagccaatgcttgatgaccaaggttcgtatacccggcgatgctcttccaatcattgtaagtatctgaaggcatgccataaaccacatcatatttatgattcttcaaagcagacgtaattgacgcactagaaacattttccatggtgatcttgtctaacttaggagcacccttccaataatacttattcggggtatattggacactttgaccggcaacaaccttgctaaccttgtaagggccaaagaacaaaggttgcttccgaactttatcgctggattctagtttatcaaaagcaatgtcatgcagatagtgatacggtgctgcattttcgaggaaatagccatttcctgaagtgccaaacgaaggcttcatttgcttgaagtgaataaccatcgtattaccattatcacccttcggcatcgtcaacccggaaatggaatcagccttaccatcatggtactcagtcaaaccttcaatgttctgaagagactcagtgtaccgttgactctttgtagctttgttcgccatgatttcataggcatacaccagatcacgcgcaacaaccggctgaccatcagaccacttaacgtttggcttaatggtaaccgtaatcgtcttagcgttgttatcctgcttcaaagtcgcggcacccttattattgaatttgaatttgctattgtaagcaaacagagattcagcagtagggttcatgtaataataatcatactgatcggtgtagagttcttcgttgaagacccccttaaacggtgaatcatcaaccaccgctacattgacattgccgcctttaactgcctttgcagtattgttgtaagaaatcgggaacttcacactcttattggaagtacttgagctggagttcgaactcttactgccacaagctaccaaggtgatggataaagcggtagcgagcgtgatcattccgagcacagaacgctttttcatactttttcccccttccgcgccgtcatcgcaatatgtaagcgaagcaacgcttcatgtgagttaaatgatagcataattagagcgaaatgaccaatgtttcgccacaaatttttctttttttcttcaaaaataaagaggcacccagttttgtctgagtgtctccttataaattttcaaatcaattttcagaaaaaacgtgactttaaccacgacgttgccgtgaatcggcagcacgccgtaatgcttggccaacaaagttaattgagagtgacagtgtcaacaagaccaaaactgcagggaaccatacccaccagcgattaaaaatcaaatctggatttgatgcatagccaattagcgtccctaaacttggggtctccattggcagcccaaaacctaagaaagatagtgcggtttcgatcccgatagagcttgcaattgtcagcgtcagatccgtaatgatcagtgaactaatattgggcaagaccccggtgaacataatcttaaagttagaggtccctgacgtctttgaagccatgacatactcactgcgcgcttccgacagcactaacgatctcatcagtcgtgtggtggtcatccagtagaaggccgccatgataagaatgatggagatcacgttatattgcggcacaatcgtaactaaaacgataatcacgagcaaagatgggatgatcatccaaaaatcaacgagtcgcataatcacggaatcaatccagccaccgaagtatccagaaattgttccaaggacaaccccgacaaactcaatgattagcgccaccgaaatcccgatagtaatcgagttgcgggcagcaaagaacaaatatttgaacatatcccggccgccttcatcagtcccgagaatatacccgttgacacccggtgacgtgtagcgatccatgatattaacctgcgttgcaccgccaacattgaacaacattgagccaataaacgcagcaaggataatcgcaaccgctaagaatagtgagaccacagcaaccttgtctttgcggaattcgttcagaatcaccttgaagttagaaggtgattgttcaatttttgtggtgttagccgccacttcatttgcattgttttgcataaactttccccaccttctactcgatccggatccgcggatccacgatactcatgatgatatctgacagtaagttaccaagcaacgtcaggaagccgaacaaaagcaccagcgagataaccaccggataatcacggctggtcatcgacgaaacaaagagctggcccatccctggataactgaagaccgtttccaggataaccgatccgccaagcaacatagtgatttggttacccatgaacgccgcaatcggcaataaggaattacgcaaaatatgtttattgaaaatgacgcgatccggcacacctttagaacgcgcggttcgaacaaagtcctggtgggtattatcaatgacccccgtacgtaaatactgaatcgtacttggtgtcgtaataatgcccgccactaacgccggtaggatcatatgatagatccggtcccaaacgtaaccaattgttcccggattatacgtcgacgacacactcccaccggttgggaaccactgtaagaagaagccgaagaaaatgagccctaacaagtagaaaacaaatggtggtacagccatcaaaatgaaggatgcaaccgaaattgcagaatctcgtttactgccttcataacggccggcaataacaccggctggaatggcgataacgtaaagaattactgttgacatcaatgccagccagaatgtatttacggcacgttcgccgatcagaccggttactgaccgtttgtaaacgaagctctggcccaaatcaccatggaacatgttaccaacccatttgacatactgaatataccacggatcattcaagccatactgttgacgtaaggccgccatctgtgctgcactttgcccttgctgaaaattaccggataacggatccccgggcatcattttcgacaggacgaaaaccaagacactcagcaaaatcaattgcgggatcatgattaagatccggcgtagaattgttttccacattaatcatgcactcccttcatcgttgaatctggcagcgcaacgtaatgtgtatcggaaatcttctggagatccaaaacgcggccttccttagaataatatttagattcttcttctttaaaaatgcgttcgacttcgcgccgatgttctttgttctcctcgcgatcatcggggttaacatcaggaatcgcggataaaagccgttgcgtgtaaatatgttgcggatgattataaatatcttcgcgcgttccgatttcaacgaagcggccacggtgcatgatcgccatctttttacacatgtgcttcacaacgcccaggtcatgtgagatgaacagataagaaatgttgtactcttcctgaatgcgtttcataaagttcagcacttgcgcttgaacggacaaatccagcgcggatacgggttcgtcggcgataatcaacttaggattcgtcgccatggctcgggcaaccccgattcgttgacgctggccgccggaaaattcatgcggatacttgtacaaagcatcactcggcatcccaacgatatccagtaattcctgaacacgatgacgctcctcgtctttggtcaggttctgaaaattacgaatcggctcagcaatgatatcttcaatgcgcttacggggattcaggctggatagcgaatcttggaaaatcatctgcacgtccttgttgtactgcatgtgcttgcgaacgctgcgcttggtgatgtcctgacccttgtacatgatcgaaccggacgtcaccggctccagtccaacaatcgctttgccggttgtcgatttgcctgaaccggactcgccaatcaggccatatgtttcgccttgctcaatgtcaaaatcaatcccatcgactgccagcacatgatccgtcacccgattaaagaagccggaacgaatgggataatgtatttttagatttctaacttcaatcattgccataattactcacctttttcagccgcttggtcgtcatccgggaaatagaagtctttgtagcacgtgcactgaacaaaatgatcaggtgcgacttcatgcatggtcggatgctcttcgtgagcagatgccggaatccatggaattcggggagcaaatcggcagccttccatctgcatattcttcaatgacggcaccacgccttggatgacgtgtaactcatcatcatcggagtcggcttgcggcatcgagcgcaacagactgcgggtatacgggtgggtcggatgcttgaagacatccatcaccgagccgctttcaacaatctgtcccgcatacatcaccgccacgcgatcagcggtttcggccacaacgccgaggtcatgggtaattaaaataatgccggaatgcatttcccgttgaatatcttccaacaaatccagaatttgtgcctgaatcgtgacatccaaagcggtagttggttcatcggcaatgataatcggtggtttgcaggcaatcgcaatcgcaatgacaatccgctgccgcatcccgccagatagttcatgcgggtaagaacgtgccgtccgttcgggattgggaatgccgacttgattcagcagttccagcacccgtttatcacgttcttctttgttcatcttggtatggtaaaccagcgtctcttcaatttgctcgccaatccgcatcaacggattcaacgcagctaacggatcctggaaaatcataccaatatccttaccacgaatccgatcaaacagggtttcatttaacccgaccagattcaggttgttatacaagatatcaccggtcacttttgtattacgcggatcatgaagcccgataatactggttgccaaagtactcttgccggagcctgattcacctacaatcgccagaatctcatcttttcgtaacgtgatgctgacatcatcgacagcatcataaaaagcatctccaagtctgaatccggtgtgcagatgttgcacatctagcagcaaatcttcaggtttatccaaacgaactcctcctttgcgtccttgacgcaagattaaaacaagatgagatttttgaaataattgtctctaagtataaagaaattatagtggttatgcaagccaaaaatgcgtcccaacgccattgacgcgcgaaatttacggataaatccatcaatgattcgtgcacaaggatggcgagctttaaagaaaatcgagcatcctcaacatgatgctgcaagctgatcatatcagaaaattcggtttgtttgaagaaaacgtcctttatcgtctgcgtgcggctcgtaaaaacgaaagtgagtcgcgctcaccataacgcgctccccggcgcaggagcctgcatgtaaggatcttggtcgcaatggcctaagaccgggccatcacgcccaagaccacttacactccggctcctaaccgcgccggctcgcgctcacaaataaaaaagccgccatcactggcagctcacgcattcactatttttgatgtgctttgatgtaatcaaccgcatcttgaactgtttggatcttttccgcatcgtcatctggaatttccgcgccgaatgcatcttcgagttccaaaacaaattcgacaatatcaatcgaatctgcatcaaggtcttgcttgaaattcaagcttggactgattttgtcaggacttaactgaaaatggtcctgaatcaagcctgcgatcttttgataaatttcgtcttcactcatgccgctcctccattcatctgccaatttagtttacttgtttccagcgtcgttgtctacggctttatcagtggttttcgcttcggcaatttcagggtgagcgtcaaaataatccaccactttggctaccgtgccatttttgaccattttggctgtctgcagcaaggtgtaataaaccgtgtcagcatcagccgcgccgtgagctttgaccagcggcgctttaagcccaagcaagaccgcgccaccgtatgaagaaatatcgaaggtttgtgccatcgacttgaggttgtttttcaaaaacagaccacctaatttgccggaaacaccgccatcgtaaatggcaccctttaacatgtgcataacagtgcggacagtgccttcaattgcctttaacgttgcgttgccggtaaagccgtcagtgacgaccacatcggcaggtccattgagaatatcactggactcgacgtttcccacgaagttaatcccaggagcagccgccaaaagatcatgcgcttcttgatgcaacttgtcgcctttgtttgcttctgtgccgttgttaagcaagcccacgcgtggattgtcaacgccgcgaacgtctttagcgtagtagctgcccatgatcgcgtattgcaacaaatgatacgggcgattttccgcattggcgccgacatctaacatcacaaagcccttaccgtcaacagtcggcaaggttggcaacaaacccggccgttcaatagccttgatccggccgataatgaataaacctgctgccaataacgccccggtggatcctagtgaaaccatcgcggccgcgtcgccttgtttaactgcttgcgccgccaacaccatcgaagcctgtttcttacgccgaatcgcccgaaccggttcatcgtcactgttaatcttctcggccgtgtgcacgatcgtcagccgatcctgattatgaatcaaaggtttgattttggcttcatccccataaaggataaattccaaatccgcgtcatggtcgcgtgccttttccgttccggcaatcacaacttccggagcgtggtcaccgcccattgcatcaattgcaattttcataaaatccttcgttcctttcgcatttaatccaaactgccgttcatctgccgactagcagccagataagcggctagcggttgatgctcaggttccagcaagtgcggatcagttttaaaaatccgggccacaatctgttgggcagcttccagagttggaaaatccccgacaggatcggccactttaaattccggcagtcctgactgcttatctccaaaaatatcacccgaaccgcgcatttccaaatctttttgggctaacaagaagccgtcattggttttggtcatgatttgcatgcgggcgatgccttgctcatttttagggtcagcaatcagcaaacactgtgctgccttattaccacgacccacgcggccgcgaagctggtgaagttgcgataggccgaagcgatcggcatcgaaaatggccatcaccgtcgcattggggacgtccaccccaacttcaaccaccgtcgtcgaaaccagcaccgcaatgtcaccctgactaaacgcccgcatgattcgatctttttcatccggcttcattttgccgtgcaacaacgcaacctgcccaagattgccaaccgctttttgcatatctgcaaaaagctgctcggcgttttgcaggtcgatcttttccgattccgcaatcagcggggtaatggcaaacacctggcttcctgcctgcacctgactgcgaatcagctgataaacctgaccgacttggttcttacgcagccatgtagtcgtgatcgccttgcgtcctgccggtagttcatcaatggtggagacgtccatttcaccgtatgccgtaatcgctagcgttctaggaatcggcgtcgcggtcatagacagtaaatcgggcttctggcctttttcctgaagaaccttgcgttggttgaccccaaagcgatgctgctcatcgataaccaccaaccccaaggctttaaaatcgacgcctttttgaatcagcgcatgggtaccgatgatcaaattaagtgtgcccattcgcaggtcggtcagcaattcacgccgcctctttgcggttgtcgatcccgtcaagagccccagcttaaccgggaaattaacgaacagtttctgcaacttggcaaaatgttgctccgccagcacttctgtcggcaccatcaaggcagcctgatagccggctgtgaccgccgcatacaagacaatcgctgcaacaatcgttttcccgctgcccacatcaccttgcaacaggcgattcatatgattgggccggcgcatgtccgcacagatctcattcacaacccgcttttgcgcattggtcaacgaaaacggcaacgtggcaatcaatgctcgcaacgcctgattgtcatacggaatggcaagaccgttgctgctgttggtattaagctgtttcagcgcttgtatttgcagttgaaacaggaaaaactcgcgaaaaacaccggttcggcgcgccgccttggcttcttgcggtgtgtcgggaaaatgcatcccatggaccagctgttcgtccgtcattaaccgataatgctcacgaatgctagcggggatcaggtcatgtatatgctgatgatcacgcgcccacgccgctttaatcaggtcgagtaatgtacccatgcgaatatttttattcacggtataaatcgccgccatggacggctgatcccgtgactgggtggccagaattttcatcccggtcaaactgcggcgctgggcatcccacttgccaaaaattgctgcttcgtcacccatctgaaagcgatcttttagccacggctgattgaagaaagtgaccagaatgacgctgcgttcgacctgcagcttgacattcacccggctgcgatgcggaccaaaacggctaataaccggatcggcaaccacgacgcctttgatcgtcagcttttcttgatcggttgcttcagcaaggtctttaactttaaggtcatcatagcgatatggaaaataaaacagaacatcaccgaccgtatgaatgcctaaactggccaagccttcttcacgcttaggaccaacaccgggtaaaacgctaaccgggtccgtgagcgccatcatcatccctcccttcgcaataagatggtaaacgacaaactgtgcttagcctttcatgtcgcaaaaaagtgccccgcatgcgggacaccttggcagtaaagcaacttgtttactcgactgagacaagataaggataaaccggctgatcgccttggtgaatttcaaattccagatccggatgcgctttgccgaccgcatccgcaattttcttcgcttcgccttgattagcatcggcgcccacaatgatcgtgacaatttcgctgtcgtcattgatcatcttgtttaccatggcaatcgctgcttgttggcgatcctgatcagtgacgctaatcgtgccgtcaatgatccccatccaatcgtgatttttgatagccagtccattaatggtggtatcgcgaattgcttgcgtaatagaaccgctaatcacattcggtagttgtgcggtcatttcgctttgattggtagccaaatcggcgtctggattatacccaagcatagcggtcatgccttgattgatggtcttacttttcacgacagctacttctacgtcagttgcggccttagcagcagcttctgccgccatgaaaatattgccgttatttggtaagacgatcacatgcttagcgtgagcggccttcaccgcatccaaaatgtcattggtgcttggattcatggtttgcccgccatttagcacgtaagtcacgcccaaactcttgaatagctcgccgagtccctcaccggcagcgatggcaacaacacccatctcagctagtggttggtcattggcatgagcatctagagagccttcccgttcaataatgctttcctgttgtaagcgcatgttatcgactttgattttcataagctcaccgaattgctggccgtaacgaaaaaccgtgccaggatgttcagtgtgaacgtggactttgaccacttcttcatctgcaaccaccaatgtcgagtcgccgagggtattcaaatagttacgaaacggttcataatcaaagtgcttgaaatgatcgccggtttcgagttcaaccatcatttcggtacaataaccataaacaatgtcggccggatccagttgggtttgggcactttggtggtggacagcattaatcatttcggtcatttcttcatccgtgacatcatgaacatccgaactgacttcgccggataagccttcacggaatccttcatagataaagaccagtccttgaccgccggaatcgacaacaccgacttctttcaaaacggccagcagatccggcgtcttggctaatgcacgtttagcacccttaacaacggccgtcataacgaccaaagcgtcatctgagccattagccgcttttaagccggccttagctgcttcgcgggcaacggtcaggatggtgccttcaaccggcttcatcaccgctttataagccgtctcgacaccatgagcaaacgcgtcagccaaatcctgagcagtcagactctttttaccttctacgctcttggcaaaacctcggaaaagttgagaactaatgacccccgaattaccgcgggcgcccatcaacaggcccttgcctaagtgcttggccagatcgccaacgcctgcatcattagattccaacactgccttggcaccggtttgaaacgtcagattcatattggttccagtatcgccatcaggcaccggaaaaacatttaatgaattcacaaaatcagcatttttattgatgcgatgtgcggctacccggatcatgtcctggaatttagtcgccgttatttcggttactgccacgaaacatcctcctcgaagaacttaatatcgttacaccgtcagctgacagtgccttaatgtcagtcgcctaataccttgacgccctggacgatgacggtcacttcgtcggttgtgacccccaacatcgtttcgaggttgtattttactttgtcttggacatttcggcaaacttcggatattttggtaccataactgacaatgatgttgacttcaatcttgacgccattgtcagtttggcgtaccacaacaccgcgcgcataattttcacgcttcaaaatgtcattgagattatcccgaatctggttacggcttgccatcccgacaatcccgtaaatcgatgtcgcggcaccaccaaccactgttgcaatgacattgttggaaatgtcgataatcccatacttggttttgattttgaccgccatgctgaatcctcctagccattcacgatgcgctttcacaccgtgtacaattctaccagttagtgtagcataggcacgaaagcattaaaagcgccaccgcttgtggattcctgcctaggccttctcactgacggatgctccgacttccgcgctgaagaagcaaaaagatcctgacaatgatggatgcatcacattcattgtcaggatctttttgtatttatgggatcaaacccgggtcagtttacctgatttaagggcacgtgcagaaacccatacccgctttggtttaccatcaacaaggatacgaaccttgtgcaggttggctttccatgtgcgccggcttgaattcaaagcgtgtgaacgcttattgccaaacgtggtatgacgacctgtaataacatctttagccacaatatgacctcctttttttcaaggtcaccctcgaatttttcactcaactaacttatcatagccccgcggcgaatgcaagaagttttgcaaagtaaaattacttgacagcctcgattggtcgcgacaatgattacacactgactgtcatttggtagctagttgtcgactttttgaccgatacgatcgcggctgtaaatgatcgcaacttggcctgctgtccaactgaccgtaaatggttcgtttccaatgaattcgtttgacgcccacgcgtaaggaaacgcaccgtcccacgctttcagaggatacttggcaccaatgatcgtcaaagccgtcacgggcgttaaattaataaccgccacgtagcgataacccggtaacggctgaatttcgtgttttcccggatcgtaataatcgacgcgattttgctcgtctagaagatgaatccgttcaatgtcatcaagaaaacgcggctgaagcggcaaaaacaggttggacaaaaaatgatccagtcggccgccagttgccccgaccagcgtcactttgtccgcggaaaagtccgttaaggccgccttcaccgccagttcggtatccgtatcgtcttttgccgacgggacttgctcaatcttttgaacacgctcccgaactaattgaaattcgctcgctgtcaatgagtcaaaatcgccgactgccaataccggcttaatacctgctttgaccaatcgtagggtgccccgatcaaccccgatccattcgccggctaattgttgccaattctctgagaggttctcgtgcggtccgccagccatgatattgacgtctgtcatttgaccgcctcacgtaacgacgtgatcgcgtcactgacgtttggtgcgccgaacacataggaacctgccacaaagatatcggtgccggctgctgcggccgccttcactgtctggtcgttaatcccgccatcaacttcgatcacaaaatgtaaatctcgttcctgccgaattttgtgcaatcgcgcaaccttatcaaccattggcgtcaggaacttctgcccaccaaatccgggattgaccgtcatcaccaaaacctgatcgacaaggggcaacacttcatccagactgctcaatgacgtcccgggattcaccaccaccccggcacgaacaccggcagcgcgaatatgttgcaagacaccataaagatgactggttgcttcttcgtgcaccaaaatcgtatcggcaccggccttggcaaactccggtgcccaaacacccggatcactcaccatcagatgcacttccaacggcagattcgtcaccggacgcaacgcctgaacaaccaatgggccaaacgtcaaattaccgacaaagtggccatccataacatccacatgcaacaaatccgcccctgctccctcgactttttcaacatcgcgagctaaatgagcaaaatcagcacttaaaattgatggggcaattttcataggaatccctccgtgagcgcgagccagcgcggtcagaagccggagtgtaagtggccttgggcgtgatggcctggacttaggccattgcgaccaaggtccttacacgcaggcttctgcgctagcgagcgcgttaatgtgagcgtgaaccggcgcgcttaggagtcggagtgtaagtggccttgggcgtgatggcccgagcttaggccattgcggccaaggtccttacacgcagactcctgcgccggtgaacgcgttaatgtgagcgcaaaccagcgcttccaaaccagtccacgcatgatcgattactttttcttataaaccgggcgcttgccgcttaattcttcgcggaactgcaaataattttcatagcgactcgccatgatcttgccagcggccaaagctgccttgactgcacagtggggctcgctaacgtgttgacacccgcgaaacttacagttaggtgccaaagcaacaaattcagggaatcggtcgcgtaaatcatctaaggtcacatctagcaggccaagcgatgaaaaccctggggtgtcagccactaacccgccatgaatcggatacaaatccgttgtccgcgtcgtatgccgcccacgattcaatgcacgactgatagacgcagtcgccaaatccagtcccggcaccaagtggttgatcaaagtcgatttccctgatcctgtttggccagtaaaaatcgtcaatttatccgcaaaactagcgtgaacctgtttcaaaaccgcttgatcaaaaacatgctccggcgcaaaaacagcgtagccgatcgcttggtagcctgtcaatgatgttcgaatcttttccagtaatttggcaggggccaaatcggttttggtcaaataaatttcagcgtgaatcgcatggccttcgagataaaccagaaagcgatccaataaattcaaggaaaagtctggttcaacggcagaggtaatcagcaaggcctgatccacgttggcgactggcggacgtgccaacgcattttggcgtggcaggatccgtaaaagataaccttcatcatccccatgaccgggttgaaaggccgcaaagtcgccaaccagcggcgtgatgttgtcattgcgcagactaccacggcctcgggtgcgataaactgtctcaccgaccgcaatatcatagtacccactaatttgtttaatgattcttccggttaattcatcactcattgggtaatatttgcctcctgcgcaatcactgtgccatctcgcacaacgcggtagctgccgggatacttcttgctaacctgcaacgtaatcgtgacctggtcatctgccgtgatattgaatgttttattgatgtcactgatattgtgtgtcttatcaccaataaagacctgaatgccatttggtgtcacgccactgctgcttgcgctggcactcgcgctaccggaagcagcagatggtgcctggtacggaatcgaaatagtttttgaaacggttttgacttcatcagggtctgcaccttgggaaatggtgacattcacggtggctccggattgaacctgtgtccctgcagccgggttctgactaatcaccatgccagtatcgaccgtatcggaataactttgactgatcacaatctttaagccgacttcattagcgtagtcgcgtaaactcttttccgtgtatccggtaaggtcacgcaacgcaaacgacgtgttgaccttcttgactttaaccggctcggcaacttcaaacgtgatggttgtcttgctggcaatcacttttttcccggctttgatactttggcttaaaatcttacccgcagaagcttcatttgttttaattagtttctccttcacggtcacgccgcgtttttgcaagtcagacttggcatcgctataatcctgcccgacataattatccagcgtgattcgcggttgtccccgacttaaaatcaggttgacgctcgacgactctttcacgctgacttgccgtttcggatcagaatcgatgactaaatccttatccaccttggttgagtaagcatagcgatactttccgaccttcaaccgcgcactttttagcgctgtcttggcctgagcagttgtcatgccgcgtaagtcaggtacggttacgtctgccttttgattggctgttacaacgccaatcccgatcagcagcaaaagaaccacgactgcactgatggcaacaataagccagcggcggcgcttctgtttaggccggttctcaggcgcagattgatcggcgggctgatccgctccgccatcagaattgtgcggcggagttgggccattaggaacgatcggcacaactcgcgtttcatccaaatcgtccttaggaatcacgtacttggcttcatgggctcgggcaggactcaaggcagtgttcaaatcgcttgccatggcctcggcactggtataccgattggcaggattcttggcagtcgctttgaagacaacattctcgagggcttgcggaatatgaggatcaaacgctcgaactgaaggaacctcttcctgaaaatgcttcaacgcaattgagaccgctgaatcaccttcaaacggaaccgagcccgtcaacatttcaaaaagaatgatcccgagcgcataaatgtcgctttgtcgcgtgggcatactcccccgagcctgctcaggggaaagataatgaaccgatcccaataacgaattggtcatcgtcatggaattttccgatagcgcgacagcaatcccgaaatcagtaattttggcatgcccgtttgcatcaatcaaaatattctgcggttttaaatcgcggtgaataatattgtgatcatgagccgtttgaaccgcagacagaatttcttccatcatatcgacaacgcgctgatacggaatcggaaaatgctcaacgatataatgctttaaatcagagcctttaacatactccatgaccagaaactgctgaccatggctttcacccacatcataaatcgacacgatattagggtgcaccaattcgctggtcgccatggcctcacgttggaatcgccgaaccgtgtcgggatcgttttgtagatcaagtcgcaaaaccttgaccgcaacgtcacgatcgaggataagatcgtgcgctaaatagacgttggccatgccgccttcgcctaatgttttgatgagcttatagtgttcatttaaaatcgtccccggctcgatcatgacggttccctccgatcctgatgaatgatcaaggcgctaatattatccggtccgccagccgcattagcttgaagaatcaattcctgggccttgctgccaatcggcatatcctcgcgtaaaaccgccgcaatgctttcgttgtcaaccatattggttaggccgtctgaacaaagcagcaggtaatcatcatactccatgtcataaatcgtcacgtcagcgtcaacatcgctgctgacccctaaagaacggctgatcacattccgttgcgggaagcgtttggcctcttcaggggtcaattcgccatatttcaccaattcgttgaccaggctatgatcttcagtaatctgaatcagatggccgttacgataaaggtacccacgcgagtcaccgatattggccacgacaaaccgcgtgccactgataatgaccgccaccactgttgtccccataccggaaagatcggtatattgtttggctttttgtaaaatcatgtcattttcttgctgcaactcaaaaataagccaacgcacgattgactcgatttcagccgtatcggtcttttcaaacgcgtagccgagatgcgataccgccatttcactggcaacatcaccgccgcggtggccgcccatcccatcagccaccaaagcaagcgttgcttcagattggttcttgaaaataccgacataatcttgattatttggtcgccgccgaccgatgtccgtgcgataagcaaactccatacatacccctcatttacggcgaatcatactggcaatgaaaaagccgtcggtatcataatcgtctggaaatagttgcagtgccggtgccccatgcgccttggttaatggcttgagcgtcaaaaccggcacctgttcaaattcaggatgagcagccaaaaattgcgcgacaacatcctgattttcctctttcaccattgtacatgtactatacgtcaggcggccaccgatttttaatgtgggcgccacgctattaagaatcgccaactgaatctgttgtaaatggcgcggatcatcagcctgtttggtgtacttgatttccggtttacggcgaatcagtcccaatccggagcaaggcgcatcaactaaaatcttgtcaaacgattcaggtgcaaaagtggcatcaacttgacgggcatccaacatttgggcagaaacccgatcggctaatcccaaacgattggcattttgttgaactagccgaatcttgttggcatggaggtccaatgccgtaacacgtcctccttgatcaggatcaagatactgggcaatgtgggtcgttttgccaccaggagccgcacatgcatccaacactgcatcacctggctgaatatccagactcggcgccaccaacatcgaactttcatcctgcatggtgtaatcccctgcagcaaattccggcatgcccgccaaatgtccgccgggagcaatcaagccgatcggcgtcagcgggctttcccgtagttcaggaaagctcggctgtaagattttcagcaaagcatccggcgttattttggtggtattgacgcgaattgacgcatgcgcaggctgattgatggccgccagtacgctggctgttttggcgacacccaactgttcctggagcttcttaaccagccaaagcggcgtgctgctggtgatagcaagtcgctcgatgggatcgctaatgcttgcaggatccgggaaaccggtacgctgtgcttgccgcagcaccccggtcacaaacttggcaatgccttgatggcccagttgtttggcgatttcggtgctgtcaaaaaagactgcccgcgccggcactttatctaaatactgtagttgatagaccgcagtttgcagcaaacaccgaacccaaggatccagttggcgatttttgacgaacgggtgcaacagataatctaaggtcaattgatgctgaatcaccccatatacaatgttggtcagcaaaccagcatcccgactgtcaagccgatacttagtgatgatgtggtcaagggtcagattggaataaccacctttgcccacaacgcgggttaacgtctggactgccagcaatcgcggattatttggcttcatcggtgatcacctgctgtccgactgtcaaatcacggccaggaccgttcaaataatcggcgatatgttgcttgcctttaccggctggctgcaattcgtcaatttgaaaagtggtctgatctccagccgccaccaccaattgatgcttgctgcgttccacgacactgccagcaggcaagtccgttttttcggacaatggcgttactgcccacagtttcgcgcgctggccattcatgtagacatagccgcccacatcaggccgaagcgcacgcacccactgatccaaggcttgcgccggtaagtgaatgttgagatgttcctgttctttggtaatcgttggcgcaaacgtcactttttcaggatcctgcggggtgcgggttgctgtgttgtcaataatcttcggcaatgttgccaacagtaaatcgcggcctagcaacgacagctttgtaaaaacggtgccagtatcatcttggcgggttagcggtaacttagcttgggcaaacatgtcaccggcatccattttcttcaccatttcaataatcgtcacgccagtttcggcatcaccgttgataatgctatattgaatcggcgcgccgccgcgatattttggcagcaaagagccatggacattgactgccgcaatttgagccgcctgcaaaaacttggtcggcaaaaattgcccataagctgccgtcacgattaaatcaggcgccaaagcaatggccttagctaattcgggactgccgctaagtttttccggttgcaataccgggatgtcatgggcgacggcagcctgcttaaccggactggcggccaccttctgcttacggccgacttttcgatccggctgggtcatgaccgccacaacattatagttttggtcaatcagaccttctagaatgggtaccgcaaaatcgggggtgcctaagaaaattactgaagtcatattttcctccaaaccttaagttcgttaacaaaatactaacgaatcggttgttgttttttttacacaaatgaaagtggttcgggatcaatcgtcacctgaaagccttgacgactgctttgttgggtttcttcaagaatgtgttgcaatgtttcagccaacgtcggctcatgcttgtattttaaaacgatctgataaatatagcgatttttcaaacgggcaatcggtccgggcgtcggaccaagcatgatcacttgatcggataatcgatcgcgtagctcctttgccagcgaaaaaatggctttagcagcttgggtttcatcgacatgactgacaccgatcttagtcgaaaagaagtacggcggataattgccttgatgacgaaccgccatttcctgccgaaagaagccttcataatcctgacgtttggcatactgaatggcgtaatgatccgggttaaaggtctggacaaatacttcgccaggcttatcagcgcgcccggcacggccactgacctgcgtcaacaactgaaacgtcttctcacttgctcgaaaatccggcaagcctagcgccgtgtcggcattaatcacgccaaccagtgtcacgtcagggaaatccaatcctttggcaatcatttgggtgcctaacaaaatatctgcctggtgggccccaaaagcattcaagatccgcgcatgaccacctttgcgtcgtgtggtatcgacatccatacgcaaaatccgggcatctggcagcaacttttgcaattgtgcttccactttttgcgtaccggtgccgaaataacggattttatccgaaccacattgcgggcagcggcgcggaatggcttcttcgtggccgcaataatgacacttcaacgtgtgcgtatccatgtgtaacgtgaggctgatgtcgcagttaggacactttgcaacataaccgcaatcccgacacataacaaaactcgaataaccacggcgattcagcagcaacacactttgctcatgacgctgcagccgtaacttcaaagcgtccaacagcggcgcggaaaagtcttcttgcccaccttgcgcaaagctttcacgcatatccacaatgtgaaccggtggtaacggttgatcattgattcgatgcggcaaccgtaacagtgtatagacgccttttgccgctcgggcacgtgattccagtgaaggcgttgcggagcctaaaacgaccggtgcatgatgaatctgcgcccgttttaacaagacgtcacgtgcatggtaacgtggcgaggagtcttgcttataactggtttcgtgttcctcatccatgatgaagacgccaatatgcttcaacggcgcaaaagcagcagagcgggcgccgacgaccacttgggcttcgccgcgggcaattcgccgccattcgtcgtacttttcaccatctgacaagcctgagtgcatcaccgccacgtgcatgccaaaccgacctttgacgcgatccaccatctgtggcgtgagcgcaatttcgggaaccagcatcaaggctgtctgcccagccgctagcacttgggcaatcacctgaagatagacttcagttttaccggaaccggtgacgccttccaacaagaacgtctcaggttccttagctttaacggccgcgttaatggttttgaccactgcctgctgctcgtctgtgagcggcagtggttgcgtcaacggttgatgctggagttgtggatatggatctcggtaggtttcatgcgcttctagttttagccagccttttgccgctgcctgattaataaccgattttgtcaggtgatggcgatgctccacttccgttaacaaggggcgctgatgttccgccgaccaggttttgatgaaggaaagcagttccagctgtttgacggcgtttttgcgtacctgatttttttgctcctcagcctgctcaggtgacaactgcggcacaagataaaagaccttcttgacccgcgctcgatcttttttgatgtaagaaatcgccactttgccggcctgggccaacttcatcagcgcaatctgttgctcgtcacttaacgtattcatggcgacgctatccgcttgaccgaagtaccgcgtgcgctcatcagcagacaaccccagtggttcggctaccttgacggcatcgatcttcagcatcgctggcagcatcgtctgcatgcaggcaatccaaaatgaataggtggtttctgccagccatttggacaatcctagcatttcgtgattaagcaccggtgccggatcgagtacatccaggagtggcttaagttcgccatcatattgactttgattggcaatggccacaaccatgccgctgactttgcgatcgcctttgccaaattgcacccaaacccgcatgcctgcttgaagtgcaccatccaaacgttgtggcaccaggtaatcaaacggccgatcagtttgcatggtcggaacatccacaatcactttggcaatcgttgccaagcgctcaccccttttgtttcggtaacatcgttgctaactgtttgatcagtgcgacggccacttgttgcttggacatctccggtaatgtcactggcggttggtttggccgcaataaagtcacagcatccgtatcggcattgaacccgtgcgttgcatcaaccgcattggcaacgatcatatctgcttttttcttcgttagtttgacttgagcattggccaataagtcattggtttcggcggcaaatccaatcactaactgatgggttttcttttggcctaacgtcgccagaatatccggattctgaactaaggtcaatgttaagccgctattggcgtcaacctttttcaatttatggtcactaatggtcggtgcccggtaatccgccaccgctgccgccatcaccacagcatcggcctcttcaaactcaatcataatggcatcagccatcgactgagcgcttgtcaccggtttaaccgtcacgccaggaacaactggcaattgcttcgttgtgaccagcgtgactgtagccccggcaccagccgctgcattggcaatagcggtacccattttgccagatgaatcattggttaaaaaacgtaccggatccaatcgctccttggtgcccccggctgacacgataatatgccggccttttagcagcggttcatcaaggctttcgatgtaaagggcaatctggtctggctctggcattctgccaacgccgacatagccttctgctaactgaccggttgccggtggcagtaaaagatatccttgctgtgcggttagcttggttatattgtgttgtgtttgcggattttgccacatttgatcattcatagccggcaccatgagcttgggtgcggccattgctaacaaggttgtcgtcacaacgttatcggccatgcctgccgccagttttgccagggtattcgccgtggctggcacaataacgcctaagtcggcccaacgagccaaagctacgtgggcaacatgttcgggatggtcaaattcatgtccatccgtcaaaacggcgtgcttgctaacaatcgcaagcgtttccggcgtgacaaacttttcagcacttgttgtcattgcaacgcgcacatcatggcctgcttttactaacgcccggaccagcaacggcgttttgtaagcagcaatgccgccagtgacaaacagggctatctgttgcttcttcatgaggcaccccttttacttctgtattcttaggttcattatagcaaacagtgagcggcatgcttgcatggttgcgagaaccgagcgtcagagtctggattaccgatttccaaacgctcctgctcgcgctcaacaaaaagaggcagtggacttttttgcagtgtccctgcctccttttcctattggcgcaaacccaaatggatgaacatcatgggtgcttatgcttgttccttgtgatccagcttttcagcatcgcgttcaagtaacttggactttggatcgatgaccacgtcacccgcggcaatttcttcaagtgctttgccgacactcttgtcagatttataatcagacaacattttcagatccccagattcgagttcatgagcgcgttttgcggccaagaccgctagcgaatagcgtgaaggtactttttccagtaacttgtcaatagaaggataaataatcataatgaagctcctttttgtcataatagctgctctgccgcggcgagcagtcagcctgtccttatctggctaagtcggcacttgccaacatgcctttgtaacgatcaatcacgcgtggcacccgtaaatgttcgctttcaatgatgcgttcaatccgttttacagccaaatcaaccttgtcattgaccacggcataatcgtagttctccatcatcgtgatttccgaagctgccttgcgaatgcgtttatcaatcgtttcatcgtcatcggtaccacggccttttagccgatggcgcaactcacctaagtctggtggcgtcaagaaaataaaaacgccattgggacattttttgcgcacttgcatagcaccattgacttcgatttcaagtaacacatcacgcccggaatcaagcgtctcattcacatatttcagcggcgtaccatagtagttatccacgtacttcgcatattccagcataccacctgtcgcaatttcgtgctcaaactgcgccttggttctgaaataataatcaaccccgtcaacctcaccgggccgcatttggcgtgtcgtcattgaaattgaatattgaaaatcccgatagttaccattcagcatggcctgccgaactgttcctttgccaacgccactagggccagacaaaacaatcagcatcccccgttcgtgcatgtgtgaacctctttcgttaagtattaccaaacattttgcactttttcgacgctgatttcaactgcttcattgatgtggtaacaaaaacgtcatgcggggtaacgcttttttggcatcctgacgacccaattccaacatggcagcgatggcacttggccgaaaatcaaagagctgcggcaaccggcgactgggttttagatagcaatcgccgtgatcatgaccgatgcggccaatgccttcaccactaatcgccacgacaaaatcagcaccgatatctctggcaagatcaaccggtaaatcattgaccacgccaccatccacaaaattaacgccttgtcgtttgatcggcgtgaacacacccggcatcgcacttgatgctaataaccattctctggcatccacggcatcaagcacgtctaacctagtgacatgagctttaaaatccggcagcgaggttgtcacaaccagcaccgctcgatcatcgcgtttcggcatcttcagcatttgatcaagcagtggaacaaaattccgccgtgcaaacaccggtccggtcattttgcgtgccgtaaaatattgccaccagcgggctaattggaatggcgtcatgcgggctgttgccgccgcgttaatggctccgattgaagaaccgatcacaaaagtcggtgccagttgcggacccaaaacagtccacacacctgcctgatatgcgccatgcgccgcgccaccaccgaaaacaactgcaagggtcaaactaacgcacctccgtttgcacatcaccttgtaactgaagcgatcgtaagttaaaaaagtagttgcaagtttgaacacatgttcgtataatgaagttacaaacaaatgttcggaggcttgatcatggaaaataaatcatcagcactgcaaagcgtcacccagcatcttgtggcttcttatcgcgaaatattcgatctggcagcgcccactgctcgcatgccaatgcatcaggtggatcttttcattgatcaggccatgcagcgtcactataaagtggcactcttctttaatcacgaatcgtcaccttttgttggtcacattattcggacgctcggcaacaaccgctttctagtcaaagcataccacagcaacgttttccgcgtcatgaccagcacaagtgtcaactttatcaagcgctttgattaacaggccctttccaattccaatcatgttgaacattaaagctgtgcattagaaaccatcgctacgtttctaagtcgcatcattaggctaacatcacatgtttgccgcactgaagccggtgatacatttaaattaaaatcgcccgcaaagacaaaaattatgtcttgcgagcgattttttgctattcagttccgtaaatgtacatcacttaatggataagcctggacgccaaatgaggtcatgtccgaccgtgtttgaactcatcggccattttcaacaactcttcggcgtgttcgaccgttagtttggtgatcttttcaccagccagcatacgggcaatttcatcaacccgtgctttagccgttagtttgttaacttgcgtggtagttcgcccgtcatggacgtttttactgatcacatactcgtgatccgccatggcagcgacctgtggcagatgcgtaatgcaaagaacctgcgaagatttggcaatgaggctgattttattggcaattgcctgggcaactcgaccggataccccagtgtcaacttcatcaaagataatggctgtcacaccttcggatcgggcaaaaatcgttttcattgccagcatcaagcgcgacagttcgccacctgaggcaattttagccagcggttttgcttcttcacctgggtttgtctggatatagaaaaccgcttcgtccaaaccatctggccgaaaatctttggccttcgtgaaatgaaccgagaagactgttttatccatgtatagcgatgctagctgttcatgaatcgctttggtcagttgtttggccgccgcatgccgccgcttggacaaggctgaccccagtttttgcaactgcgcgcgggattctttcaaagtactgtctagatcttcaaccgaggtttcggcctgctccatctgacttaattctgcggccgcacgcttaccataggcaatgacttcatcaagcgtttcaccgtatttacgtttgagttgattaaataaatcaaggcgcttttcaacttcatcaagccgaccctcatcaaactcctgatcatcaagctcgttagataaatcattttggacatcctgcaaactgtaataggcactttgcagattatcggcgatggccgcaaaatcaggatccaaatccgcaatactttgcatactcgacatggcttggccgatttggtcaagcgcattaacctcttcgtcgcttagcaatgcataactttcctgtaacgctgaattaattttttgaaaattggcgaggcgttcccgctcggtacttaaatccgtatcttcatgcggatgcagatctgcactttgaatttcattaacctggaatttcagcatgtccagccgttgtgcccattcctgttcgttcgcctgtttttgcttgacggcctgtaaagtgtgttgataattgtgataaacctcggcatactgttgccggattttcagcaaatcatcaccagcaaaggcatccaacaaacctaagtgcgtttcggaatgcattaactgctgatgttcgttttgaccatgaatgtcgaccagcgtctcgccgatagcttttaacgttgcagtattcactaaatgtccattgacgcggcaaacattacgcccactgcggaataattcccgctgtaataagaccgtgtctttttgatccggatccatgaccccgtatgcctgcaatttggcttcagtagccggattagcttgcgcatcaaacaagccctctaagctggctttggcggtgccggtccgaatgaagtccactgatccgcgcccaccggctagcagaccgactgcatcaataatgattgacttcccggcaccggtttctcctgtgagcgccgtcatccccggctgaaagctcagtgccaggttgtcaatgatggcaaaatcatgaattgctaactcttgtaacattgcttcaccccaccattgcctcaagttcagacaatactgctgacgcatattgcgccgaccgacaaataatcagaatcgatgcatcaccactaatcgttgcaaaaatccgttgatcatctaactgctcaattaacgtttcaactgctgccgccgtccccggtaacaaggctaaatggacaaagttatccatggcttcgccccacttcatcgccgttacaagcgtccgcttcaatttgtcagttgccggaagctgcttttcaactggcatactgtagcgatagtggccttcccctgctggcactttaatcaactgcatttctttgatgtcgcgtgaaatagttgcttgggttaccggaatgttcaggtcgttaagacgcgccaccaagtcttcttgccgctcaatgggctcatcccgaattaaccgctgaatggttgcttgtcgttcacgcttgcgcatatgctcacctctatcaaaaatgggcatcccagtggctcagaatgctttagctctagcatagcgcatgcatcgcggggttgccacggttttgcataaatatacattaaggacgttttaattcggcataagcagccttcaatgttgcctcaatgtctacagttggcgcgactttacccgggatttgttcggcattttgtaaatgaattaaaaattcaatattgccttctccgcctttaatcggactatagtctaaacccaagacgttgtaaccagtcgcactggcaaaatcgacaatcatttttaaaacatcgcgatggacctggggatcacggacaatgccgtgcttgccaacatgagctggacctgcttcaaactgcggcttaattaacgcaaccgcatggccatcaggaatcagaatcgcttttagtggcggtaaaatcaatttcaatgaaataaagctaacatctgtcattgcaaattcaaccgggccgtcagtaaaatcttccggtttgctgtagcgaaaattcacgcgttccatcaccttgactcgcggatcttcgcgcaatttccacgctaactgattatagccaacatccaaggcatagctcatcttggcacctttttgtaatgcaacgtcagtgaagccgcctgttgacgcaccgatgtccaaaaccgttttgccggttaaatcaaggtgaaacgatttcaaggcttttgccagtttaagcccgccgcgactgacatacggcatttttttacctttcacgtgcaaaatcgcatcgcctgggatcttgacgcctggcttatctaagcgttggttgttctgatcatagacctcaccagccatgaccgagcgttttgcttgttcacgggattcaaaaagtccctgctcaaccagcaagacgtcaacccgttcttttttgactttttccattatttcaacaccgccaaaatcgattgtagcgccgcagcatcaacagttaagctctttaacgctgcatcagcctgctgaatctgcgctgccaacgcctgctcggcaccttttagtccaagtagctcggggaaggtgtttttatgctcggcaacgtccttatccgctgttttgcctaactcggcagttgttttggtgacatcgttaatatcatccttgatctgaaaaccgagaccaaaagcagccgcaaaatctgccaaggccgcctgatcagcttcggggatcgttacgaatacggtgcccatcgccacagcggcttgaatcaaggcaccggttttggcttgatgcatgtgcttcagcgtcgccaaatcatactggactcgctcgccatccatatcgaggacctggccttcaaccatccccgaactaccagctgcctcggcaagtatctgaatcagcgcagcgcgtttatccggataatgttgacttaataaggcaaaggcatcggttaaaagtgcgtcaccggctaagatcgccaacgcctcaccaaactgcttgtgattcgtcggtttgccgcggcgcagatcatcattatccatggcaggcaaatcgtcatgaatcaatgaataagtatgcacaaattcaagcgaggcggcagcaggcagtgcctcagcaaccacaccatcatacatagcaaccacgctcaataacagtagcggacgtaatcgcttaccacctgcgtcgacggaataagccattgcggcgcgtaaatgcgggttaggtacctgtgctagtgtttcatctaatgtatgttcaacggctgtccgccattgacttaagatcggattcattgttggccttctttaggttgaaaaggttgggtggtgccatcgtcactcaccatttctgtcaccgtcttttcggctgacttcaatgttttttcgagttcctgactcaatttcacgccagctttaaattgatccaaagctttttcaagtggtacatcgccttgctccagttgattgacaattgcttcaagttgggcaagtttttcttcaaacgtaggttcagccatgattcttctcctttgttgtcacatgagcgccaatttgaccatccgcaacatgaatgtgaatgtcggcaccgaccgcatagtcatctgtctttttgagcatctgcccggtgtcatccgttacataggcaaatcctcggcccagtatcttcaatgggctcaaatggtccagtccaagcgccgcattggccaccgcttgacgcttagcctttacaacactgatgactgcccgatctagacggtgttgatcatcgagcagttgccgtttgaggttcacgacttttatcagtaattgccgcccatcaagttgctgcgtcgccatggccagacgatggtcattttcgtgcaattgattgaccatgctttgattaagccgctgccgcaattgatcgacgcgttgcacgtactggtcgtacaaacgatcaggctgggttaagacgacgctttctgcagagcgctgcagtcggctggcagcatttttgaggcggttgtgcatcgcattgaccagacgcacacgatcttccgagatgcgattaagtgcgtcgaccagcgtcacgggcgttacaatttccgcagcagccgttggcgtcgccgcccgccgatcggcaatgaagtccgtaatggtcgtatcggtttcatggccgaccgaactcacaatcggaatcggcatgtcgactaaagcccgcgccactttctcttcgttaaacggccacaggtcttcaatcgaaccgccgccgcggccgataatgacggcatcaaagtcagacatggccttaatgcggttcaactgtttgacaatcgaatccgccgcctgatccccttggacaaccgccggaaaaagagtcagctgtagaatcggataacggcgcgccacagttgtcatgatatcctgaatcaccgcaccgctgggactggtcacaaccgccacgcgtttaggaaacaacggcaacggacgtttattgcgatcaaataacccttcgctagccagctttttctttaactgctcaaaggcttggtagagtgcgccaacgccgtccggttccaaccgttccacaatcagccggtattcaccacttggttcatacagactaacgcggccaactgccagaaccttcatgccttcttcaagattgaattgcaacttgctaaaagcattgcggaacatcaacgcaccgatcttagcgtgatcatccttgagggaaaaatattgattgcctacccgtttgcgataattagaaatttcaccggttaaataaaccttggccagataaggatcggcatcgaatttacgttttaaatattgagttagtgcggtgacacttaagtactggtcggtatcaaccatgcaatcgcctcttcgccagttcaactgtttgggccatgagtgaggcaattgtcatcggaccaacgccacccggtaccggtgttaaagcaccggcaacaggctcaaccgcatcagcatcgacatcgccgtgcagtttcccatcagctccgcgcgaaataccgacatcaataaccgttgccccgggtttaaccgcatcggcgccaataaaatgcggcacgccaatcgcaacaaccaaaatatccgcttcacgggtcagcgctttaaggtcacgggttttactgtgggcaatggtcaccgtcgcatcgtgattcaccatcagaccagcgagcggccggcccacaatgttcgagcggccaacaatgaccacccgcttaccggtgacatcaatctgataagcatctaacagcgccataatgccataaggggtcgaagccacaacagtcggttcattggtccacaagcggcccacactcaccgggctaaagccatccacgtctttatcgggatcgatcgcattaatcacgacccgttcatccagttgcttgggcaatggcagctggaccagaatgccatccacatcgggatcctgattcaattcagctacctttgccaataaggtttcctgagaggtttcttctggcaacttaaacattagggaacgaaccccgatttcctccgcgcgccgttgtttgttacgcacataaacctggctggccggatccgatcccactaaaatgactgcaagtgttggcgtcacaccttgttgcgccaaaccagtcactgtctgttgaagttcactaagaatgcgttttgaaactaccttgccatccaatcgcgttgccacaaaaaccactccccatttgattagcattgtctgatataacaaccaatgttcggttcctcgatcgcgtcaagtaccggtataaagcaaaaaccggccaaagtaattgtctttgaccggttaacttacgctttcggcgatgcttcaataaaattagccaaaatgccattgacaaacttagcagattggtcatcgctgtaacgtttggccaaattgatggcttcattaattgccgcagcttccggcatcgcttcttcatagcgaatttcatacaagcccaagcgcagaatcattaaatccggtttggtcaaacgactcagcgtccacccctttttaagctgaggggttaaggcagcatccaacgcctcctgatgcgtcaagacgccttccaccaattcacttaaataaggcggcacttcagtatctttaggtaaaacttctgcgtatacggcgcttttatctgcttccggattcgttgccaacgcaaaaagcgctcgaaaggcagcttcacggatcgcgtgtcgtgattccatgttaatcgtcatccttgctgctcgttgtcgatggttcatcagtgtcgtcatctttaaacagatcatccggattgactttttccgtcttttcagggatgacgccaacgacatgcacattcacttcgcttaacgtcaaatccgtcataaagagtaactgttcacgtagctgttcttgcatggccaaagccactttcggaacggagacaccgtaatccagatagacgtagacatcagccgtaatcttatcatcggcaactgtcacactaacgcctttaccgtggttggcacggccaaaccaggcgttaattgaagagcctaatgtaccgcgcatttgatagacaccgtctacctgactcgcagcaatgcccaaaatgacttccaaaacttcaggaacaatttcaatggtcccttgagcatccgtccgatttgctaatataatattggtttcttcagccatcgcgagaaccctcctaaaccttaattattggcacgtgaaatgtaagtaccatcatccgtgttaatcgtcagtacatcgccagtgttgatgaaaaacggcacctgaacgactaggccggtctccatagtggctggtttcgaaccgccgctgctggtattgccacgaatgcccggttcggtttcctttaccgtcaagtcaactgttttcggcaactcaatacccagggtttcattgccgtgcatgataattttaacattcatgttttcttttaaataattcaactggtcgcgaatctcatcgccgggaagcgtcagttgatcgtaagtatcggtgtccatgaagacgtaattatcgccatcggcataaaggtactgcatgtttttactgtcgatctgcgctttttcaaccttttcagttgatcggaacgttttttcctgtaccgcacccgtgcgcaggttcttcaaggttgaacgaacaaatgccgaacccttgcctggcttaacgtgttgaaactcaacgattcgccacaggtcaccgtcgacctcaatcgtcaaaccattcttaaaatcattaacagatatcatgaacttcctccatacattcagttgtaagctaaatctattctagcaagcggtgaagatgcttgcaacagccatgccacgtggatggcttcacagtaccagtaactcagctggcgccggttgactaagactctgattaccgtctgctgtcacgaccaaatcgtcttcgattcggacaccgccaagatccggaacatagatgccgggttcatcggtcacgacattgccttttgcggctggtacatcgagataaggaccccaggcgccagggccttcatgaatcgacaagccaatgccatgtccggtaccatggccaaaatattgaccatagccagcgtcattaattgcgttatgcgccaaatcattaatcgttcgtcccatcacaccaggcttcaaagcttgctggactttctgattcgtcgcataaacaatttggtaaatcgtcttaagcttggcatctggctcaccgactgcaaacgtccgcgtcaaatcggacatgtagccgtgatagatgcatccccaatcgagggtcacaatatcccccttggcaatcttcttttccgttgctgcgccatgcggcattgccgaacgcgtgccggaagccacaattgtttcaaacgagacattgctggcaccaagttgccgcatgaaaaagtccaagtcattggcaatgtcaatttcccgcatccctggtttaatcgtatcaagaacatgctggtaacctttttcggcaatggcaaccgcctttttgatcaaggccagttcctcatcgtctttgacttcgcgctgtgtttcaacaaagtcacgtgttggcaccagtgttccctgcgttaaaagatcaaaggcttcgtaatcggcataattcagatgaacggcttcaaaaccaatgcgggtcaactgcaattgattggctaaatcacctgccgtcttatacaaaccatcttgatgcaaaaccagtttggcattatgtacctgttgcttaaactgctcggtaaaccgggaatccgttataaagtaagctttctccggcgtcaccagcaaggcactttcttcaccggtaaaacctgtcaaataagtgacgttggtggcatcggtaacaaaaaagccatccaatttcttgtccagaatccgtgcctgcaatgctgtcattcgatccatccaaaccactccttattgacattattttaaaattttgaaaaaaagacgccccgattaccgggacgtcatcaatatttattcagcagctgctgccggataaactgaaaccttcttcttgtcacggccgaagcgttcaaacttgacaacgccgtcagcagtcgcaaacaaggtatcgtcgccgccgcggccaacgttttcaccaggatggatcttggtaccgcgctggcgatacaagatgttgcctgccttaacgaactgaccatcggcacgcttgctacccaaacgccggcctgcagaattacggccgttagatgttgaaccgccacctttatggtgagagaagaattgcagattcatctttaacataacgtacacctccgagaattaattttgttttaattgttttgtcgtaatcaaaatgcgatcaggatattgatcttggatgctttgtaattcaagcaataaattttccaacaaaatctgactaatgtgcaactgttcgccagtgattgccgacttaagtgtcatttgcagatggccgccatggacctcatccgcatcaacgtcaggcttaaaacccgccagagcttcgacaccattgacggcgccaatactcacagccgaaacagcagcacagacgatatccttgccggttttaccggcatcggcatggccactcagttcgaaactgacgatatcgccatgctcatcgcgatgaaaaattgccttgatcataaactgacctcttatgcgttaatcgcgtcgataacgactttcgtgtatggctgacgatggcccttcttttgatgagagtgcttcttaggtttgtacttgtaagtaacaacctttttctcgcgcccttgtttttcgaccttgccagtcacggttgcgccggctacagttggcgtgccaatcttggcatcaccttcaccagcaaccataatcacttcgtcaaaagtaacttgcttgccttcttcggcatcaagtttttcaacatagatggcttcaccgacttcagctttatactgtttgccgcctgttttgataattgcgtacactgtgtgcacctcctgttttgcctctcggcttttcccctgaagactcgccaagttaggtgcttacgcttaaaacctaacgatgtgcggttgcataggaggggtgccaaatacaacggactaatattaccagacagcacgccaagttgcaagcacatcgccgataatagccgttttttgtcgatcgctgatgataacagctttttgattgttccaaacccgcaattgtttttcaactcggcttggcgctaattaaatggtcagattgagttgcagccttaagacagcaactttcttattacggcaagtgctgctggcggtaaagccaaacgccaatgatgaccgcgggcatataaagcgcataaatcaaggtaaagaacgtcaaccagccgccaaacgctgcattaatcagcagtaaggccacatataaaatgccatcaacaatccaattaatcggttttctgagttgggtggttaccgttattagcaatgcagcggtaaccagtaaaatgaagatgttcagcaaaatgatgatcagtaccaccccctggatggaattatagccaagccaaacagtttcaacaaggaaacgttttaatcggcgacttcgaaccaaaaaaaggcccagaaaaaatctgagcctgcccctgccaaggaacctaatatagcataaaaagtctccatggcactagtcccttggcaaaaaagaaagccgccggtatgaagtcattcaccggcagcaagacattatttcttcagttgttgcaacgctttttcaattgtctcgcccttaccaatgtgcttagcattgtgcggatcaatcgcgataaattcttgcgtcttcatgttcaactggattcgatatcccatcagaatccctccattcttaaaaatgtgaatggccttcggtagcgattgagtgtatgttactcacttattgttaggaagtcaagagcgtgagcaggagcgcttagaaatccgagtgtaagtggcctcaatcctaaatggctggtctttggccatttaggattgaggtcacttacacgtagatttctgcgactgcgaacgcgtttcaaagccggattgcctaactacaagagctgtagcgttccttccacatccttaaaaccttttacacaccctccacaaagttcaagttcctcaacattccgttgacgcctacccgcgcttctcgtatacttaataacgatttgtaccagtagctcagctggatagagcaacggtcttctaaaccgtttgtcccgggttcaaatcccggctggtacacttaaagcaaacagtttgtcctcaaaaagcccgatgtttcgggctttttgtgttaccaagtttacctaaatgccgcccttaaatagcttctgtgccagtagcaacttccctggaatcctcactttttaaccgcaacctgtgatcaaccatttcgtaaatctttacgccatacgcctgcgccaaggcttcctgataatgatgcgcgacttcaatgaccgttgcaggtagcgtgtaaataatgcgatgaattttatcagcattggtctgatcaagacttgaggaaatctcatcaagtaaaaagatgggacttttgcgcaacagtccgcgggcaatcgcaatgcgctgcgcttgtccacctgatagattactgccgttatcaacaattttgaaatcaagcacatgctcacccaattcctgatcaaggcccaccagccgcaaaaccgccaaaaccgcggcatcatcgtaagcctgatataacgtgatattatcccgcaacgtaccattaaacaaccagacattttgcgacaccaaaacaaactcaccagcatgcagcggttgaccggcaaaacgaatcgcaccttgagatgtcacttgaccggtgatggcttttagaagggttgttttacctattccagaaggaccggtcacgatgactttgctacccggttcaaggcggatattgacatcactcaagattaaatgccgatcacgcacaacagttagatcgctgatgtcaagctggccttctaaagcttccgggtttgactcgccatcatcaaccttggatatttcaaatttaccagccgccggtaacacgcgtagctgactcgtgctaacaatttgactttgatatttgctcaaactgcgagcgccgcctacaacagaatctgccgtcattgtcagtgtcaaaatgacgctggtcgtcacaccaaacaatcctttggccatcaagaggaggccgataaaaagtggcaacaaaaacgccgcaatggcaaatagccaagaaacatattgaaataaatattgaaagttattcattcgttcatagtcgcgttcttcttggctcaaatgttgcttaaatcgggtgaagaagaccggccaggctttaaaaataaagatttccattcggccttgaaaaatgtctttcatactcaagaccaaaccggcattggtgttagcccaaatgtccgacttttttgccaggctctttctgccaaagtgactcggaagcagtgacaatgcagaaaataacacatagaccaaacttaacacgatattggttttcaggataaaagccacagcgatgatcaagccaatcacttgttgcagcatattgataagtccgacaaagtaggcttgttcaatttgtttcgcaacgccggtcacatcattgatcgtgtcagaaacctccgtggcgtcagtccctgcgtgcgcgactgaggcggtgaaatacgctgatttaagtgcctgattcaacacccgaacagcgcgttgctgggcgcgcaaaaacagatagagtgatgtataggtaacgagataggcagctgcagctaatgagacataacgcaccacagcgtcaagattactgaagtcaatattgaccagctgaccgaaaaccacgccatttaaaattggctccaaagtgcttgtcaggctcagtaaaaatagcaccactattaaagtcagcggcaactgtcgaataacccaacgtatattaatctggcgttcctgatgatccatccacttcacgtccttttcccgcaacggcgcaaacttatgacgatgttgtcctcaaccgtggatgctatttttaaagtcgaaatggcaatgttaaggtgctcttcgccaaatcgacgtgataatgcgttgtttttgtcggtcggatcgtttgcgccatatcggcaccatggatgatcaaggcaagctgccggccggtcggtaagtgatagtgcgtcggttgcagatccagactcacgtgaaaaaactggcccggtgtgatttgctgcacttcgtaggcgtttttaggattttgtaaattaatatgacctaacgttatcagtttacttggggttggcttagcggccggcttgaattcgacaatatcggttgttttaaaatcaaagcctaactgtaaatcattggccgcaacggtggctgcggtttcgccaaaacgcttggcctcgccgagatccacgagccgaacactaagaatgccggtcggtgcatcaactgccaacgtcagctcaagatgtggaatgccttccaggatttgatcacgctcaagcactggttgggtcaaccacaaccggctgttagcgtaagcactattaggggtaatgatggccttttcgaaactggcgctggtgtcatgttgcgccgcaaacgttgccgtggcatgatcggtaaactgatcggtagctgcttcaaagtcattcttcaggttgacctcagttgtcacatgttccgcttccggattagcaaaatcggtataggctgaccaggtctgcggagtcacgttatcttgcacaataacattcggcaaaacatctgcaacatcattggctacccctaacagctcatgtgtcaaccacaagttcatcatgtccaaaaagtccaacgagcgaacattgtgaacataaacatgttgtccttgatgtaaaatcagtttcttttgaatcggcaaatctgcaattgcctgccagaaacggattgcgtttttaggcttgacattccagtcattgagcccgtgaatcaacaccacgtcggctttgacgttggcggcatttttgcggtaattacgcgcatcccaccacgcggtataggcacccgtcgtccgatcctgatcacgggtaatcgcagcaagatgccgctcccaagccgacttgatgcgaatcatatcgccgccggatttctgccgggaaaacgtatcaactgccaaaacatcagcgtcttcaccttgaaagccgccgggcgccacgaccaaaccattttcgcggtaataatcataccagctagaaatgccggcatcggcaatgatggttttcaacccctcaacgccggtcgtcgccgcagcaatggctaacgtagctaagtaggacttaccggtcatcgcaactttgccggttgaccaccaagccttaatggcaacgccagcagtacggttcgtgaacgcccggcgcttaccggtcagccattcgatcactgccacagccccggccgtttcctcaggtccaccaatggtccgaaagccgtctgaataccgcgtgccaaccccagctgagtaaaccacagcaaatccgcgcgcaagaaaataatcgttgaacgcatacatactattttcttcggcataggcctctgcctctgtcgcctcgccagtaacggcccgcttcggtaagtcttcgatttgagccgctgtagccgtcacttctgccttcgaggctccatgcggcttgactgccaaaaccgtttccggaacatgcgtcgcagctgtcacatcattggtcccatgaaagtatggattcgcggtaaacaaaacgggaaccttcaatccttgctcggtggctttgggtcgataaatcgtcgcttctaaaagatcccgctttccatcgtggtctgagtcgacatcagactcaatccataccacctcacggatagcttggcgcgcatcgaaaacctgttgcactttaccattaaacaataaaggtttcggttgggttgccgacgactgaaaatctttgaaaaagccacgattggctaaatcatcgagaaagttgaccaagtgtttagttcgcgtcgtcaacaataagtagctagccttcagaaaatcctcggtatcaagcagatcatgatcaatgcttggcaattttgtcgccgccataaacggcaatggatctgccaaatcgaaatcggtgaaggcttcaaaccccagcaactgcagggctacattgtaaaagttttgccgggtcatctgcgtgggccccgatgccaaccagtcagccagattctgccgcgaatcgactgcaatctgagcgaatttatcttgtttggccgcgggctgataagcttccgggaaaaaggccgcatacatggctgcagccgtatctgcaaagtcacctttaggatctgccggcaagccgatgcgggcaagttccgttaattgttggctaaattcaggtgttaaccgcgcgaattggtttaatttcatgagcagtgccgtcctttatgagagaaatgtgataaattcagtgtagccatctcatttagcgttttcaactattaatattgattaactccctacaacagttgaggtttttcagatcgtacgcaatcaaaaaagcttcaggcgtggttgcgtctgaagctttttgaaatatggaatgcttgactgtttttaccagttagtcaaggaaaaggttaacaacagcttttgggtggctggaattaatacaattccaggtattgttgccgttcccattcggaaacctgctggcggtatgcggaccattcgaggttcttcgaatccataaagctttgatacaaatgttcacccagggcagccttgaccacgtcatcagccgccaatgccttcaacgcattgtgcaaggttgatgggaggtcttgaatatgatttgctttgcgttcgtcgtcttgcatccgataaatgttacgatctaccgcttcttccggcttcaactggttcttgacgccatcaaggccggcctgaaggattgcggcaatggctaagtaaggattggcagtcggatcaaccgagcgtaactccaagcgggttgataatccccgtgactgcggtacccgaatcagtggtgagcggtttttgccggaccaagccacataaaccggggcttcaaatcctggcaccagtcgtttgtaggagttgacggttgggttgttaaccgcggtcagcgcataagcatggcgcaaaacgccagcaaggaaatgcatcgccgtttcactcaactgatcgtcggtatttggatcatagaaagcattgcctttgtcgtggaaaaggctcatgttgatgtgcatgccgctaccgttgatgccgtgaagtggtttaggcatgaatgtcgcgtataagccatgtttgcgggcaatggttttgaccacaagtttgaaggtttgaatgttatcggcagcgtctaacgcatcggcatatttgaagtcaatttcatgctggcccggtgccacttcatggtgggaagcttcgacttcaaagcccatcttttccaactcaaggacaatatcacgccggcaattttcgcccatatcaagcggtgcaaaatcgaagtaagaaccatgatcattcagcttcgttgtcggattgccgttttcgtccagtttaaacaagaagaattccggttcagggccgatattgaaagctgtgaagccggcttctttcatttcattcacgacacggatcagattgttacgcggatcgccgccaaaaggtgtgccgtctggacgatgaaccgagcagatcagccgggcaatcttaccatgatcattctcccacgggaacaatagccaagtgttaagatccggatagagcagcatatcgctttcttcgattcgaacaaaaccgtcaatcgacgaaccatcgaaggtaatcttattattcagcaccttttccaactgggaaatcggcacctcgacgttcttaatgatcccgttaatgtcggtaaacatcaggcgcaagaataagacgttctcatccttaactgtctggcgaatctcatcagcggtaattgcttttcttgccatatacgtgaactcctatctttagtgtgattgtcggaagccaatggtgggacccggatccgggctttgattgagtcgactctgattcagcagttcgtcgcgcaacactttgcgaacttcggcatcactatcctcgcgatgacgtggatgcttcaaccgcttgacatcagccagcgtgaaaccatcggccatctgactgcggatttccagcagttcatcaacgtcattaagcgaataagttcggtgattgccggcattgcgctcgggcttgaccaatccctgggcttcatagtaacgaatctggcgggcagtcaagtctgttaacaacataactgtaccaatcggcaaaaccgatcgcgttctcagatcagcgatctcagccataggcatcctcctttacaacgatgtcagcttatcaaaccagataaacggtgtcaacgcaacatgtaagtttttctgacatttaccgtaaaaaatgaaaaaattttatttttacgatcaacttgttatagaccaatatgttgagccaattattcaaaaagaagcgctttctactaagtcaacttgccacgcttgtcagtattatccaagcaatccgaaatcttaccgcgccaaattctttctaggtattttcaactatgaaacgtatgataacagtaactaggtttctgaaaggacgttgtcgtcatgaccttacatttacacgttgggtacaccccgaccatgaaatctgtcaacttacccaccgattggctgccgtttaatgattatcctttggcagctttcaatgcagtggtggtgcatgcggccgatcaaaatgtctttgaccaacttgttgccagtgaactgcctttgccggtctttgtcattggccaccgccaaaatgattcaaccggccagctggacgtgactgaagcaccgcgacttgatgctaatttgctcactcaaatcaccgcggcagcgacacattacgaaaagaccatgattcctgcttttctaaatgatctactgaattttgcgcaggcaaatcccacaagctttgccacccccggtcaccacagcggccattacgatcgattagcgcccgccggttatttactttatcaagcttatggtgacactttttttgccagcgacaccagtgatgtcgtcacttcgttaggcgatatgctgacacatggcggcagcccgctggcagctgaacaagccacggcgcggttataccacgctgatgaaacttattttgtcaccaatggcacgactggctccaacaacattgtggctagtgcgttgttgacgccaggtgatctggtcttgtttgaccgcaataatcacaaatcattttataatgctgcgctggtgcaaaatggggcgcgcccggtttaccttgacaccctccgtacgcagcgcggattaatcggtccactcgaccttactgatatcagcgctaaccggctacgccaactggttgcgagcattgatccgcaaaaagctcaagaacgccatccgtttagactggccattcttgaactggaaaccttcgatggaattgttcctaatgtccgccagttacttgatctttttggcccattgacggattacatcgcctttgacgctgcttggggcggctatgagccgttcattccggccatgaagccgatggatcctttgcagatgccattaggtccggatgatccgggcattattgtcacccaaagcgttcacaagcaacaatccggcttcggccaagcgtctcagattcataaaaaagatgcgcacatcaaaggacagccacgctatgtcacccatgagcagttcaaccatgcgtaccttaaacatgtcaccactagctactcttacccactttatgcatcgttggtcgctaataccgcaatcaatcaaggccgccggggtcaaaagatctgggccgacgctcttcaggcagcactcgcctttcgtcactcgttaagtgattctcgcttgtttttggcctatcaaaatccaacgttaaccgcaattaccccgcaaaaggcaacgacttctgcggaagcctgggcaatggcccctaacgccaagtggcatcagctcctgcacttaaaaccgaaccaagcctatcttgatccgggcaaggtcacggtgctgttaccggaaacggcaacatttggcgttagcggctggttggtcgatcgctacttgcttgatcacggaattgtcccggaaaaagccgatttgaacagcttgctctttttggtaacgccgggatctgccgcaaccgactggcagcaccttcgccgagttttgcaacaattcgaaaaagattactttgccaacaaaactgttgccgaggcattaccaaaattagttgctgaaaccggcgaggcgtacaaggatctgaccttacgcgaactggcccagcaaatgtccgattttttccgcgaagctaaattggcccagcagcaacaattacttttcacaaatacgaacaacataccgactgctatgacgccacaagcagccgaccgctgttttgtccgtggaaaatttgacaccgtgccactgcaggctgcggaaggccgaatcgccgttgccggggcattgccgtatcctcctggcattttcgtcgtcgtgccgggcgaacgctggcgtgcggtggccattcactattttgaaacgttatttgccggcatccgtcgttttcctggattcacgccggagattcagggcattgtgaccggtgcggacggtgaaccttatgtgcaggtcgtggctgagaaatagcgatttttgaaatttttcagactttacatttttcacgagcaaatcaaaaaagcgccagtgcactgcctgtttgcagtgacgctgacgctttttgacatacaaatcgtttattgagcttgatcaaaaaaggtcgattgtgccgcccccatagttgccaatttaatatgcgcgtaagtcaaaccgccttgcaaataaagcgtgtatggcggacgcaacggaccatccccggaaaattcaactgtcgaaccggctacaaacgtcccaccggccataatgacctcgtcttcgtaaccagccattttctccggaatcggcgtcacaaagctatcaacgggcgaattggcttgtattgccttggcaaacttaaccatgtcagcttgattgccgaaattaaccgtttgaatcaggtccgtccgcggcgcatcccaggttggtgatacatctaagcctaactttgcaaataaggccgcttcaaagatcgcccctttaatcgcattaccggttgtttgcggtgaaatgaagaaaccttgatacatatcagccagcgcaccgacagtcgccccctcggcaccaccaagaccaggaactgtaaagcgatagctgatgcgctcaattaaatccttcttgccgacaatatacccaccggttttggccatgccgcccccagcatttttaaacagcgaccccgccatgacatcggcgcctacttcaagtggttcggttgtttcggaaaattcgccataagcgttatcgacaaaaatccagacattcggcaacacgctgcgaacaactttgatcattgccgcaatttgatcgaccgtaaacgaatcgcgcgttgcatacccacgcgaacgctgaatcgcaaccactttggttttagcggtcagccgtgccttaaccgcatcattgtcgactgccccatttggcaaaagatcaacataatcgacgccaatgccgtattctttaggactgccaatgccgttgccagcaagtcccagcacctcttgcaatgtatcatacggcttgccggtgatgtacaaaatgtcatcccccgggcggacaagcccaagtaatgcaaccccgattgcgtgcgtgccagaaacaaattgtggccgcacgagcgcgtcttcaccgcctaaaacgtcggcatagatggcctcaagcacatcgcggccttcatcgttatgtccataaccggtcgatccggttaaatagctttcggcaacatggtgtttctgaaagctcgttaaaactttatcttggttctccaaaatccgtccatcaatcgtagctagttgcggtgcgatttgggtatcgacttctttgaccatttttaataaggcgggatcaaatttatctgtccaactcattttcttctcctttaaccggttgcttcagccactgacatactaaggcaaccactgcctgcttttcttctggatgggcaaccaaatcaaaccagtgtgtcggcatttggttgcgaaaatacgtcagctgccgtttggcaaagtggcgtgaatgctgcttgatgagtgccacacagtcagccaaatcagcttgacctttaaaatatggaaccagttctttatagccaatggcctgcattgcctgagcatcaggcggaacggtttttaacaaattggcgacttctgcttccagtccctcaaccatcatggcatccacccgcgcattgattcgctcgtataaaaccgctcgctgcgtggtcaagccgataaccaatgtttcataaagcggttggggctgaggctgttcggaaaaccgcctgccagtcaattcaatgacttccagtgcgcgaatcacccggcgcgtattagcaggttcaatctgcttggccgcgaccggatcacgctgtaccaactgcgtccataaccatgacgcaccatactcggctaatgccttttgccatcgctgacggacactttttggcggcgctttaccacccagtggcagattcaggcgtaaactattcaaataaaaaccggtcccgccaactaaaatcggcagatgatgccgttcactgaccagcgtgatggcattttcggcggcttctttaaacttagcaaccgtgtaagtcatcgttggctcaacgatatccagtaaatgatgcgggacgccagccatttcgtcaggcatgactttggcggtaccgatattcatatgacgataaatttgatacgcatcaccattgatgacttcgccttgaagctgctgggccaagtaaatgccaagatcacttttacccactgctgttggtcccacaatcatgacgatgcggtttaccggtttatccatttcattaagctccatcaatatagtataataaattcagtatcacagatcaccaatcaggggggattctcatgaaacataaatttgcacgcggctttttcgttggcacgttgatgacgcttggcgccattgccggcagtgttttcgccttcaagaaaaactatgtcgaacctgttgaaaccaaggccgatgaaatcaatgaaaatcggcgcaaagctaatcgcaaacgcttctcagcccatcaaggctaagcaaataagcatcgcttaacaaaaaagcaatcgaccagtgcgattgctttttttgctgcctatgtacggctcaataattagtcgggctttttttgattttgcctgaccagttatcgtaaccgccttttaaccagctgatcttctcaaagccattcttgcgcaagcgccgtgctgcccgcaacgaaaggacgccggttttgtcatagagatagaccggcaaatctttacgcatctcgcctaaccgctcacgcagctgcgtatatggaaggtcacgcgcaccaagaatatggcctgctttgaattcgttgcgttcccgtaagtcgataatctgggctttgcgcattgtgtgctcaaattcttcaggtgaaatttcgccaccgatggccttgaatttcgacttttgataatagctccacaaccagctgaagccccagtaaattaaaaataatccaacaaagattaacagataagttaacacttacacgactctccttttccccttacttcagcgccaggcttgcggctccaatgacgccagctgtattgcccaacgttgccaaccgcaatcgcgtggtttcacgaacattcgggaacgtattttctttgaaatacttatcaacgcgtttaagcaagaagtcgcctgctgccgacacaccgccaccgatgacaatgaatttcggattcaataaattgcctacgtttgctaaggccaaaccaagatagaagcaaacccggtccacaatcatcaaagccaggcgatcgccgtcttttgccaaatcgaaaacgattttgctagaaatctcgtccccatcgtccagcgtttgcttcaactttgagtcgccggcaaattcttctgccatgtcacgagcaacccgcaccacgccggtcgcactagctactgtttcgaggcagccgcgcttgccacaggtacatagatacccgttaaccggatcgacggtgacatgtcctaactcaccggcagaaccggcaacgccatgtaacagctcgccatctgcaataatgcccccaccaacgcccgtaccaagcgtcacgaaggtcacatccggatcattttcaccggcgcctttccagcgttcgcccaatgccgcaacattggcgtcattatcaatgttgaaaggaatcttggtgccggattcgatcacttttttggcttgctgcaatgttttccagttcaaattgtatgcgccaataacggtgccagctttgatatcaacagaacccggagaccccatgccgatgccggcaaaatcggctggcgacatgttgtaaagttttaggtgttcgttaatggacgtcacaatatccggcaaaatatggctgccttcatccagaatgttggtgtcgatactccagcgctgctgaatatcgcccgcctgcgttaaaatagcaaatttaatggttgtaccgcctaagtcaaccccgattaatttttgattattcattttgatcattcctccgttggttcgaatgcaaaggtaaatcgtgattcaagggatcttgctcttcttgttcatgggcatgccgcaaaacaactttcgcattcagataaaccttatcgtcaatcaattttgcctgatgcaaacggtctaattctagtgctgccagctcaatatcccacacccgtttaccgacatggataaaggtgccaaagctctttaataattgcaaaacatcataataagttttcatacgattccgcgctgaattccaaataaaatcaaagcaaccagtccaaagatcaaggtgactgccgaagcgacgcgccggacagtccccatacgaccaagtgccggggctcccaacatgccggccgctaagaaaccgcctagcacaccgccaatgtgtccataaatatcaacgccgctagagaaaaggttaaatgccaagttcaagacaaccaacaacaaaaattgacgcgacaattgccgaatgacggggttatcgcggtaggtatcccccaacatcaagcaagctcccaacaacccaaaaatcgcggtgctggctcctgctgccaacgtgttgggactgaaagcaaaacttgccacgttgccggcaaaaccggaaatgaaatatagcaggaagaaccgccaatgaccaaataaacgttccgtcatttcgcctaaaaagtataacgaaaagccattcatcaagatgtgcgttaagccaatatgaacaaataccggggtgatcaggcgccaccattgtccgtataaaataagcggattagctcgggcaccataagcaatcagcacttcagtattggtgctgccaccggaaagtgtctctagaatgaacaccaaaatcgtgacggccagaatgccgttggtcacataggctgaattttgaaaacgtgagcgccaatttgcgtagttcattgaaatcctttctaacttgactgtccaagcagcaagtgcgtgtataaccgtcgccaagcggcaatctcgctaaaaaaacaacaggtgaccctgttgttttcccattgccaccagtgccaatcaatcacttgacggccatgttcttgtagtagtttagcattttttgcacacgctgccaacaacgttaaccattgatggtcttttgatggatcgaatagcccttatcttctttgatgtcattcatcttatagaagtcgctaaacatttctttggcaatttgtaactgatatggcgttgtcgtttcagcttttaagttaggaataatgaccgcaatcgcaatcttgggattcttcgctggagcaaagccaacaaaactttccgtgatggtctcggtcaacgccgatccttttgactcacgggtaaagccttgcgccgtcccggttttcccagcgaccccaggattcaaggaattcagcgacgttgccgttgtccacccattcgtaccatggacaacctgccacatcccctgcttcaccagatcgatttgtgcttgggtattctcaattttagacgttacagatggctgagttgtacttaaaatcggtcccttactgccatcgctcagtgtctgactgatactattgaccaggtaaggacgcatgcggtacccattattggcaatcgcactgatgtactgcagcatttggatcaaggtgtagttatcgtagttcccgtatgccaagtccaacgccgacccaactagtaagttgccagaactgtcatgggtactaccttccaacccggcaatttcaccaggcaaatcgatgccggtcttgattcctaagccgaactggttgaagtagccgcgcatcttgctgaaaatgttgttgtctagttttagataattattcggcgagtaagcgtaatggccttccttcatcgccagccacatcatgtaaatgttactggacacttccaacgctgaagcagcatccagcgagctgaacgtaccgacagggtaaacggattttttaactggtgtacccggcaaataaatcggcgtgtctgcctgggtattgtggtcaaccgtaataactccgtcttgaagtgcaccgagaaccgttgcccctttgaccgcagacccgacaacaaaggcacgattgataaccccaagcgcatcgtcttcgactttatgggtctgcgtatcctgatgttgcccggccatggccagaatccgcccggtatttggatccattgccacggcatatgcaccatccgataaactgccggcaccggccgagcgaaccgaactaaaggtgtcatccaacgccttttcgactttcttttggtattccgaatcaatggtcagattcagattggcaccttgctgtcctttgaatttagaaaccgactggacaatttggttattattgccgatttcaacctgggtctgactctttgatccctttaaaacattctcgtacgctttttccaagtaactggtgccgacacggtcattgcgcgcatacccattcgctaagtatgcgttcaattcatccgcaggcagcccgcttttttcattggaaacccggccgatgatcgaggtcattgactcgccattagggtatgagcgttcccaatcagtgccgaggttaacgcctggcatctgcgtcagccgttcaccgacaaccgccacctcatgagcagtgacattttggtttttcaaataaaccgtggacaactgcgtggcaccgttcatgattttataaagtcctgctgcttctttttgaatgggcgtcaacgtcggcatatgtttgcgaacataggcaacttgatatttatacaatttatcggagtccgctgaaggcaatttttgaatctgcttaggcagctttttggtgattcgctttgacaccttggtctgcgccaggtagtaatcaatataatcacgcttggttagattctcagccggcttatcaatcaaccttgccagctgattggcaatgtcatacatttgttgggatttggtcccgacactcttggtataggtaatcgcattgttggccttgttagtgacaagcgcgcgtcccttactgtcataaatcaacccacgcggtacattgccggtgaccgttgttttgttcgtccgatcgacttcggcagccaatcggggaccatttagaatctgcaaataagccagctgggcaaccagtgccgctaacaaaagaaacgcaatgaaaaacaataaatttaagcgaaacggaatgtgacttttatttcgtttcggctgcggtgtacgaatgtacttcaccctaaatgctcctttgaaatctctatcttttaaagtgtagcaaagaacccggcaaaacgctatgtgtcttatgatatgcttgaaatagcgatgccggacgaaaataagccggaattaattttaatttagaagttggtgggtacctgtgcgacgacgatggttaaaaaacaatccgctgatccttagttttttactgccgggactgttagtcggtttttactttgctattcgcggcgttttcccgtttggttccagcagcgtgctcacggttgatctgggccaacagtatattgacttttttgcctatcttcgccaaactctgctcggccacccggggcagcttttttatgcctttaataaaggattaggcggcgacatgtttggcgtctttgcatattatttactgagtccgtttaatttgttggtaattcttttccccactgacatgctggatgttgctgcttttttgatcatgattctaaaaatcagcacggccggattaaccatgggatggtatgccaaacaccacggaattaacgggctgatgatttccgcttttggattggcatatgcgcttagcggttggctgttggcaaacagtttcaacttgatgtggctagatgcagcgattttgctgccgctgatcgttcaaagtgcggaggcgttgttcaccaaaggccggaacattgcctatatcggctggctggcagctgccctaatcattaacttttacacaggctatatgatcgctttgtttctggtattatacgccgcttattggctcagtgcccatgccaagtcttggcggcacgcctggcgcatcggcctgcgctttataggcgccagcttactggcagctatgtgcagcgccgtggtgcttcttccaacgtggtttcagcttgcccagtccaaagcaacgtatacggtcaaaacgttccagtggcactttgagtatgccccggatcgcttgttaagcaagctgatcccgggaagtttcaactttgatcaaatgccttcagggttcccgaatatttacgtcggcgccttaggatttgttctagcagtccttttcttcttatccagacagcagccatggcgacagaaaatcgcggctgtcttggtgaccggtttcttgctactttcctgcatgttcgaaccgctggatttattgtggcatggttttcagtttccggtttggtatccgtaccggtttacgtttgttttgtgcttctggttcctgagtttaggtatcaacagcttggcaaaaatagaaacgggattgtcgctgcaaaagctcgtcattttgctaatcgtattcgggctgatttacggtgacgtggcgcttaatctgaagcacttcagctttttgactttcggtaatctcgtgtttggcatcggttcgctgttactggtgcttgtgtggctcagtctggaccagcaccggccgttatggtttgggtttgccattgttttggtcgatatgagcggcagcatgattctgacactgaatcagctggcttacctcggccaccgtgattaccacgattataccgcagcacttattcaaggggccaacgccgtcaaggaagacgatcacggattctttcgcattggcaaaaccacaattcggacgcgcaacgatccgatgaccggcaactatcgtggtgccgatcaatttaactcgctgctcgagccagctttaccaaagttctttgggcaaattggccaacccgaagacgacggctcggtggcatacaccaatggcacgttaatcacggatagcctgctggggatgaaatactttttaacaccgactcatgcgcagagctccctacccgatgccgggcaacggcctgatttaaagtggtatcggcaagtgaaccaagtcggcccctggaaaattctgcggtcaccattcgctcaacaaatcggcttcgcggccagcaccgatttactgaaacagcagctttatagcgatacacctgtcgccaaccaatcgtttattctccaggctgccctaggaaaagacaccgatccttattttagcgcgttgccactccccgaaccgacgcttgctggcgttcgccgcacgacatcaaatggcacctcgacctttaccaaggttggcaaaggtcgccatactgtgacctatcgttttaaaccacaagcgggaaaatgctacgttctgacgcttggcagccattttgccaatcacctggtgaacctcaaacaaaatggaaacgctgtgacgctccctgatagctttaacgacacgatcactgtaaacgtcacgcctaaaaagggcctccaggagcaatctttaacttttcagctcaataaaaaagaagcgtggtttgacaatgttggtctgtatcaagctgatgtcggtactattcaacacgatctcaaacagttacaagctggcggttggcgggttaaacacgccactgacaccaccattgcggctgatgtcaccatccatcaatcacaccaaatgttgcaaacaacaattccaacggcaccaggctggcacgttcgcgttaacggccgcccggtttcagtcaaaaccagtctaggcattttcatggccattccgcttaagcccgggcattatcgcatcaccatgcgctacaccccgccattattgggctggggcagcctgataacggttatcggcttgcttctgacgacaaggtggtggtttgtcacaactcggcaccagccctatcggaaatcatgatctgaaaagcaaaaaatccttaggcaacagcaaccgcgcccgaggattttttgcgtgcagattaatcatacataaagtatgactgcaatctgacttattcttctttaaattcgtacttaggttcatccagatgggcatcgtaatcaaccgtcattgcaaggttttcaaagaaccatgcatcggtcggattgacgaaataggtcacgccgtctttttcgactgacataattggatgctctggataatcatcccttgtcatgcccacgctaaaaccatcatgaacctgggttttaccataagcttttccgaagaagcgaatgccggcaccttgatccggtaaattcaattcacggtgaaaccattgacttgctttatcagtgatcgcgagttgcaaccccatcatctccttgatcatttttgaccagaccatgctttagcgcataaatcgccgcctgggtccgatcctcgacatccaacttggctaatatgtttgaaacgtgcgttttaaccgtttttaatgtaataaataatgctgtggcaatctcctgattcgacttgccttgcgcaatcaactgcaaaacttcgcgttcgcggttggtcagttcgtcatactgcggttgcggatgattcatgcgattcatcattttggtggtcacctgcggctcaagtacccgttcgcccttggcagtctgccgaatggctttggcaatttcctccgccgttgcggttttcagaatatagctcgccgcccctgcctccatggctggatatactttggcatcatcgatgaaactggtcaaaatgataatccgcgcttgcggccaagctttcagaatctccttagtcgccgtaatgccgtcttttaccggcatcaccagatccatcaagataatatcaggccgatctttcaacgccatatcgacgccttcctggccgttctcggcttgatcgaccacctctaagtcaggctgaacgccaatataagtcgccagtcccaatcgaaccatttcgtgatcatcaacgatcaatactttaatcatgcgcaacatcctttgataacggtaccctgacttcaacactggttccttgaccgaccacactcacaaccttggccgttccgcccatggccgccgcgcgttccttgatattggcaagaccatagttaccgttgccattagtttcttttggatcaaacccaacaccatcatccaccatacgcaaaataaccatatcttgcaaccgcttcagataaacttccaggctatcggccttggcatggcgtaatgtattgctaagtaactcctgaacaatccggaaaagattatcctccgttgcagcatttaacttaatgtcatccaattgccatgtgattttgattgtaatcttggtttgcaattctttcaacaactgaatgattccctgctttagcgacttgccttcaagattagtcggacgcagatgcaatagcaatgcccgcatttccgcctgggcttcattgatcactttttgaatcgtatccaactgcttctgcaaagcttcctgcttaggatcgcgttctgcaacactccgcagtgcggacaacatcatcatcgccgcaaataactgctgggaaacggaatcatgcagttcccgagctaaccgatgccgttcaccggttagaatggcctcacgggtttcgccggaaaagcggacaggcgtattactataacgttcaatctcacgttgtaagcgtatcattttttgccgtaacgcttcaagcaagtcagctggctgtttgcccaatgcggcgaccgcttgttgagagcgattaaagattggcgcttgatattgtccggcatttaattgcgccaagcgactatccaactgattacgcatcacccgttgtcgccataacacaatcacggtggcgccggaactgatcagtaaggctccaataaaaaggtaaacaaataacggcgccgaaagcacattcgctaacagaagctgcaggaaatcatgatgggtcacttttgccagcataaacaccaaacaggcctcgaccaaaatcgtccagaccagcagaatcagaaaaaaaccgactaacatccgtctcctcatactgccagcacctccaagtcgcccaccaccacattcgtgataatgtggattcggcgcggtgcatcgtcgtaatcctgcgaataagcggtcacactttggctatgcagcatcgagtcggaatcttcaaaatgcagccgcccataaaacgtcgcatgttctacagcaacgccaacacccacgggaaccaaaattctggttttcccaaagcctttgcgaatcataatcacgctgtcgcctttgggtaaaaaagtgtcacccaggtcaatgatggtatcaccagctggcaccaccatattgatgtcatcccaatcataactaggtgcaatcgtttgccgccctgcccaggaacgaatcgttcggcgcccggcttttttgcctggggcctccgtgactggggcaacgtactgtttatgattccaaaccgaaaagcctgcttttggtttggtcagaaccatcatcaaaaagatcccggccaccatcaatatgagccaaatcgcgggattaatgaaaatacctagtaccattaaaacaccgccaaacgtgacactaaaagtccgcagccggtgccagtgcatgcctaagaaaagaaacagaaagccaatcaggatcgttgccaacgccatgggattcgtaatgatctggaatcctagccagagtaagagcgcaaattcaatccccaaaaacagttgccagcggcgcatttgcgatccctccttttaatcaaaatcgtgaatttatctggcagtgaggcatcaccaaattcgtacccgactaccatatccttgatttattataacggatcaaatgctcgctagcttagggcgtaaggctgatattcaccggcaagtgatatttgctcataagaaaagccagcaagcacatcctcgtcgtcggagatgtgcttgccggctagcttttataaaatgagattagccttcaacttttgtaatcgtcacggtcatttcgccgcctggggtgttaatggtaactttgtcgccaactttacgaccaataaggccttgggcaatcgggctttcattactgatcttgccattgaaagcatcggcttccgctgccccgacaatttcgtatgtttcctcgtcgccgtcttcttcaaaggtcacttttttaccaatggagacttcatttttagcaactgccttagcgtcaatgatctcagcgtaccgcaacattgtctgaatcgtcacgatccgattttcaagtgtggattgttcatccttggctgcttcatattcggagttttcggacaaatcgccgaacccccgggctaccttgatccgctcaataacttctgggcgtttcttggtttttagttcctcaagttcgttttcaagtttctttttaccttctgctgtcatcggatagcttttgtctgccataaaatacttacctcacttcttattttccttagtcactttattaatccgggagccatttgtcaatggctactcttgtaaaccgcgttccgctagaatggctttgatcttggtcaccagtaaatcaatggcgacttgattctgaccgccttccggaacaatcagatccgcatagcgtttcgttggttcaacaaattgatgatacatcggttttacggtttttaaatattgattagtaattgaatctagtgtccgcccgcgcgaaaccatgtcgcgccggatccggcgaatgacacgaatatcgtcatctgtatcgacaaataccttaatgtccatcatgttacgtaacgactcatcatcaagaatcagaataccttcaagaatgatcacatctttaggctcaagatgcactgttttatccgagcgattatgaatcgtgtaatcatagaccggttgatcaactgcatgacgatggatcaactcatccaggtgatgcttcagtagcggagtgtcaaacgccaacggatgatcataattgattttcttccgctccgagaatggtttgtcgcttctcttataatacgcatcctgtgccagtaagagcaaggaatgcccggaaaagtgatcgaaaattgctcgactgacactggtcttgccactggcagaaccaccagtcacaccgatcacaatgggtttcttttgctgcatctgctggccttctttcatttaaatcgttgacagaaaaaactgcgcacaacagccttggaaaagatgtccagcattcaagcatcatttccaaggccgtttttctttaattgagtcactaaaatttcgccactgattctaacacgataaaactgctccgtcttgcctgtcaagatcaacccacaagtaaatcatgccactaaagtcgtggataaggggcgctagggccaacatgtaaattacttattgacagatgaattatcgctggcaaacttagccgtgttctcgtcgtgttgttcacgcgtggtagcatacagcacttcgccggtcttcaggttggcaacaaagtacagataatgcttgctgcgatcatttggactcaacaccgcagtgatactttgctcacttggcgaatcaaatggaccaggcccgtaaccggtatgcacatacaggttatacggcgaatcaacactggtatctttattggtcaaatgggttttatgtgtgtttaaagcatacataaccgaaatatcggattgcaatggcatatccgcatcaattcgattcaagaagaccccggcaattgtccggcgatcttcctgggtcaccccttcacgctcaaccagcgaagccaaggtcatgacttcctgaaccgtataaccttgctttttgatactcttatagtaactttgcatgacgctgtcggttttggctaacatggcttcaaccagatcttcgaccgtctcgccagcgctcacactataagtggctgggaaaagataaccttccaagcggtagcgaacgccttgggccgaagcagcagagctcagaagctgcgggtatttcttggccattttagcaaagaacgcctgatttttcatgagcgccatgaatttcttgctcgtcagattgcgatttgatttgcctagcttattcacggaggttgcgatttgctcgattgtcgcgccttctttaactagcaactgtcccgccgcggtggctgctgtgccgccagcccgcaacttttggatcacctgattcatcgaatcacgttgtgtcaactgataactgccggcctgaaagtcagcaatgttgtgaaacttgacataataattgaacaccatggcacttttgatcacgtgcttggcttccaatttggcggcaatttgtttggtggatgaacctgcaggcaccgtgacattgacagaagtctgaccattcggattcaccggctgaagtgccgagtggacgtaccgataccccatcaggccaacaatcaccagcaccgcaaacaagatacccagaacccacgcgacaatcttgtgcgacgcctttttttcatcggcgcgcaaccgccgtttgtcctctacatgtcgggatcgcctatccaaaaaagatgcctcctttttacgtactattgtttatcgcggattaaactaaatgtgcctgtaatccaaactggcagcatacagccgcttatgtaacagaaccaccgccgaactatcttcggcagcagcttaataaccaatgaccatcatacctaattacgcggtaaattgcgactgatgattagcgaatctcagcagccaaatctgatgctaacgcagacttaacacgatcgaacgcttgcgtcacttcgtcttcagtcagcgtctggtcatcccgccgataagtcagcgtgtatgccaagctcttttggccctcagcgatgtgttcacctgcgtaaacatcgaaaagtttaacctgcttcagataggcaccgccgtgttgccggaaaacgtccatcacttgcgcatttgtgacggtctcagccacctgaagcgcaatatcgcgcgtgacggccgggaacttcggtgccggttgggcaatcttttcctgttttggcgcaacgaacaacgcgtcaagatctagctgaaagacaaacgtctcgggcaaatggttgtcatgttcaaatgcgggatgcaggcgtcctaagaagccaatgcgcgtgtcgccgacaaaaatatcggcagcttggcctggatgaagttcggtcactgcctgcgttgccgcaaaccgtactggctctgccaatgaataatcttcaagcaagtgggtaacaatccctttgacataaaagaaatcaacgggacgggcatcctggttccaagtcttagtcgtcacctggccggtcaatgcaccacctaggtactcgatttcagtcgggcgaacctgatcgccggttttggtgaaaatgcggccctgctcataaatcgccacattggtttctttacgagcctgattgtatttaatgacatccaataatccagtgaccatgttcatgcgtaacacggcatgatcggttgtcatcggtgaatcaacccgggttggcttgcctggttgcagtttgaactgctcagccgctttggcagtggttaagccataagtgattgcctgggttaagcccagtccttcaagaagatgccgggtccgccgaatccgtttttgcttcggggtatattccccgattgtcatagttgtcgtcggcaaggtacttggtaaattatcaaagccataaatacgcgcaacttcttcaaccagatccgctttaatgtggatatcccagcggcgtggcggaaccgcaaccgcaaaaagaccgtccgcaaccgtcacgccaaaacctaactggcgaaaaatgccggttacctggtcttcttgcagatcggtgcctaaaacgtgattgatgtggtctagggagatatctaccaccacatccttggcttcaacagcagtcggactcaaagtgcctttagccgattgaccgcctcccaattcagccatccaggcaacagcagcatccaacgcgtggttaatatcagccagattgatgcctttttcgaagcgggaagacgcttctgaacgcagattatatttcaacgcggttttccgcacattgaccggattaaaactagccgcttcaacgacaacggttgtggtggtttcggagatctccgaattcaaaccgcccatgaccccggctaaagcaaccggcacctgaccatttgtaatgacgatgtcgcgatcatccagttcatgttcccgaccatccaaggtagttaacggctcaccgtttttggcacggcggacttcaatatgcttgtcgccgagtttggcataatcaaatgcgtgcagcggctggccatacgccaacataatcagattcgtgatatcgacaatattattaattggccgaaccccggcattccagagacgccgttgcaaccagagtgggctttctttgaccttaacatgatcaataacccgcagctgatagctcggtgcatcgtgggcatctttgacttctgcagttaggtagtcggcaatcggcttcgtgccctcggttaacggtttttcgacaaaatgcggcttttcggcataggtggcaccgacctcccacgcaacgccgcgcatccctaaagcatccgcgcggtttggcgtgatttcaaaatccaaaatggcatcatgcatacctaacgcggctaacgcatcactgcctggcttcaatggttcgttgaaaacatagatgccgttcaaataggactttggtaccacattttcgttaaagccgatttcctgaagcgcacaaatcatcccgaggctttcttcgccgcgcattttgccttttttaattttgacattgtccgcaatccgcgcacctggcagtgccacaacgaccgtttgtcctgcagcgacattgggagcaccgcaaacaatctgccgcggctccgcttcgccgacatccacatcacaaagcttgagatgatcggaattcggatgcggcttacttgtcagcactttcccgaccacgatttttttcaatccggcgtcagggtgcttaaccccatcgatttcaatcccggttcgggaaaccttatcggccaattcttctggtgaaaccgggacattgacgagttcttttaaccaatcatatgaaacgttcatcttaaccctcctggctgaactgcgttaggaagcgcaagtcgtctgtgtaaaagctgcggatatcgtcaatgccgtatttcagcatggcgaaccgatccggaccgaggccaaatgcaaagccaccatagacatcggcatcaatcttggctgcccgcagaacattcggatgcaccatgccggcaccgaggacttcaatccacccggtatacttgcaaaccgggcagcccttgccgccgcaacggaagcaggaaacatcgacttcaacagacggttccgtgaatggaaaataactcggacgcaaccgaattgttcgatcagcgccaaacacgtgctgacacatggcaagcagcgttcccttgagatcagccatggtaatgtgcttatcaatgactaatccttccatttggtgaaattgatggctatgcgtggcatcgtcatcatcgcgacgataaaccaaacccggactgatcatcttcaacggccccttactgaaatcatgcttttccatggtccgcgcctgcatcgggctcgtctgtgatcgcatcagcaattcattgttgatataaaaagtttcctgcatatcacgcgccggatggtccttgggaatgttcatcatttcaaagttataatgatcttcctcgacttccgggccactcagcacttgataccccatgcccatgaagaagctttcaagatcgtccatgatttggataatgatgtgcggcgtaccagcaacaaccgggtcgcccggcaatgtcacgtcaatggtttccgacgccaatttggcatcaataaccgcctgttccagttgcgctttgcgggcttcaatcgcggcactcaactcatcacgaattttgttggcaaatgcaccgacttttggtcgttcatcggctgcaagatccttcatcccacgcaggacgctggtgatcggaccttttttccctaatagctgcacgcgaatctgattcaagtcatccaacgaattgacttctttgatgcgctcgttgttttgttgaaaaagttgttcgagcttggtttgaaaatccatatttttcctcctcgattactgactgcaagtggcattttttatgcgttttgaaggcataaaaaaagtccctcttcaaaagggacgaagcgtcgcggtaccacccttgttcatggtcacactgatccatgcactcaacaaggtaacggccaggccggagctttctaagtgttgccacctcaaaagtcaactcggaaagtgaagacaaacattttggtaacagacgtctcgcagtcttatgaacgtcactccctgtcttaccagcctgtttgggctttcgtcatggtttttatgtttttagataaaacaagcttagcaaattgagcgctgacgtcaagagctgaattttcaactggcgcccgttaaaagaaaaaaacgcgtgaattacgcgtttttctgagtctcattggcgtggcactcttcatccgtaacccaggcatcgccccaagcgtgtgccgctgccatcaccgaattcaaagcccggcctttatctgtcagtgcatattcgatcaaagccgaatccttatgggtcaaacgattgatcaagccttcgccctcaagttctttcagacgctcaaccaaaacccggtctgaacaacgcggaatcagcttcgcaatatccttgaaacgggaattgccattgttcaataacacttccaggatcaaaccgttccatttcttgcctagaatttcaaacgtatgttgaaatttaggacaaagagcgacttgctgactttgacaatcggttgtactggttactgttgcatccactctactcacctcattattcccacttacttacatttagatagtgctagcataccacactggcaaaatattacaacccgatgtataagaaagtccagacaaaccaagtaaaactgctaataaagtcacttaattattggagtcccaaaacgatcaaaaaagtcttaggcaataagttccatgtcgtgccaaactacgcaatctccggccagctggggctggaacgctgtgacggcgctttgagccagaaaaccactgtctcaaagtcgcctaacaacatcagcgacaaaaatcggtcgctgtgttgtttccactgctgagccccatctggcctgcgattgctccgctttggcactaatgtctcaatagctctcccgaattactttgcgaaaacaaagagtgaacatgatccaagtttatgaatgtttgtttttatattgtgaacttgaattatgtcagaacctttcaaaataaaaagaaccgcagataaatatccgcggttcccgtgtggacggtggcaactaccaccatcatatcacgatcctaatttaaagcttttaagtgggtgtggatcggatgccggagcttgtgcatccatggtacgacgacctcatccatcgcagcataatcatcaactagagatacaacaaaactctccttgtatttaggcaagccaactgttgcgccccacatgtgcttgatgatgatgtctttttccatcggtgacaattcggtcagcttctcagcgttccgtaaagcaatccgaggatggataaaggcatgcgtccccaagtcaaacttggttttgcgccaatcatagtaaaacagatcgtgcaacaagcctgctcgggcgatcgcacgaacattcagatgcagccgtttcccgatcagatagctctgataggaaacactgatcgagtgctccaatcggttagaataatgatgttgcgggtgttctgccagtcgctgaacctcaggcttggccaataaatcagccacataccctacatactcagcatccgattgccaatcgcgttttttgctcaagacatctgctccttttgtggtttgatgaacacacttatagtataacagcttccacccctaaaaggcaccttcataatagattcttaatccccaactagatgaaacatcatgatcgctgcagcgaccgcaacattcaacgattctgcctgcccgcgaatgggaatgtataagtttgtgtcggtttgctttaaaagaacaggatccataccgttaccttcgttgccgacgatcaagccaaattgggcacttggctgaatcttgcgataacttttagccttctcattgagttccgacccataaaccggaatgccggcccgttgcagcgctttgataatcggcatcagcttggcggagacgatacggacgtggaattgactgccctgcatagcccgcaagacttttgggccaaaagcatcggccgttccctgcccgaaaatcacggtcttgatgccggcagcatctgccgtacgtactaaagttccgacattgccgggatcctgaatcgcgtctaacaacaaaaattgcccactcagaggctcaggtaattgttcggcctgccgtggcataaccgcaaaaatgccttgcggtgtctcggtgtcactgagatgttccgctactgattccgaaatctgggtgattttgtcataaaacggcttgagcgcgcggtcatccaaatatttttcggttgcataaatatcgtaaggcgtctgaccactcgccagcgcctcctgaaccaaatgacgcccttccaataagtaacgtccggcatctttttggtgtttcttaacggttaattttttagcggtcttgattctgtcgttcttaggtgatgaaatatattccataaaattctccttctggcgccaatgttcggcgatgtttacagttgccgacaagttcatttttaaaaatcaaactttagtccattgtcgccgcactcataagccttatgctacactagtatggactgtggagaaagcacggatgaggactttgatgctttttcacaggcagttttctcacgaaatgagcgcacctagaagctttctgatactagaagcgcgtgatagtaggaaaggaagtgtctttttggtcaaactcgctaaacaaatcgtcgtccgtggccgggtgcaaggcgtcggtttccgctgggccacgaagatgattgcagataatctgaacattagcggcactatcgaaaaccgctctgacggctctgtttttattcaggcagctggcgaaccgcttaatctggcaaaatttgtcgcccaggttaaggcaggtcctaatccttacgctaacgtttcgacttatgaagagaagcccttggaaaacattccagacttccatggttttcgcgtcaccggttgaatccgttcagcccatacagtatagttaaacccgatgacattttgaagggaaattattcatgcacaagtcgaaaaaagtatttacattagggattgtgggcttattgcccttattattagccgcgtgtgctccaaccacgaaacaaggggtcacgcttaaaccaccaacggatccattctttggcactttttataaagtcattgggctgccacttcagcacttgatggagtggattgccgggtttgtcggcacgaccagcagctacgggattgcgattatcgtgatcaccttactggtccgcttaatcgtgttaccgctcatgttacggcaacaacggaccatgacggcttatcaggaaaagcaaaagatcctccagccacaactgaaaattgtccaagaagcgaccaaaaaagccaaaaccccggagcaacaattagctgccaataactacatgcggaaaatttattccgccaacgggacgagtatgattccgtccatgggttgtttgccgatgctcattcagttgccgattttctcaggtctttaccaagccattgcgtactcaccggaaatctcgcgggcaaccttctttggtattcaactaggccactccaatttcatcgtcacaattttagccaccttgccgtatattgtggtcagcttgatcatgttgcagggcgtgccgccggaacagcgaaaagcgatgcagacaacggcctttttgaacccgatcatgacgtttattttttgtatgatgtacaatgccggcttaggtctctactttggtgctggcggcattatcctcatcatccagcaagcgattgtgacttacatcgtaacgcctaacattcgtaagcggcttgatgaagaaatggaagaaaatccaccggtcatcgttgttaatgaacatacctttgatgactggggcaaagtcactgcgacagctggtgcgactagcggcagtcaccagccggcagatccagatgccatcgaccataacaaattacgcaagcgcaacgctggtaagcagcagcgaccacgcaagtaaactgtcacgtttcttagtcgtccgttttcgcgggcggcttttttaatactggaggcgatcacgatagccggcttcatcacgtgtacggcacccaaacgttgaaagttgcgggcaatcgccaaggttcgagggatgaatgtaacttttgaccgtcaaacaacaaaatcggctgcagagacaaaatttgtctttgcagccgatttcacgtgagaagcgctaacgttttttaatcaactttgaagtcacagattacttttaatcgtggtatcgcccttcggagcagccgcctgtttggcttcttcctgagccttaagcgccttagcttttgcttcggtaatggtcggcaggtcaattcggaaaatggacccgtgtcccaacgctgaatcgacttcgatttggccgtggtagctttcaattaactgttgggcgatcgataatccgagcccattgccgcctttttcccgactgcgagccttgtcaacgcggtagaagcgattgaacacacggcgtcgatccttttcggcaatgccttcgccaaagtcctgcacggccaaagcaacaccattgccactgttttgcgccattgacacatgaatctcttttcggttagtcgaatatttgactgcattatccattaaaatgatcatgacctgctctaaatgattacgatacatgcgaacatacgtggtcttctcaagatcatcatctaacgtaaacgtgaagtcgggatggatcatccgaaagtctgcgacaacctgctgaacggttttatgcacatcgaccacggcattaggaaactgaacatccacctgatcagctcgggtcagatccaacatttcctgaatcaggctcttcatgcgggtaatttcctgcaacgatgccttcaaagactcatccaagacctcgggatcatccttgccccaccggttcaacagttgcaggtggccttccaaaatggcaaccggtgtccgcaactcatgtgacacatcctgcacaaattcactctgctgatcgatatagcgctgaatccgatctaacatgccattaaattcgagcacgaggtcaccaagctcatcattgcgtttgagcgccggtatccggacggtactttccggctcctcattcacgacatcaatagcattcgtgattaatttaatgggttttaagaagcgcgtcgccaaaatataaccaatcagaatcgaaatcaataccgccgcaaaacttaagcccacgatgagtaacgtgatttcgtgcatcgtcgcatggaacgccgttagtttattcgtcacttgtacataaccaattaagtcagacgtcgtggccgaataaattggtgcagtgcctaccagaccgttaaaatcaccaatatggctctcctgtacctcggtgccatgaaccttgcctaacgtgatgggggtatcccgtgactgaaaaatattcgtgcgatcgcgtgaaaaaaccgacacactcacatcggcctgcgccaacttttgaatcaccgaatcagaaaaaatccgctcacgtgattcactcggtgccggtaacgaaggttgatccgacgccgttgtaccttccaaccgcggaacaacttgggcaatggtcaaatcgccactgactggggaaagtcgttggacaacggtactaagcgtgtccgtgacggttcggcgctcctgattcaacagaatctgtcgcatcgcaccgtatagaatcatcgaaaaggtgacaaaagtgacaaaaatcccgacaccaaccgttacggcccatttgacctttaacgagatgcggggacttttcttcttttgcccggtacttgtctgtttaatcaccattacgagcgcatgacatagccggttccccgaaccgtctgaatataactaggttcacccggccgatcgattttgttacgaatatagcggacatacacatcgacaacattcgtttcaacatcggagttataaccccagaccttggaaagcaagacgtcacgagccaagaccacattgacgttctccatcaaagtcaaaagcaattcatactcacgcttggtcagctcgataatgtcatcaccgcgccgaacaacccggttttccttttcaatcacgagatcacgatatttgatcgtggtttgtttagcggtgttgttttcgccttcgatactaattcggcgtaacaacgcgcgtaaccgcgccaacaattcttcgatggcaaatggcttgacaatgtaatcgtcggcgccgtggtccaagccactaacgcgatcaatcacagaatcacgggcggtcatcatgataatcggcgtattcttgacctgtcgtacccgccggcagacttcaaggccattcaactctggcaacatcaagtcaagcaggatagcatcccagtcttcagccaacgccgcctcaagtccggtgcggccattgaaatggacttccgtttcgtagccttcgtgttttaattccagctcgacaaaccgggcaagatttttttcgtcttcaataatcagtattttactcatcagggtctccttatgctttcttagtggcaccacacacgcaacgcaactttattcgtgatttctcattaaaaaacgatgctaagctagtttagcacagttttctcattttggctataagccgcgcaatgatgggcacaatcgccattgaaaaaagtttgttcggtggttttctcatttttcaatccggacaggttctcataaacaggtccacgctcatacttaaccgagttacccactcgcccagcacttctctaattttattttcataagcggtctatcgccaatttccatcaagccatcagcgtacatcttttagctcagcctttaaccaaaaaagagccaatccgacatgtttgcggattgactcgatcaattggtcattaaaattttaagcttcgtggtaccaactatagtggaaaatgccatcgcgatcggttcgttcgtaggtgtgggcaccaaagtaatcgcgttgtgcctgggtcaggttggcaggcagcactggcgaacgatatgagtcgtagtagctgatcgctgcggagaaacccggaaccggcacaccggctttaacggcgagaccaaccagatcacggacactttcctgataattcttggcgatattcaggaagtaatcgtctagcaataagttttgcaagtctggctttttgttgtaagcatccgtgatgttttgcaagaagcgggcacggatgatgcagccggcacgccagatctttgccaattcgccatattggagattccagtcgtatttttctgaggcgaagcgcatttgttcaaagccttgagcatatgacatcagtttgctgaagtacagagccttgcgaatcatttcgatggcttcttttttgtcgaccgaaacgttggcaaccggctttggcaaaactttacttgctgccacccgttcctgcttcatggcactgatgtaacgagcatatacggattcggtgatcacactctgcggaacgcccaattcaagcgctgattgtgatgaccatttacccgtgcctttattaccggcacgatccagaatcacgtcaacaattggcttgtcgctgccaagatcgtccttgcgggtcaaaatgtcggctgtaatgtcaatgagataagagtccagttcgcctttattccagtcactgaaaatgtcggcaatttctttaacatccaagccaagcaggttacgcatcaaattgtaactttcagcgataagttccatatcgccgtattcgatgccgttatgcaccattttgacataatgaccggcaccatttggcccaatgtaagtgacacatggtgcgccatcgtcagcttttgcggaaatggcttcaagaattggcgcaaccagatcataggcttccttttgaccaccaggcatgagggaaggaccgtgcagcgcacctaattcgccaccggaaacgcccatgccgatgaagttaatgccggatttgtccaattcggcactccggcgcatggtatcttcaaagaaagtattcccaccatcaattaaaacatcgcctttatcaagtaacggcaacaattctttgataaccgcgtcagtgccggcgccagctttaaccatcatgataattcggcgcggcttttcgagcgaagcaacaaagtcctcgatcttataacttggtaccaacttcttatctggatgctcgtcaacaaccgccttggttttacttccggttcgattgtagattgcaacggtattgccgcggctttcaatgttcaaggcaagattcttgcccatcacagccataccgacaacgccgatttgtggtttatccattacggaaacctcctcattaatttcaacatttactccattcatgttagcagaaacagccttgatttaacagtcttcagaagccttcgcaggcaggtaaaatgtattattttcaagttagccaagttcggactgagtgacctagcaaataagaaaagcagtgccccgacctaagcctgtgagcactgcttaattcatgattagaacctagtatctgttcatcttttatcattcaggtttgcctgattcttttcagcaacaaacacacacatcacgattcatcctgatccgggaacatccccttcaactttgcaaagggattatctgccttcttttcttcttctgtccgcttcttgtattcatcttcggcgagcacttcccattcatctccggcaggcatatcaccggtggctgcttcttccggtgtgagcacttgcatcggaatactgagcaacaaatgatcctcgaccgctggcaaaagatcaagctcggattcttcgaggggcatcaggatttcaccgtcttcatactgatccgcatggccttcatcggttaaatagatttcactaaaagtaaagttctgcggcatggtcaccggtttcaggctgcgggtggacggaaccacgagcgtaccggtcagattaacactgaccagaaaatcgccgcgatcatacaacacgtccccactcacctgaatgggactcacatcaagaatctccggatcgcgatcctgcagatcagccttgacatctaacgtggtactaaagtgtaacggttgctcatcatgtttcattaattcctgaatggtccatttcaacatggcgatcctccttaaaaatacattcgaaagcctaggaccttcggataaaaaccaattcatacgcctcacatgagtggcggtcgaccataattctgttcgacgccgccaatggctgtgattaatcgatccgcacggtgggtcatggctaggaccccatccggtgcaagcatatcagcactgacacgtgtgagcaaggggtaagccaggtggtgtttgacagtgcgcagatattgccggccagtcggcgtaaacccaaggacatgcagttgtggcaggcgccgagcttttgtgacagcagcggtcgtcatattcagcgtgatggctagggcgagccgacgtaatcgagcataggtatagcgcttggacttaacccggtgcaaaaactcggtcatatcatgagcaccatcaatttgctgggtgaaccggtattccaatccctctgccatcgtcgccacttgccgcaactcagctaaatcagccgtttgcagacgatattttaaccacgggaaaaattgcgaccagccatattgcggttgctcggcataaatcgaaatcaaatctgccggcacaacacctgtgacaggctcgccttgccacaagtgttgtcgcaccgccgaggcactggcaagattggctttgatttgctgctcatcatgcccaacaccttgtcggccgaatgggtaaagctgcatcggcacctgtaatgccaaaactgccttggcataactcaagcccaacataaagtttgggtccgtctgcgtaatccccgccaccttcgcgtacgcagcattcagttgggtcgcgtaagtctgcgtataatcggcaaaacccgggtccgtgatatcagccgatgctaattgccgggcaagatctaaataatctagctcagggtgctcggttccaaatgccagtgccgatacatgcaacgctgctaaagccgacacaccggctttggcgaattgatcagccgcttgaacggcaccggtcaccggtaattcaatcacgatatcggcaccatgagtcagcgctgcctccgcacgtacccacttatcaaaaatcgccggttcgccgcgttgcacataattacctgacatgaccaccacgacgacatcggcgtgcgttaaacttcgcgctttagccaatgcaaaagcatggcctgagtgaaacggattaaattccgcaatcatgccaacagcttgcatacacacctccagaatcgtcttcgtcagtcaaatcagaattcgtttttgcctaccgcttcttggcgtgaaagaaccagcgggtactcttggccgaaaccggctgcattccaaaatcagccgtgacttcaaccttttcaaagccggtcgcctgcagcgccgccagataatcttccagcggataagtgcgctccttgtgggtttcggttagcggcttgtaagcatctaagtcctcgtcataaatgaaaaacgtcagatcgtgttcgatactatgcggtttttcaccgacaaaactgttccataaaaaagcgaagtcatcgctttgataattgtacatatagcccggaaaaacgtgatccatctggtaaagcgaatgagcatcaaaaagaaaatccccgcctgaaggcagcaatgccgccacctgggcgaagacttgcttaactgcctcaagatcgggcatatagcaaattgaatcatcaaagcaggtgaccacggggaacttcggcaagtcatgtaaatcccgcatgtcgccttggatcagcgttaaatcaacatcagcagtaagtgctttttcttcagctaatgtcaacatgtcgtctgacagatcgagatcggtgacttgatagcctgactgtgccaacaacacggcgagaaagcccgaaccaccagcaagctccagcaaaggctgattggctggcgctactcgttgtttaacgtaatcccgccaccgtaaatacagtgactgatccatcaatttgtcataaacttcggcaaaagtggtgtaaatcatgcctcaacccactgatccacgttgacaagcggtgcactttgccacaatttctcaaggttatagaattgccgctcttccggcataaagacatggacaaccacgtcattcaagtcgatgagcatccatttcgaacccttttggccttcgattcggcgaatatcgacaccggccgcttcttctttttcttcgatttcatccacaatcgcctgtacctgacgatccgaagtgccgctcataatgacaaaataatccgccaataagctcacaccgcgcatatccaaagcgacaatatcctcggcacgctttgaatcgccggctttaacagcaatttccaacattgtttttgcgtcgaccataaactactcctttgctaaaaatgcgttataagttaacagtgttttaggaaagaccaacttgcgcgcgccgatcaggtacatcaacgtattttccaattcgatacggctggcctcttccagattcgtttcagcagccttgcgcgccttggcttcgacaggcaaagcccgttgcggctcaataaaatcgccgacaaagatacattcatctaatggcgtcatttccggatccccggttgtatgccgggcaatcgcagtcaagacctgcttatccgtaatgccgacttcggtttggataaaatgaacgccgacaaccccgtgccagacgcctctgccatattgcaacaaactgggatcaaagccatcttcgacaatgacccgtttgtaggtttcgaccgggatttctttgccataatcgtgcagcaaaccagccaaaccggcacgatcaacatcttgatcaaatcgcttagccagttcaatggccgtttgttccacgcgcaggcaatgctcgtaacgcggttcgtccaggcgattgcgtaagcgatttaagatttcttggcggcttaagccgtgtgtcaagctgtcagggtactgatgttcattcacgatataatccctctttttgaatatagtcaataactgggtctggtaccaaataacgcaggctgcggccattttgcacccgttcacgcaccgcggtcgaactgatatcgattagcggggcatcgacccataaaatcggatagcgactggccggtgtataaccgcggcgtttaacgcccacgaaagtcacaagtttgaccagttcatcaatatgagcccacttgggtaaataatcaaccatgtcagcgccgatgatgaaataatagtcagtatccggatgtaagcgacgcaactcctgcatcgtttgataggtataactaataccgcctcggcgaatttcaatgccttccaatccaaaaagcggattgtcggcaatggccaattgtaccatgttcacccggtgccgtgccgagatagctgttttagtatcaacatgtggcggctgattatccggcataaagtaaactttttccaagccgagttcggtgcccgctgcctccgccataattaaatggccgttgtgaattggattaaaggttccgccaaacaggcccacctgcttgcgacgatgcacacctagaatctgttcgcgcatcgccactgagatgaccggctgagttaaggtgacactctgcgtcttttccatcgcaatccctaccgtgcgttcacttcaagactaattcggcgatgctcggttttggctgcttctttgtagacaatcaccgtgcggccgataatctgagccacttccaagccggtaatcgcggcctgtaaagtgtcagcaacttcccgcggggtatcatcggcggttggcaacaaactgattttcaccagttctcgcgtttccaacgcatctttgaccccagcgacaaacgcatcaccaagcccatttttgccaacttgaatcaacggtttggtcgtcatcgccaggctccgtaaatagcgtttctgtttaccagttaacatatttttaaaacaactcctctgatggcactttcgtcaactttgactcaactgcggctagccacatcgttgcgatcgcaatcaaacttaaataaatgcttttcgcaatagaacatccacacctttaggcgcatagcctgcgatcgtgacaccggccggtacggtaatccagccaagtccggcaaaaacgagatctgacttttcctttggggtgaactcaaaccgtaccagtggcggaaactgagccacttcatcggcttgcggtggcgcaagcaggccgccaacatgtctttggtaaaaatcatcagcgttagctaacttggtgcggtgcaacggcaattgattatccgtgtagatcacgaacgactgacggccgccgcgaagatagtcgaatcgcgccaatccaccaagaaaaatcgtctgtccttcatttaactgataggtggccggcttgatcaccgatgtcggggataccagttttaaatccttaggtcccacaaaatgtgccatctgatgccgatgaataatacctggtgtatcaatcagcgactggccgtcatctagcggaatcataatccgatccagcgttgtgcctggaaaacgcgaagtggtaatcaggttctcaacacccgttaattccttgataattcggttgattaaagtcgattttccggtatttgtcacgccaacaacgtagacatcgcgatgctctcgatatttttcgattgcgtttaataagtcgtcaacgccaaacccctttttggcactggccagcatcgtcgcaaccgggcgtaacccctgtgctttggcttgctgctgcaaccaattttttaacctgttcggattcagcgacttaggcagaacatcggctttattgcccaccaaaatgaccggattatcgccgacaaaccggtgtaatccgggaatcacgctgccattaaaatcaaaaatatcaatcacattcacaattagcgcgttgctctcaccaattgcgttcaacaaacgtaaaaagtcgtcatctgtcaatgtgaccggtgcgatttcattataatgccgcaaccgaaaacaccgttgacaataaatatcgtcttcagtgtcagctttagctaaagtagcagcaggcaagtatccgggttgttttggatctgttgtctgtaaaatagcgccacagcctatgcagcggcgctcttcatcatttttgatggtgtccatgaatatcctcctgataattcagctgccgttttttcgcaagtgctttaaaaacgaagccttcaaaaaaccgattgatccgcgtgttccacgcatcactttccaccagtggttgcgttagaatcgtgcgcacgccggcaaggttgccagcccaaatatcagtcaggagctgatccccgaccatcaccacttccgagcgttttaagtccaattccttacgtgctttggtaatccccaccggcaacggcttcaatgctcgcgccacatacgcgacttgaagcttggccattgccttgtggatacgattagcgttgttatttgagacgaccaccacttgaatgccgccttttttcagatctgaaagccagcgagtcagtttagccgtaccttccggatgatcccaagccatcaacgtattatcaagatccgtcaacaccgctttaatgccttgctgtttcagactggcaggcgtcagactgaagatattcgttaccagccaagtcggctcaaaaactgccacaaatcttgtcccctctccggttgttcatatccttatattatagcggaaaagatgcctaagcgcgaggccgtttgcctaatacctacgacgcgtccgcaatgaaaacgctattttaaaaagacgaaataatcgccttattgttgcaaacagggtacgatgaatttgaaatcaaacgctcgcattccgttattaagcctgttatacttatttttagtaagtgtttcaaaataggaggcaacaccatgacccgtttgcatcatgtctcgcttttaactggcgacgcaaccgcaactattcatttttatacaaatgttttgggcttgcggttggtaaaaaatacggttaatcaggaaaatattcacgtccggcatctgtttttcggtgattatcagggaacgcctggcagcgtcgtgacttttttcgtcattgaccggcttggccaccgttatgacgggcgcaatcaattaggcgggatcgatttggcgatccccggcgattctttgcctttttggtttgaacggctgcagcaagccggctgtgtgatttctgaaaccgcggaccgtcttacgttggttgatccttctgatacgccggttcggctgattgccttccagaagactttgccagatcatttaacggttcctaacgacatccccggcaaccgacagatcaccggcctcatcaatgttgacatccctgttgctgaccacgaagccgagaaagccttcttcgaagcgatgctaggccaagctgccgaacacgaacagtttaagctggcagcgggcaacactttgacactaaaaccgagcctgactgacgatgtcaaacgatttggccgtggcagcatggatcattttgctttgaccgttgatcacgaagaagcgttgccgcgtcttggcaccattgccgcacaacatggttatgaagttgaagagtttgccgatcgcggctggtttaaaagtctttatgttcgtgacccggcggacaaccgcattgaatttgcaacccagtcgcccggctttacattagacgagccgcttgagcatttaggtgagaaactgggcctgccgccgaagtttgaagcgcggcgggcgaccattgaaagttatttcaaaaccaaaggagtggatttccatgattgaacatccgttactcggcatgaaccacgtcaccgccatggcaagtgatcctcaagccatttttgatttcatgagcaaaactttagggctgcacctgatcaagaaaacggtgaatcaggatgctttagacacttatcacttctattttaccgatgaccaaggcactgccggcaccgacatgaccttctttacgttccctaatcaggaaaaaggcaaaaaaggcacgaatatgatttcacgggccagcttccgggtaccaagtgatgcggccttagattactggctcaagcgatttgcggaaaaaggggtcgcaaacgatggcatcagcacccagtttgatgccaaaatcattaatttccacgatcaagatgatcagcagtttcagcttatctccgatgaacacaatcatggggtcgcaggtggcactccttggaaacacaacgatgttccggaagaatttgccatcaccggtcttgggccggtcacggttacgattttcaatctcggccacatgcaatatgtgctaacggaaattatgggttataacaagatcgccgaagacggtaactggtcactctacgaagttggcgatggtggtcacggagcacaggtgattttggaacaccgcgaagatctgccaattgccgttgaaggctttggtaacattcatcacgccgccttttccacggatacacgtgagacgcttggcacgtggattgatcgcatcaagcaatatcgcctgccgcaatccggctacgtggaccgcttctacttcaagtctgagtatttccgggcagcaccacaaattcttttcgaaatcgccacaaccggaccaggcttcttacaagacgaaacttatgatgaagctggcatccaccttgagttgccgccattcttggaaagcaaacgtgatgaaatcgaaaagcagctcacaccagtcaaaaccgattggcgcggtcgttaatttgtggaggtagttatggcagaagaaaacgtcaattatacttttgtaaaaggtgaccccaccgtctcccctttgttattgctacacggccaaggcggcaatgaaaatgatttgctgccgattggtaaatacctatcgcctaatagtcccatgctatcgattcgcggacgcattcaggaacaagggatgaatcgttatttccggcattcggaaaacggcggctttgatttagctaaccttgagcaggaaaccacttggcttttttcggttttaaacgagctttgccagaaattcaatattgactataaccggtttgtggtcgttggctattcaaacggtgccaacgttgctgcgcgcgcattgttgacacggcgtgatacttttcacaccggcatctttttccacccgatggcactttcgacggttgattcccagcaagacctaagcgatgtgaaagtctggatgtcccatggtgatcaggatccgatcgtgccagcccagaactttaaggtattgaccacctatctcaaagagcaaggggcagacgtgacgattttccggcacgggcaaagccataatttaaatgaagctgaattggcaaatgccaaatcctggttggcgaatagtggccgactacaggattggcaacggaggtgaatcctatgcaacgttttgggtttgaggaatatggcaaaccaaatgtttttaaaagtattgaagcaccggtcccggagccaaaagccggacaagtgcagttgcaggttctgggttttggcttgaacccttatgacgcttctctacgccgcggtgagcaggcagcgtttcggaaagttaagtttcccgtgataccgggaacggatgtggttggccgcattaccaagctaggtgaaggcgtcaccgactttgcggtaggcgatgttgttttgaattatcgtccaatcggcggttatagtgaatttgtgacggcctcaacctctaaagtttacaaaaagccgactgcgctaagctttttggatgccgcggcgttaccgcaagttggcttggcggcttttaacattcttcactatatgttgaatctcaaacctggagaaacgctgggcgttgtcggtgccagtggtggcgttggtgccatcttggtgcaaattgccaagtttgaaaagttgcacgtcatcgccgtggctggtgagcagcatcgcgaatatctgcggcagttaggtgccgatcaaatcttcggctacaccgacgatttgccggaagatgcagccgatgctgtggtcaatgccgtgttcggcgctgccgatcatggcgctgcattaaaacttgttaagccaaacggtcagtatgtcacaacggcttatgccgatgttgatctcagcagcaaaccagacgtgacccatttgcagttaaatccgtcgaaggactactcggtgcatgatggctttgcctatctcacggatgtcgcccaaaaatggggactacaggttcgtgtcgctcaggctttcccatttaatgttgacggtgtgattgccggccatgaaatgctggaaacgcatcacgcgccaggcaagttagtcgttatgcaaggccgccatgtcatccacccgattcgcaaagacgttaaccacctgtagtgcctcaaaaaaccgcttgcgacccgccttttcccgccgtatgataacaacatgcacggaaaggcggaaagatatgaaaattgcagtctattgcggtgccaatcatggcgttaatgatgaatttcttcaggcagctacacaggttggtgcctggattgccgagcgtggtgatactttaatctacggcggcaagctaggcttaatgggtgcggttgccggcagtacgcttcaacatggcggtcaagtcattggcgtcatgcctcaggtgttagcagaccgcggcctggccatgcccgacctgacggatttggaagttgtcgcggatatgggtacccgtaaggcccgaatgattgaactggccgatgtcgatatcgccttacccggcggcccgggaacgttagaagaaattacggaagccatttctttttcccggatcggattaaacgccagtcctactgttttgttcaatcaagacggttattacgagccgctgcatcagatgtaccaaacagcggtagatcaagggttcttcgaccaggatgcatttgacaacctgttattttcatctgatctgcaggaaatcagcacgttcattgctaattaccaaccgcttggggtgcgacaatatcattaaccaagcaagcttgtatatgactcatataaaaaacacgccatttcattcaaagcgaatggaatgacgtgtctttttatatgtaagcgtaaactgacgcaactagaacttacgccagtaaactggttacatgctgattaagccaaagcttttttagcggtatccgccaaagccttgaagccgtctgggtcgctgacagcaagatcagcgagcatcttacggttcatgtcgacattagcgagtttcaggccgtgcatcaacttgctgtatgaaatgtcattcatacgtgcagctgcgttaatccgggcaatccaaagacgccggaaatcgcgcttcttggcgcggcgatcgcggaatgcatagcgatacgaaaccatgacctgcgcacttgctgccttaaacagtaaatgcttggcaccacgataacccttagcgagcttcagtaccttcttacgacgcttacgagtaactgttccacctttaacacgtggcattagaattcctcctcaaatcaaatccgatagcttattatttcatctggctgagcatctggcggatccgcttcatatctgagtgggataccaatgctgacttacgcaattgacgacgctgcttcttcgtcttgccgtggaaacggtgtgacgtgtatgcgtgaccgcgcttaagggcacctgatgcggttttcttaaaacgctttgcggaagcgcggtgggtcttgaattttggcatgtctttttcctcctctaaacatcaatgcgcgcacgactacttaaagccgtgcacgcctttgtaacattcgccgatgattatttatcggctcgcggtgcaagcattaagaacatgctgcgaccatccatctttggatgagtttcaacagtagcaatttccttaacggcatccgccatctgctcaagaaccttacgaccaagatccttgtgcgtaattgctcgaccacggaatcgaacgctcactttgaccttgtccccttttttcaggaacttcgtcgcgttcttaagccgggtattgaaatctgcttcaccaatggtcgggctcaagcggatttccttaatggtgacagtcttttgtttcttccgagcatcgcgctctttcttctgcagctcgaatcggaatttcccgtagtccatgatgcgggcaaccggtggcttggcattaggcgatactaagacaacatctaagtttgcatcctcggcaatggccaaggcgtcacgcgtactcttaacgccgagctgttcaccggtctgggagatcaatcgaacttcacgtgcgcgaatactgtcattgactatcagatctcttgctatggttgttcacctccgtgtgaatttcagagaaaaaacaaaaacagcgtggccgcaaagacccccgctgttcattaaataccgaactaatgagcctagaggtctaaagacgtgggcgagaagcgggaacttctgctttttctcaacagcaataactatacagtagcaagccgcttgcgtcaagaggggcgctatcgatgttatcgttggtaaaagggcgaaaactcaccgctgacatatcggcctagttcattatcggttggactgacatgaaattgctgagtttccggtaagtaagcttccgcaaaaccaaccaatgcgtgtaaatcagcgtctttgtcagcatcgacaaccagtagcaaactctgtgcgtcatccgcacgcatcatcgtaaccaaataagcggcgtgcacggttggcatttttggcaggtattcccgcaactgctcaacaagatcagcggtttcgcgaggtggttcactaattcgaacagcctcgccatgtttggcttgatccggctttgccacataaaatagattggcacgtgacaataccatgttttcatcatatggattgatgaccacgccgaaaatgtcgcgatcctcatataagaaattggcacaatcagcaatcgtcgcaaccgcaaaatgatcgtgatccggacttttggcaaaatttgcctgatccgtaaaaattggcaaataatcatgcccattgtcatcagtaagcatcaccacggtcgggtcgcctgtacgtgccgtcccgactggcaacataaacttggcacttttcaagccagcataaaaagccgcttgcgtgtcatcattttgatccgttcttaaaagccgcatcaaatgaattaactggggattttgaacttgtggctcattggtcatcgtcgtcttctcctttattttgctgctggttgaggttcattttattgcgaaaattccgtaattttttaggtaagccgatcagccatgacaataaaacgatgccgacactgccgaaaaccgcaacgccttgaggttgaaattcaattttgccgaaccaccaattggcaatgccatacgcggccaatgccgttaaaagcatcacgatccccatcagcaccagcaggccgcgaccacgatgggcaatgagccagcggccgcgctgactgggagtccgccacggtaacttcaagtaaaccagtagaacaacaaaatacaagctggctgccaaaacttttgtgacgaaaaataaaacgagccatgaagcccataacgcaataaccacctagtcaccctttccttgctgtctgtcgtaaatgtgtccagtgtatcatacatggcaataggcggcgaaaaagtgccaggtaattgtagcgcagcgaacaaaaagatctgagtcaaatggcgcagatcttttcggtttactttaaaggacggctattaatcgcctaaaaccttcttcgcctcggtaggcttggtcttgccatcgcgactgtagttcttgacttcggcgaccatcgcgtcaatgaacatgttaccggcttcttcttcggtatgctcatcaccgtaacgccgaaccgaaacggcagcatcgttgagttccttgtcaccgacaacgaccgtatatggaatcttcttggtctgggcttcacgaatcttgtagcccatcttttcattccgatcatcgactttgacccgcaagccggctgccaacatctggcgcttgatgcggttgacatagtctaagtgcagatcattgttaaccgggatcaaaacagcctgtgtcggtgctaaccaggtcgggaaggcacccttgtagatttcggtcagataagcgatgaagcgctccatcgtgccgacaatgccacgatgaatcatgactggtcgatgttcttcaccatctttgccaacataggtcaggttgaagcgttctggcaacatgaagtccaactggatggtcgacatcgtttcgtcattacccaaggccgtcttggtctggatatccagctttggcccataaaaggcagcttcgccttcagcttcgtagtaatcaagatgcagatcatccatcgcacctttaagcatgctctggctgcgggtccacatttcatcatcatcaaaatacttttcggtattcttgggatcacgatatgaaagccggaagctgtaatcggtaatgttgaagtcttcgtaaacgtccatgatcaggcgcagaatctttttgaattcttcttgaacctgatccaaggcaacaaaagtgtggccgtcatttagcgtcatttcccgaacacgctgcaagccggacagtgcgccggacttttcatagcggtgcatcatgcccaattcagcaatgcgcagcggtaattcacgataagaacggatatgatggttgtaaatctgaatgtggcttgggcagttcatcggccgcaattcaagcatttcaccatcgcccatgtccattggcgggaacatgtcttcgcggtagtgatcccagtgaccggatgtcttgtataagtcgaggttggcaagcaccggcgtataaacgtgttcgtagccgtctgcgatttccttgtcgataatataccgttcgatcacccgccggattgttgccccatttggcatccagtaaggcaaaccggcaccgactttaggatcgacgaagaaaagatccaagtcgcggccgataacccggtgatcatgctcagctgcttcctgacggcgtttagcatcatcttcgagacctttttcactccaataagccgtcccgtaaatccgctggagcatcggattgctgctcttgccttgccagtaagcgccggcaactgacagcagtttgaaatgcttcagatctttgagacttggtagcaggactttttcttcgaagtcaacaaagtcaccgagcttgtaacccttaatcggatcaccagcagcttcgaccaattgcttcttgaaaggatcgtctttgaagcgggcaaaagcatcggcacgactgagaacaaccggttccaaagcagcgttggccttaatgatttcttccattttcttttgaaccgttggcaaatcatcgacacttacctggccatccgcccgatcggtatcgtaatagaagccatcctcggtcgcctgaccctgaccaaaatggatatcaggatacaaagctttgagtgctgcagccaaaacaaacgctgccgtttgccggagaaccgtcagcccctcggcatcatccttggtcataatctgcagtttgccagaatgagcaatcggttcatcataagcgatcaactcgccatccaacttgccggcaaccgcctttttggccaaactgttactaatgccttctgtaatagctttcaccgttgtaccatctggaaattgtttaacattgccatctggaaacgtaatatctaatgccataagaaagactctcctttgttgttttttcgaagaaaccatccgttcaccgatgcagagacctgtgcgtaaggatcttggtcgcaatgcctaagggcacaacgcttcagttccagacactgcggcttccgcttgcgataacgcgttcgccagcccagaaacctgcgtgtaaggaccttggtcgcaatggccaaagcccggccatcacacccaaggccacttacacgccggtttctaaccgggctggctcacgctcacaaaaaaatcgcccctaacatctcctaagagacatcagggacgatttgtgatcgcggttccacccaggttgccgacagtcttgctgcgggccacttcattaacgcgtaacctgcgcaactgagcctttcggcaatctcaagaagtggttcggatcagatcttgcaagactttcagccgcggccttgctctctgtcggatgatcctttattgcttccgtcttcgatagctacattgaaccacattgcgcggctgggtgcaagcggttttctgaaaattgcgttattctttttggagtcgcacttaattagccagcggattgcggcgattttctccgccgaccgttacttcttttgcgagaaaacggatccgttccataatgcgttgggcttttagcatttcggaattaccgcggtcagtcccggccaaagattcggttaaatcggccatgcttttgttggagctaaacagcgtcggcattttttcctgcatgcggtattgcaaaatgatgccaagcacatcatcccggacccagggactgatactttcggcgccaatatcatcaagcatcagcacttgcgcacgtttgacgctatcgatttttttcaaaaccgtgttgctgccaatggcgcttttcatttcaacaacaaaggtcggaacgtgaatcagcgtcgtgccaatgccgcctttgctggcaagatcattggcaatggcaccgagcaaataggttttaccgacgccaaatggaccgcttagatacaggccttggtgaaatgttttgggatcggcgaccactgccaagacaaaccggtttgcggccaaaagcgcatccacccgctcatcggtcggatcgtaactcgtcagacttgcatcgtgaatatctttaggcatattaaccgaggtcactagcgacgcctgcttggcctcttcgtcagccgcaagctttgcatctgtcggctcataagcgacatcgatcagcccgttggcaacgactaacgtgggttgatagccgggtgccaatggtaattcaccacgggcaatcttgttccgctcactgacgaattcatagattttggccgtgccgcgatcaatcgcatcgtcagctaattctgcctcgtgttgcttaaggaaggtctggacatcaggatcctgcaaggctgctttgaccattttgaaataccgctcccgccactgtcgagagtccattaacattgctaagcgtttacgcatatcttccattagttcgtccctcccttatcaccgagttgtcgtaacttttccagctgagcagccaacgtctggcgatccgcttcgctgacctttttcttcttgggttgatagccttccttagcccaatctggcagcttttcctgccgcacacctttggattggccctgatagcgtttctttccagttgctttctgctcttcaaacgtatgaatctgctgtaacgctgcttcggggctcgtcacattagcttttaaccagctgtttgcgatcgcatccatcaaggcttgattgatactgtcattcgttcggagaatataatcaatcaaaatattaatcgtaggggcatcaaaaacattgcgttcactaaggctctgcaccgcgcgcaattcattattggccggatacatccggtcattcttagcctgtttggccgcggttaaaaactgacgcggtggcatgcttttggcccgtttcagcagcgcttcgtcagcactagccacttttggcggtttggttgctactggctgcgccttggtttgcggctgctggcgggtataactttgctcggccagccgccgcaacgcgttcaagtcgattttgcccgtcatcacatccgtcgcccgactgatcagccgcgcaaagtcaggtggttgaatcccgtaaaacccggcgatttgatacagtgcctcttggtgtttggctaattggcctgactgaatattgctgttggctaacaacgattgcaaaagttcccagtcatagccttcgccattaccaagccgcggtaattgaggctgattttgagccattgcctttttggcggcaaccaccgcacttggttccccgcttaagttgtggtcaaagcgaaacacgtccaaaaagtttgctgtgatctcctgccattccgggcggcgaaccggtttcagactgaactgtgcaaccagttcgtcataccgtttttcaccaaccttgtcataaagcaacaggcccatcaaatcatctttaaaaaaggcatctggctgcactggcggataaagttcataagcgtaatagcgtcctagggaatcgacttgcgtataagttcgcaataagccgactgcttccagtttcacgcgagccacaaagagctgatcgatgtcgatatccaacaaatccaatagccagagttgcgggcgccgatccgtcaccaaagcgcggtctttgacttcctgccatagacttagataaagcgccatggcaatcggccccacgagcggttgataaagcgagatggcgatcttttcatcaaagtcgctaaaataacctgccttggtcaacacaaagcctgcttgtggcataaacgtatccggacgctgcatagcaaattcacctcttttcagacaacggacctgagacaactgccccaggtccgcttgttttgcgctcactatttcttagtcttttccttcttcatcatatcctgaagctcttgcatgaagacggacatatctttgaactgccgataaacactggcgaagcgaatataagccacgtcatcaacatctgctagcttggacatgacatattcgccaatcgcttgactggaaacttcattttcaccaatcgcacgcaattggttttcaaccgaatcaacgatcccttgcatctgctccatggtgaccggtcgtttttctgcggcccggatcagtcccttcagaatcttctcacgattgaactcttctctggtaccatttttcttaatcaccaataacggggtttgctcgactcgttcaaaagtcgtgaagcgaaacccgcaattctcgcattcgcgccggcgtcggatcgcccgaccgccgtctgtgggacgcgaatcaacgacccgcgaactattatgatggcaatggggacattgcacgactccaccttcttaatcaaagtttgataattaattatagcacgcacacgccgcttatgataggtgctgtaactggcggatcaaggctttcgcttgggcaatcgttgcttctgattttccgttattgtcaatgacaaaatcagccatggccgctttttccgccaagggtatctgtgatgcaatgcgttctttggcttcggcttctgtcagaccatcacgggccatcaaccggtccaactgaaccttgggatcaacggtgaccacggcaacaccatcgaatgcatcggcataatcggcttcgtaaaggagtggaatgtcaccaaccacaatcgcagcaccgccagatttcgcctgtgctaacgcttgattaatcgccgcgcgcaggtatggtcgattaatttgattcagcgcctccaaacgccgcggttgggaaaagacaatctcaccgagcttggcacggttgagtttaccgtcctcgcgcagtacttgtggcccaaatgcctggacaatacgggcgagtgcaggccgaccgggttcgacaatccggcgcgcaatcacatcggcatctacgactggatagccagctgctttaaagactcgactcaccgttgattttcctgaggcaataccgcctgtcaaacccaataaataggtcatgccggacgcctcctttgatgcagaggttggcagtggggacaataatgggtaccgcgttggccgactttgattttaacaatgagtgtgccgcagcgatcacaaggcgtcccttcccgatcgtaaacatgtagggcatcttgaaaagagccgcggttgccttttgcatcaacgtaggtatgagcactggtgccgccagcagcaatggccgcatctaactccttgataatattgtcatgtaaggtatgaatttctttttttgtcagcgtatcagctggctgcaatggattcaaacgactcaaccataaaacttcgtcggcataaatattgccgataccggcaacaacggtctgatccagtaacaccgatttgatcgctttatgatggcgttttagtttttgggcaaacgccgcctcgtcaaacgtcgcaggggtcggctccggccctaattttgccaacgccggcaccgattgttcctgaccagtatgaatcaagcgcatgcggccaaacttgcgtaaatcccggtagcgcagttggcttccatcctggaacgtaaaagtcacatgatcgtgcttgtcaaatggcgtatggccatcgctaacaacgtaatagcgaccttccatgcgtaaatggctgacaatggtttcaccgttgttcagccgaatcaacagatattttccccggcgatcgatcgtggtgacagcagcgccgacgacttctttttgaaaagtcggcaagccattaatcagaattttcgcccaattcgtactaatggcggtgatccgtttgtttttgataagtggcaacaatgaacggcgaaccgtttcgacttcaggtaactctggcattcccgttctccttatttcgcatcaaaccaagtcggaccgtaatggctatcgactttcaacggcacgtccaattgcacggcagaatccataatcttaggcacaagtttgccaagttgctccatttctgcggtaggagcttcaaaaatgagttcatcgtgcacctgcaacagcattttggcttgcagatgggcatcggttaacgctttttgcatgcgaatcattgcaactttgataatgtccgctgcactgccttggatcggcgtgttcatcgcggtgcgctcagcaaatttacgtaaattaaagttacgtgaatgaatttgcggcaaatagcggcggcgatggaacagtgtctcgacgtaaccgtcttcgcgcgcctttttaaccatattggccatgtaatcatgaaccttaggatactgctcgaaatagccatcaatgaaagctttggcttgcttacgcgaaattccgatattctgtgccaggccatagtcgctaataccataaacaattccaaaattagttgccttggcttgccgtcgcatatccggcgtgacttgatccggtgaatccaagccaaaaatcttcatcgctgtgttggcatgaatatcgacgccatttttaaaggcttgttgcatattttcgtcaccggaaatatgtgacaacacgcgtaattcgatttgcgaataatccgagctgaaaatctgccaatcaggatgggatggcacaaacgccttccgaatgattttaccttcgtctcgcgctggaatgttttgcatgttcggatcgacggagcttaaacggccggtctgggttaaggtctgcaagtaacgggtatgaatcttgtgatccggcatttgtgctttcaataaccccacaacatacgtcgaattcaactttgcccacccgcgataatccagaatatcctgaacaatcggactggcagacttcagctcgtttaagacatcgacactggtagaataacctgtcttggtcttcttgatgaccggcagattcagcttttcaaataagatctcacccagttgcttcggtgaattcagattgaacttaacgccagcctcaccataaatcttttcttccagcaccttgatgctttgtgaaaactctgtacccatatcttttaaggtctgggcatcaagcgtgattccctgaatttccatatctgccaacacgcgcgccaatggcatttccatgtccgtgaaaagatcggtctgttcctgtttagccagatcttcggttaagtcgggacgtaacgcaaagagtgccattgacttgcgggcaaattgggcaaatagctttttatcttctggtacttggcgcttggctcctttgccataaacatcttcatcccgcggcaggtcgtgataatcatggtcttcggcgattttgcctaaatcattgctattttcgtccggattgatcaagtatgaagccagtaaaacgtcaaacgcgatgtccggtaactctaatcccaagcgatgggcagccacaatgttgcgcttgccatcgaacaccgtcaaatcccgcttcgaatcacctagccatttggtcacttcgggaatcgtcagcaaggaaacgtccgtgctgacatacgtttcgtctttcgtgccaataaaaaaaccaatctggtcggcaatatgataattgtcgtccaacatttcgatttcaaaagtgattggttccgtgattttcgtcagggccaaaatggacttatcatccagcaccgaaaaatgaaccggctgcgtaggtttagccacatccccgccgatctttttcagtaacgagttcatgttcatcttggtataaaattcccgcagtttggctaagtcaggtccagaataagtgacatccgccaagtcgactgtgacgggagcatcgcgatcaatcgtggcaagttgcttactgagataggccttatccttatcattgatcaggttctctttcaacttggacgttttcatcccgtcaatattcgcataaaggttgtcaatactgccatactgcttcagcaatttcaacgcggtcttttcgccgactttggtaacccccggataattgtcagaggtgtcacccattaagcctttcaggtcgatgatttgtgtcggcgtaatccccagcttttctttaacatgctccggcgtatacgcttcaagttcattgacgcctttgacagtcacctgcactgtcgtctggtcggtggtcaattgggtcaaatcccgatcaccggtcacaatcgttgtttgccagccagcgtcatctgcccgcttcgccatggttccgatgatgtcgtcagcttcgtaatcttttaattcataatgctgaatgcccatatcgtcaagcaattctttgatgtacggcaactgttccaataactcgcttggcgttttggctcggccactcttataatcagcgtacttcgcggtgcggaacgtggtcttaccggcgtcaaatgccaccagtgccgcgtcaggttgaacagacttcaaaacaatttccagcatgttattgaacgcgtaaatcgcattcgtatgcagcccatcctgattggtgaaccggtcgagctgattgtataaggcaaaaaaagcgcgaaacgcaatcgagttgccgtcaatcagcaataatttagtttgactcgtcatatatgagcttccttttcttctcagaccacctctgaagatgtcatgagttaattgtcacaatcattgtaccaaattctaggcctttttggcggatgggtcatatttggcggttcgccactagcgttagttttgggtagaaaaaaagccggcgttcagccagcttttgaatacatttaattattattgttgccaacgcccagaatctgcagaatggcggtgaataggttcaggaaatcaagatagagcatcaatgctccgacaacagccagggaattttctgaaattgccgcctgaccgtcactgccggttgtcaggtacaggttctttaaacgctgcgtatcccaagcggtcaagacgatgaagataatcaagatggcataggagatcagcatctgtaaacctgtcgaacccataaacacgttgactaaagacatgatgatcacgccgaacaacgcaacaaaggcaatgttaccggctttgctcaaatcacgcttgccaaaatggccaaccatcgacatgacgaggaagaccaccgccgttgttgccaaagcaactgccaagttcgaagtccgtgcgaccattgcaaccattgcaaatgtaaagccaaagcttgcggacatcagataaaacatcaacgttgcgtaacccggacttgcctgtgcccgtcgtcctgtgacaaagaaggataaaatcagcggcaaagcaagcataatccagaaaacaatcggatgtgcacctacaaagttcgtataatctgctttaaaagtaactccaagtaaataactgacgagcgccgtcacaaccagcccgctccccatcaaggtgtagatgcgggagaagaactgcgtcaagccggcctcgttcacaacgcggcgttcttgcatattgcgttcattcctttcaactatctgtatctattataactgctattgtagcatttgtcagtccgaccaacgaccgatcttgtgctgccgggtttgatgactgataatgctctcaatatcttgaggtgcagtgattttattgtaacttttaatgacgcagataaacagcaaaaagcctcctcattcactctaaaacgagtatgagaaggcctactttcttaacttacggcaatgattttcaaactcactcaggcaacttcgtcattgagcagagtcggtgaatcagattaccgtttgtggcgacgaattgattggattttcttgaaaacggcataaaggctgatacctaacacgatcccaccgatgagaatcaagtaccacggtatcgatgctgctggcgtctctggtttagataactcacgtaacttgtcggcatctttcttggaaacggtaaatgtccgcgtcaggttccacgtgcgcccgcctcctttggcaaccagcttaagtcgatattttcccggttccaacgggcctttaccaagattaagcttgaaattaaaattggaattcggtgccatgttgatacgagttttttcggatcgataaagcgccttaccgcctgattggcgataaagataaccgctcacgtgcaaattgcgcaggatggctgcttcaaagttctggatattagcaagaattgccggctgaccgtgatcgttatccgctgccacttgtcgcaatttcaaatccggtacaaccggctgatcggattccgacaacattaagccgaccgcataaacatagcgattggttacagcgcctttttcgttgcctttatcatcagacttggccttgaattgcaacccgccaagcaccgttcctgagaaaggcttggccggcatttttaagtgaatcttaaccgtttgttggctcaaggcaggaatcgtcacctcagccggcaacgtcacaatttcctgcaggttaaccggtaaagtcggatcagccggtttaggagacttaccatattcaacgaccccgttatcattggtaaacgctgactgggcagccagtaaaactgtcaaaggtgctgtgttgcggttctgaatcacgacctctagatcctgctcctgattcggcgagacccgcaaatcaaaatatgtctgacttgtatcccgctggtttgccggtaaaaccgttttgacggtaaagccggcatcatcagcagccaacacctgttgtggccgcaagacaatcccaaaagcaatcaatcctatagccaagctcaaccaaaaccaatttttcttaatcatttttcgtcttgaaaccagcccaaaaggtcagctatcacgccacaccaacactcagtttgccaggcactgatatttgcactgggtcttatcctttctttaaagttaatcgatccataacctttttccgaccatacaaaacactcgcgatcaagagaatgccaatgccgcaaagcaccagactatttttgatccattcgtttagttttggcaggtatcgagcatccccgctctcaacgctcaacggagacgatccacgatcaggcacttttgaactcttaatctgaatcgacttaaagtcaggcagtggcaacgacccgccgcgttgaccggtcggttcgataacgatttgaacgcgcgcttcggtttcaaaggtagctgatgcagtaacctgcccgggtggcatgctcaccaagaaggcaaagatgacgagagccccgctgatacctttcttcatcatcttgattaaatcggcgcactggttagcgtccatgtcaacttggtggtgaattcagctgacttcaagcccttcgttgtgtagctttcagccggaacggtcaatgaaacaccttcccctgccttagccggattaaaaaggttaataaaggttcccttagcgacatccttgtcgttgacggccaaaacgtcagtcgcttggccgtcacccatataaactttaatggccttacttaagccaaaatggttgctggcatcgcgagcctgtccatccacaacactgctttccagcaatgtgatgaaagcattctccagcttaactgtctttccttggctatccttttcgtctgacttcagatcggatgccgacaagctgaccttccaagcgtctgcccccagccgcttatccgtcacctggaagcgattaggcaccggaatcgttttgccatcctggcctgtccactgatcaggcttagcataaactgttgtcgcaacagttggatccaactttaattggccaaagtcaagttgcgacacatagtctaacgttaagccttcaccacctgcatttttggtattgtcgccattagctaccgtacccggcgtcttgtctttggggttaagtggatttaaaacccgagtcggcgcatctgattgcataatcttgacgctgccgtcagttgtcaccgtgcgggcgtcgtcggcatggacaaccgctgagttcgctgccatccccaccgtcaacgccgcaagcgccatgaactttaattttgtgtgtgtcttcatttgtcatcttcctcctgaataaattcttcacatctcagactggtgtgtcgcctaacgtccattgcaatttaaaatcataagtgtcagccgaaaaatcaaacatattctccggaatgcgtagcaacaaccctgcttgcgcatcataggtaaagctatgatcgatttgtgctttggaaactttcttaatccgttgattcgtacccactttcagcggatattcatgtgcatcttcacggaaaaacaatagcgattgcttaaccgttcgctgcttgctgtcggtcaatggcgactgttgttgaacatcaagcgtccaacttgtctttcgactccgaccatctctgactttaatcgtcatggttgattgatcgcctactctagggacttcaatcttctgtccgtcaatccggacactaccaaaatcaatcactttaggcatttgaacgaagctgagactgccttcagttacttcaataggaatttcgtatacataggcaatccgctgactaacattggcaacgctggcttggctgactttgagttgaatttgctttttcccgacagtttttaagtcaggcatgtcaattgattcaatcttcaatgacacctgttgcttgccaacttcatttttaatgacctgttcgaccttcgacggatcagtatggttttcaaatgttaatgctgggaaaactatttgattcaaatctaacaactgatagcccttattggtgacttcaaacagccattcctttttgttttgacgtttgggcatattttgggtaacaccgttttccatccaacttactttgttttcaagatgttccacagcgagcacatcgccgggtttagtcgcggcaatccgacctttaccccactgatccagcagctgttgctttcgagtatcgccatttgctgtcatttcggcagcaagctgtttgcgatcatgtacggttaacatggtacccgtggtggtataaagagacgtgctgagatacttctgctttggaaagatactgtgaacctcgcgattatcatcatcgagaccatccgttgccacgatttgcaactgattctgctctttaacaagcgccaagacgccgccagcatagcgcggtgtcatttcataacctttgatcgcaatcgcattcccataaccaaccttcatggtgttggtggacaagacgctcccagtgctggcatcaaaacgcatcgtcacatcaatgggattaccgattttggtcaagcgctggttcttaggatttaacaacttatcaatggcttgcggccgattaatcgagagcttctgatcaccccacttgatgtcgcggtcatcgtactctttagccgacgcaagcatcgcacctaatttcgccatcgtgacagtttcacctaaattgaaggtgattggctgagtcgcaaaagtggctcgtttcacgacttgaaccggcacgtcataggtggcttcaacttctttaccactcattaatttttcggaaacgactacttttgccgatgctttgccgactttaccgacgtcagggttactttcataacgtttgattgccagcttggctttggccggtaatttaaagaattcacgcaaccgtagatccatttcatcttgagtggcatgaacaggaatattgacactttgtggttttaactgattcacctgtagtggtcgataacctttatcggtaatctcaaaataaagctccttgggacgattaatccccgtcaattgctgttccttagaatcctgggtataaccgattttacctgcttcattggccactaagatgacatcacccggttcgaccggcaattcacgattgttgccccacgcgttcagaaagtcttgctttttagcatcaccattaaaccaattgagtgattcttttgacagattcttggtagatgactgtttcatatcaacatgagcaatcgcagcgtatggctttcccttaaactggtcattgagtgcgttattatcattagccgcaccagaagtggcgatgacttttaagccatcatcattcaacaacacataggcaccaccggcatcacgcgattgaccagcttcgtcaccctggccgcgaatgacaatggcgttaccatatgtcgccgttgccgtctgcgtggattgaatgtgacccgtattcgagttgaatagaaacggtgcaggaagcttctgaaataggacgtcaatccgcctagtcttagcattcagcttgtcgttgattgcctgcggtagcaaaagttcgatttgatcatccacccatgcaaccggggtgccatcaatttggttggcgctgacaaacatgcgttttaaatttttcgcccgccactgttcacctaggacaaaatgaccgtccctagctttaatgtcgccagccggaatcacatttaattcgacttcatagtcaaaatccgcaacgcgatcttcttctaacacttcaaaagtccggacaaatgctttggttttaccgggcttgctaacatccggtcgcgttctaaaccgcttagcaacgatattgtatttaatgccgagtgctttagggaacgttgcatctaattccgcatcagtggcattttgtggcacatcgacaactctggtttcaagctggttcactttcatcggtttaaacccttgtttcgtgatttgaaagaaaaccgctttcttaatattgggatattcagcttccgacaacgtatgcacctgtgagtctttggcataactgattttgccttcaacattttccactttaatgatgtcacccagctgaacgggttgcacgcgattcaaaccccactgattcagaaaatcctgcttcttggtattcccggtggcaccagcagtattgtcttgaaaaaagcccaaattcaaaaatttgtgatcccgcatcgaaatatattcaaaccgaccataaaattggtccccaaagtttgaattgatttttccattgtcactactaccgccagatgtggcaatcacttttaaaaccccatccggatcactgtcaaccaaggacaaaacgcccatggcattgcgatttgctgaggtttctcggccattaacaataatggcattaccatatttagcagttgccgagccaacgcccgtcactttgcctgtgcgcgaatgaaacagcaaatcaatctgttgcttgttatacaacacgtcaattcgcttattgggttcattcaaccccatttgccgtgtcgcgctctgaaccttgtcgggaattgttggccaaatattcgaattggaatatgggacactggtgccatcagcttcataagcacccttcatccaccgtgatcttgtctgggtactaaaatactcacccagtgtaaacactgcatcctgtccctcaatccttgctccaggcagtagcagtcttgctgataaggcagggccggccgttttgcttaaaggcaccatcgctggttgcttcagcttgccatactgtgtattcccggccatgcgacgatcagtggccttaaccgtattcgcaatccggtccctaaaccgcgtttgcacgttgtcttgcttcccaaaagcaaaaaatgcgcaactgatgcatacaccggtaaacagcgctaatagcacgaaacaccatcttatgtgctttgacggcacctttatcactcctttcataatatccaattgtgtaacactgaatgttacaaaaactaattttatagatcttggtgctctcataaatttcacatttttgggcattatgatttttggagattctgattttggcttttatattgttttatatttatcgtgtatattaatttttgctaattaagatcagttactttcgttgtaaaaacggcttcttgcatcaattctattttattttctaaataccaaatattcatcttccaattaacctaaatgccataaatcattaattgaaagcggatctgagcttcgtccttgccttttcaaaactggctggagatggcagtttgctcgcgaatgatgctgaccagcaaagacttgatttgatcaatatcgtaagttgtttcaatttcattgattcgataatgatgcttagcggcaatagcggccgatgacgttttgaaactggtaattagtaaatcatatgtcgccggtgcctccgcaatttcaaggacaaccgagcacatgcccgccaaagccagttttaagcgcgccattaccgcagatgtcgccaaccagtcgtcgttcagcagaaggccgattcgaatcggtttagcgatttgaacatgggtcaccattaaaagtcgcacataatgctgcgttaaaaaaagccgtttagcaggcgcagcgcaacatgggtcatccttggccacaatcgcagtcaactcactggccaatgtttctaaatgttgcaactgctgatcactgattaatacccggtcggctggctgagccaataacctaaagtctccttggaaaaactgaattcgatgatgtaattgatttaatgtgtactgcatgcggatcctggaagcatctgaacactgcgtctcaaaacccgcacagatttgccgcaacgccgccataaaatattgattccgctgctgcacagtcggtaaagctagtgccaaatatttttcaacgtgacgaggatcagttgctgagaaatcaatgatgtccatcgaacaaacaaaaatatagatgttatagacttcaaattcatccaaagccagcgcatattgcttggcaatttcaaatagccaatttctaatcatgtgataaagcggatttacttctagctgatgaagcgtttcttcggggatgccggtaaattttttatcaccggtaaaatggcgtttaagtgcaatgtccagccaaacgcaaagcttgatttcaccatgaggagaaaatttaacctttgatcgtgcttcgaatctcttaatgtaacgccgagccgaaaaagttgccgccaaagctgcaagttcttcgctatcatagctatttaaaaccaactggtaatataaatatcgaatctcaacctctgagccaatcaacgtgccatttttaattttgatcgcatgcgacttcaatccgagatttaattgtttgattttgcgaaacacagcggctttgctcatgtacaactgcgcgacgaactcgtcaacccgacattttcctttttccagtagtgttgccaagatctgatattccttcgactgtcgcaaaagtttccggtacaagtcatcaaacaacaccggcttttgcgtttccaaaaagagcctgcgcccttttccctcgttgcattgtctaatttgagctgcttcgtcaaatgcctgcagccgttgttgcaaagacgccacagtggcagcaagtgtacttggtgtcacttgtagactttcgagtaatcgggagtaagaacagccatgcgttccggctgtcaaaagtaactgcaacagcttcacatctctagcttcgttgctttcaataaaatcatacaaatccatgccattcgcctcgcgatcttaccattggattattctaagttatcgttcatcaatgtttcatcatgttaacatgacagtgttatcatgtcagcttgtttttttagtgtcttttatccgtagaatagacgtttctataatttttgtaattttaatatgacttttaatccaaataaaaacccaatataagcagctggtctttgcgtaagacacagtgcctatattgggacacatcaacaaaataatggattaaaatggtttttcgatgttctagtcatttagtgaatgattcttcattgagtaacgactcataagccttttcgtacttttgaatatcgccggcgcccataaagacaacaaccgcgtgatggaacttgagcagtggtcgcatgtcttcctgatggatcaccgcagcgcctttgatttgggccacaacgtcctctgaccgaatgttgccatttttttcacgggcagaactgaaaatcggtgtcaggaacgtttgatcagcctggctcagcacttgaacatattgtggttcgtaggctttggttcggctataagtatgaggttggaaaaccgcaatgatcgctttatcaggatacttttggcgggccgcatccagcgtggccttaatctcattaggatggtgagcatagtcgtctacaatgatcatatccttgatatccttttcggcaaagcgccgttttaccccgccgaagtttcccagttcacgggcaattaacccggcatcaagcttctccatatgtgcgactgcaacaacggccaacgcattgaggacactgtgttcgccaaacaatggaacaaagaagtggccgattagctgatcgtggaaataggcatcaaaactgctgcctttagtgtcgcgatccacgttccgcgcctgaaaatcgtcccgatcactggtgccgtaataataaaccggcaccttagcctttaatttgcgcagccatggatcgtcaccccaggcaacaattgctttttgaacctgattagcctcagtttcaaaggcatcgtaaacatcttcaaaaccgtgataatagtcgggatgatcaaagtcgatgttcgtcataatcatgtaatcaggatgataagccaagaaatgccgccgatattcgtctgcttcaaaaacaaagaattttgaatcgcgcacgcctttgccggtaccatcgccgatcaaataactggttttggcaacaccacttaacgtatgagccagcaaccccgttgtactggttttaccgtgggcaccggcaaccccgatgctggtataacccttaatcaattggccgaggaactcatggtagcgataaatggtcagccccatcgccttggcctgcttgatttccggatgatcgtcggtaaaactgttgccggcaatgacggtgtagcctggcttcagattggcaggatcaaatggcaacatggtgattccggctgctgccaagcctttttgtgtaaatgtgtactgggtgatatcactgcccaacaccttgtggcccaaatcatgtagcaccagtgccaacgcactcattcctgagcctttgataccaataaaataataggttgcctctgtcatgacgattgttcctctttctttgcttgtgtgtaataaacttcacgcggtttggcgcctttagctgccgacaccagatgccgagcttccagtgtatcgatgagatttgccgcgcgattgtacccgattgaaaagacgcgctgcagtttagatgtcgaaatgtggcgttcaccagccaggtagtccaaaacatcgggcataagctcatcttcatgggcattgctggcttcggcttcagccgacttgacaagtcctgctggatcaaataagtaccgcggtccttggcgtgccttcacgtaatcaacaatactatcgatttcccgatcgacaaacgtaccttgcagtcgaatcggctgactggcaccgttgcctaagtacaacatgtcgccacgacctaaaagccgttctgcgccagcggtatcgataatggttcgcgagtcaatttgactggcggtcatgaaggcaattcgcgttggaatattattcttaatcgtaccggtgatcacatcaacactaggacgttgggtggcaaccagcaaatgaatacctgccgcacgcgccttggcggtgatccgcgcaatatcgtcttgaatctcgctaccagctgccaacatcaaatccgccaactcatcaataataatgaccaaatacggtaacacttggttatattcctgatgacgcttagccttcgcattaaattgttccagattacgaacgccagccgctgccagcttcttataacggtcattcatcgtggtaacaacccactttaacgccgcgctggcagctttaggatcggagataaccggcgacaccagatgtggtaagccattatatccagcaagctcaacggccttaggatcgatcaaaagcaaacgaacttgctggggtgtggctttgtacagcaacgaaaccagcaagctattgataaagaccgacttgcctgatccggtcgcaccggcaatcaacccgtgcggcattttggccagatttgtgacgactggctgaccaaaaagatccaccccaagtgcaatggtcaaaggcgattttgcttgttgaaaggcgggagtatcgagcacttcccgtagcatgaccggtcgcggtttcaaattggggatttcgatgccaaccgtattttttccgggaatcggagcttcaatgcggatgtctttggcagcaagtgccagtttaaggtcatcattcaagttggtgattttgctaaccttaaccccgcttgccaaactgacctgaaattgcgtcacggtgggtccgatggtatgagcgaccacatgtgcgtccacgttaaaggcttgaagcgtttgatcaagtcgctggcgctgttgcagcacccagtcacgctgggctgcctgatcagccacgactggcggtgaaagtaagcgtaatggcgggatggtctctgtggtggcatcatctgcgctaaccgctgtaacggggggttccgacgttgtcattgacgcaggcagcccggctgttcctgattgcgattgtgctgtagacgcctcgcctgcgccgcgtgcttccggtattgacggcgctgaccgtgcactttcggcatccctgcttgctactgacttcgccttttgtgctgctaacgccttgcgtagttttttggcttcatgcttgcgtcttaacgcctcgattcgggcagctttgcggctattaggcccatgcggtttcgtctcctgcccggcattggcggatgacgtctttggcattgatgaaacttccactgacggtgcagatttaacgtcttcttcagtcgtcgcttgcacctctgcatcagacgccggctgcggctcaactggttcggcaatagctgctacaacggcatgcggcttctgcggttcacttgcctcatgaacagccgcggcttggtcgcttgcgactggttcggaagcagttgttgaagttgccgctgacgccccttcttcttcgctaacagattccgatgttgtcaccgcaatcgctaatgaatcagcttcaatctgcttacttggcttggtgccatgacccacaaaaagataaacgctttgctcatccggccttaaagcagtcgcgatcttctgatagtcaatccgctcttttggcagggttcgaaccgtactattcggtgttgtgagactcgcaattcgatcgcgatcatgtcttggcaacggatggctcatggcccgcaaatctgcctgtgcttctgcaacttttcgcggattcaccggttttttcggcgcgtgcgccagctgcggcggcaagtgatatggctcgtcttgcggctgcttccatttcgaattcgttaattcggattcaggtgttggcaagttattttgatgtaaaaatgccggcccatcataatgtgccatgattgaatcccctttttatcgtgttttaacggtgtctccattttagcatacgcaccggttccccgaatccttgatctataaaaataatcttttcctcataacgcgctcacaaaaaatcgactcaagcatcattgcacttgagtcgatttacaatctaccttgaatgttctattaggcttgcgcagccaccactttagcggcttctttagcatcaaacggagtaccggcagccagctcatctggcatcacaagaatgccgcgtcgttgtggtgcccctggaatggctaattcacgagcactgctgatcatgccgtaagaggcaacgccacgcaaagagccgggccagataatcttaccatctggcatcatggcaccaggcagcgcgaccacgatcgtttgtcctaaagccgcgttgggcgcgccgcaaacaatctgcacctgcttctcaccaatatcaacctgcgccacatgtagatggtcagcatcaggatggtccttgaaatcgacaattttgccaatcacaaacttgggcttgtcatctgcttcaagctggcccggtaatcctgcttcttgaatagcagcatttagtttcgccacttgttctttggtcaacttaacctgacctttgcctgttaaagaacccagccattgactgaccttgaaaaagttatagccgatcacctgattttggtcatttaagatcgccacaacgtccccattttgctgcgttgtctgtgtcgcagtatccggccctgtgatcgcaattaacgtatcgccgaatgctgattgattataactggtaataagcatgcgtacctccaaaattaatgcaagccgttgataaagtcctcgacttgttgtttcgttttacgatctttattgacaaaccggccgacttccttgccgtcattaaaagcaataaagctaggaatgccgaagacacccatgtcctgggcaacttctaaattcttatcgcgatcaaccgcgacaaattcatagtctggaaaatctttttcgatttccggcattgccggtttgataaagcggcaatccgagcaccaatctgcagagaagaacagcattttcttacctggttttttaacctcatccaaaattgctgtattcgatccaagttctttcatagccaacatcctttcacttactatttaaaagtaactataacaggaaaatcgcattggcgcaatgtcatttcatattagttacattatacttaagttagacgtttagccacaagctgataactgaaaaaagtcgtcgcatcttttgcgttaaggagggctatcatgcgagtttcaaaattaagatcgtcttttgctgtctggctagcaaccggcatcatcacagcgggaacatcggtgatgattcatcaccgactttattaccgaaccatccctaatcggctcctagccaacattaaagccggtttcgcaaaccgcggaaccattgagaacagttggattgccatgtatccgacaacgattgaaacgcctagtcagcaccatatccgagtttatacaggtggcctgacgatacgtcaacaccatacacaccaacaatttgaatttgaggtacaacccgatggccatttatggcgacgccaccaacttcacttggttgaaaactaaaaatgcgcgactaactcgtaaatccggccgccgtcagcactgaacttctcctcatactcggttggcacattatcggtaacgcgcttgtcgtgatgaagatcaagcgacacgaggtcaaaggtcatgccaaagttattcatgctcaccaacgaatattcaaaaagcccttgattatcggtcttaaactgcagcaacgcgtttggtttcataattgcttgatattgccgcaaaaagtcgtgataagtcagccgtcttttttcgtgtctggtttttggccatggatcggaaaagttcaaaaacaaaccgctaatttcaccatcagcaaaataatcagttaaatcggcgccatcgcctaaaacgagctgaagattaggcagttttaacgccacctgcttctttagaatcatggcaatggccgcctcctgcaattccaaagcgatgaaattatattccggatgggcttgagccatggcaacaataaactgccctttgccagagccgacttcaagatatagtggctgctcctgagcaaatcgtgtctgccactgaccgggcattttttctggccgtacgaggatcatctctggatgagcctcaatcaatggtttggcccatgttttgttacgtaatcgcattggtatcgtttccttatctttgagtattgtttaatgcggtgattttttgagttaacttgcatatttgtttagggctggtggctgccgtaacgcgttcgccagcccagaaacctgcgtgtaaggaccttggtcgcaatggccaaagcccagccatcacgcccaaggccacttacactccggtttctaaccgggctggctcacgctcagttctccataacgcgttcgccggcgcagaagcctgcacataaggaccttgaacctgaatggccaaagcccagccattcaggttcaaggcctcttatgctccggcttctaagcgcgccggctcacgctcaacaaatcaaaagacccgcgacaaagccattttgccacaggccttttgatttgctacttgttgcaccacttcaatgtgtggattgcagtacttcgaactggcgcagggcttttgccacttcatccgatcgctgatgtaacgcagcggtcttcatatcgcttaataagtgcaggtcactgtaccaataaagtcgatgttgcaaatgatcatccatgtttgccccataagccgctaagaatgccggccatgtgtcgtggttgccataatgcgccatgacgtcggcaagatcataagctggatcgcccagcgccacttgctcccaatcaactaaatacaggcggccgttcgctcgcagccaatttttgtgattcaggtcgccgtgacagacactttgcacggtcacccgcggcacccagcgttggatctccgccagtgcctgctccactcgcggttgggccgcgagattttcgggaaagttttgcaacaacgattggcgtaactgatcaggatccaacacctgaccgccaacttggcgaagcattcgctttaataaacttgagtggtgcacctttgctaacatgctggcgacgaccggctgcatcatttgctcgcgggtcaacgtttcgccgtctaaccattcttgtgcggttagcacatcgccggtactgacccggcgcgtccatagcaaccgcggggtgatgtgttcaactgaaagtgccgcaagaaatggtgacgcgttacgtttaaggaaatatttttgattcgcataaaccccaagaaacgcacttccggtggaaccgcctgcaggctgcagggaccacccggcatctaattcaaactccataggcactactccttatatctggccgcaggaatggttctagtcatcaaaaagacactcccaggcgctcgtgcgtccacgtttcatattactaagttgcgatttacccgtcaagactaactgccaattgcagctgacctgacgaaatacgcaggcttttcattttccaccgaacgtttttgatttgacttagagctgtcagccaaacaggattaaatcatgacgtgatgctgttttaaccgcatgcgcgcataccagcgggtaaatgcccagacgaaaagtcccccgccgatgaagattgacccggctgccaaccattgcaaccgaacaagtgtcacaagcgtaaatgtcagtacttcaatcaacagcaaaaccgttaacagctgctcaaacgcagccggcttctgctcaggcgccacgggatacaaatgcacaaagacaatatcatcatactgataataaaacggtaacagttggaacccgaccatgtaaagaaacaagatggcaaagcccagcaccagccaccacggtgacaaaacggccacgatcacggcaccgatgacgagtaatcgcacatacaaaccaaggtattcgccgccgcgcaaaaagccacgcaaatacaggaatagccatgtcgttgcctgctggggcttgaccagtttcaacaagccatccagatatcggcgtcgatggacactgttggctaagccaggcacatcggtaaagagattgtaaaaccgatacagccgccccattcgtgcctcttccaagctaattaaagcggaaaaattcaattgtccttggtcaagcaccgattttaactgccatctaaaaacaaggtttaggattaacgccaccaaaagtgttatggcaggatgaacgtaaaacccgccaaacaaagcgatgaacgcaatgccaagcaataagagccgctgatgatgccagcgaatcggcaggtggtaccgctgtaaaaattgcagccacaaatcaagatctttaaacaaccacaaggccacgagcaatgccatcgttccgcttgccggatcttgaccaagctgcgcaaataacggccacatcgctaaactcgtaaacgtcaacaagacgccaggtaggatcatgctataatggcgtgccttcaacaaataagctttaaaggcttcggcttttggcaacaagaaaatttgatccggtgcttccgcaagcgtggccagctgaccaaggctcagaaagccggtgaaaatcagagccagtcctaaagcaagccatccagaaggttgcagggttttaacaatttgactatatgcataaagcgcaccgccaaacaaaatcagcaaaatcaaaacgaaatgatcgttaaacaccaaccgcaaatatttttgctgttcttgcacatgttgacggagacgggttcgccacaacttgatcatgctttttcctccgtcatcttcatgtaaatatcatccaggctgccgtcctgcaaaccgaattgttgcttcagggaggccatgtcgccggtcgcccgcacttttccggatttgatcaacacaaactcgtcagcatactgctgggcggttgccaggatatgcgttgacatgagcaccgatgccccttgctgctttttagccgtgacgatgtccaaaagatcatgaatggccaatggatcaaggccggtaaacggttcgtcgatgatgaacaattgggcatgcgtcataaatgccgccacaatcatcactttttgttgcataccttttgaaaatttagctgggaaccagtccagcttgttgtcaaggcggaaccgtttcagcatcgcatcggcttcgcgccaggctgtgtctttatcgaggtcgtaagccatgatcgtcatgtcaagatgctcacgaagcgtcaactccggataaagcaccggggtttccggaacataagccaggctggcgcgaaaaccggttggatcggtatttaatgttttaccatctaagtcaatcgtgccggtttgtggcgtcagtaaaccgataatatgtttaatagttgtcgatttacctgccccgttaagaccgattaacccgacaattttgcctgaaggtaccgagaagctgacgtctttgagaatcgttaaattgccgtaaccgccagtgagtccatcaattgttaaagtcatcttaccagtccctatctgtataatttcagttagggatatgatagcatgaaatcaaggtttctattaacaaaagcgtaagcagaaatgaggcaaggacatgattgattgcattttttgtaagattgttcgtaatgagattcccaacgttccggtttatgaagacgatgtcgtgaaggcgtttttggatatcacgcaggttacgccgggccatacgctaatcgtccctaagaaacacgttcccgatatttttgcgtatgataccgacctagccgccgcagtttttgaacgggtgcctaaaattgctcgggcgattaaggcaagcaatccggccatcaaaggcatgaacattttgaacaataatggcaaagttgcttatcaaagcgtctttcattcacatatccacttgatccctcgctacagcgatcaagacgacttcggtatgcatttcggcgatcacagcgctcagtacgataatgccaagcttgaggccgttgccgccaaaattcgcaaccagctggaggcacaagcatgaaatttcgtcacggctttttattaggcgcggttgccggtacgatttatggaatattaacggccaaaaaaaccggtccgcaacggcaacaggagattgctacttattttaacggcgttgcaaatggcgtcacccaagttcgccaaagcatcaaccacctcagtgagacgctaacgaacttgtccgctgaagttgatcaaacgctcaagccagccatgaaagacattaccaacagcgtcgaaactttcgaattcgaaacggcaccgcgcacggacgcgatccaggaacatctcgacaagatcaatgaggcagtcagcgatcttggcaccaaagcaccgacgtctacagcaaaaccttaaccaaaacattgaaaatggcgtaagcagttgtcgccaagccgtgacggattattgaaagttatgtgaagatcggcgtatggcgataagttatggtatagtagacggcagtgttaaacagaaactttttagattaggatgtgtgattgcatgaaaaaatggattctcggcgttgttggcttgtttgtagcagtgaccttagcaggctgttcaagcggcactgttgcaaatatgaagggtgccaagatcaccaaagatgagtattataacgccatgaagaagaccaccaccggtcaagcgaccttacgtaacatgatcgttttaaaggcgttagaacaacaatacccgaacaaggtgtcagacaaaaaggtcaacagccagttcaacaagctgaagaagcaatatggttcttcatttgattcaacgcttgaacaaaacggctacaccgaatcaagcttcaaagatcaaatccggacaacgttgtattccgaagttgctttaaaggacatgaagaagccaacgaccaaacaaattgaagctcagtggaagaagtaccaaccaaagattcaggtacaacatatcttggttaagaccgaagatgaagctaagcaaatcatttccgattatcaaaaggatccaaccgaaaagaacttcgaggctttggctaagaagaactctatcgatacaggtaccaagaataaaggtggtaagttaactgccttcgataacacggataccagcttggattcaaccttcaaggcagctgccttcaagctcaaaaagcctggcgatatcacgacaacaccggttaagacccaatatgggtaccatgtcattcgtgccatttccatcggcaagaaaggtaccatgaaggaacacaagaaggatctggaaaatcagatttacacttcatggcagagtgatcagaccgtgatgaacggtgttattaccaaagtcttgaagaaggctaacgtttcaattaaggataacgaccttaaagacgttctttcaagctacctgagcagcggctcaagcagttcaagcacttccaactaaaaacaggaccaagcaagatagcaaaaggctcgcgccgtggcgcgagcctttttgtgtatcttttatttttgaaagtccattttacttaatggcatcaatgcggatccggaaatgtctgaccgttcgtcggccgataaaagcgccggttatccatgccaaaaagccgttcggtaaacgtccctggatcaacatgctggtaagcggtggtcatcatattgatggacgcatccatttcatccagctcatgtaacacctgcgcctccaggacctgcggacgaaccggtgagccgtattcaagcaatccgtgatgggccaagacaacatgccgcaacagcaacatatcttccccattgatgtcgattttaagctgatgcgcagccagcacgatttgttcgtcaatcaaaacaatatgcccgattaaattcccgggaaccgtgtaatccgtcgaaatcggtccgcttaattcgatggttttacctaagtcatgcaaaatggatccggcgtatagcaaacttttattcaaactcgaatactgggctgtcacacttttagccaatcgcaaaatgcttagcgtgtgaaacgcaagcccgccagcaaacgcgtggtgattcgacttggcagccggatagctgaagaacgcttttttatgatcgttaatcaatttgcggacgatgcgattccagttagcgttggtgatctcaaaaataaagctattcagctcttcttccatggcattaggcgcttccggtgcccgctcgacgaaggttttcgggtcattgccttcttcctgcgttgcaaggcgcattgaataaatcttgatttgcggattgccttggtacagctcacgtttcccggatagctgtaccacctcacccgccttaaactgagcaatatcgttagcagtggcatcccagaacttcccggaaatatggccggagttatcctggaaaatcattgcaataaattttttgccattcttggccacgcgaacttcagccgatttaatcagcacgggaagtcgcacatcttcttcattatggtaatcaaaaagccgttttgccacggttgtcaccttttcctttactatacaagctaactaaatcataccgatgtcggtcctaaagtacaaggaaggtctcaattgcccgtcacgtgtcgccaaaataaaaaagccccagagagaacgctctccggaactttttctagtgcaggttcctaaacgaattcagcacctacaccgacccagttaactgattaaggtttgctttggtaaacatcaataatcggctgggaaataatcttattcagttcgtccatcatctgtgacaggccttgttccttggccatcaggttttggatcggttggatgtcgcgcatcttgtcgccaagtgcctgcagcgatttcacttcttcatccgtgaaatcctgtccctgcattgacttttgctgcatctcgtattgcttttgctgaaactgttggaacaagccgtaagcaacggtgtccaacttcaacagatcaaaagccttcttgagatcctgaaattcctgagtgctcttgatatcttccgccatctgattagcggtgtcgtaaacgtttgccatactttacctcacttttttgagcctatttgaaccagcccttgatattatcataccattttcccacagtttgcttggcactgtctatgcctttatcgataccatcttgaattccttgccaaatatcgtcatttttttctggtgtctgaatacttgccatttgtgccgcatccttggtatcaaaggctgtttgtggggtattgggcattaatttggacatttcaagtttgaacaacggtgctacgccagaagtgcttgtgccctgcaggaaatgttgactgtcggttgtcggataaccgatccaggtcgcattgacaatgtcaggagtatatccaacaacccactgatcttttgtaccatacccccaactgcttggcacttcggtactgccagtcttcccggcaatagtgtagccagatggtttggccgtcgacccggtgccttcgttgaacgtgccgatcatcatgctggtcatttcctgcgccacttttttggagatgatctgccggcttggcgggttcgaattatcgaccaccgtctggcccgtcgcgtcgacaattttgcggataaaatgggtcgtcggcagcttaccgccgttggcaaacgccgcatacgcccgcgctaacatgagcggggacactccatttttcaaaccgccaagtgccgctgctaggttctggtcgcttgatttgagttgaataccgaaacgatcaagactggaaacccctttttgaacgccgattttgtttaacaaccatactgccggcgcattaatcgaatccgccagcgctttatacattggcacggtacccaaataggttcccgtagcattggtcggcgtatattgatttttaccataactaagcttttcgtctttcagaatcgaatcgtaatggtagccattttccagtgcgggcgtgtaaaccatcagcggcttaatcgtcgaaccgggtgaattgcgcaactgggtggcataattaaaccctaagaaggtatgctcaccacggttgcccacaactgcgcgcacaccaccggttttgggatccaagatgatggaggcaccttgaacctgtttaccatccgcagcatcggccgggaatgcccagttctgctcaaaactagtttgcaggttctgctgataagtttgatctagattcgtgtaaatcttataacctttgttcagaatgtcatcaacactaataccttcactccgcgcttcttcaataaccgaatcgaaataagatggatatttttgcgcattcgccgttgaaaaggcatcgacaacctgcaccgactgggctttggccgcattggcctgtgcctgggtgagcttgttgttatcgaccatgagttgtaaaacgacattgcgtcgggaaatggcgttgtctttatggtcagcaggattgtagtaactgggattacgcagcatccctgccaaaatggccccttcactggcatccaattgactggcatttttgccaaaataccgtttcgccgcatcctgcacgccccacacgccgttgccaaaataggcattgttaaggtacatggcaaggatatcctgcttggagtaaactttattcagctgaatggccatgaacaattcctgcgccttacgcataatcgtctgtttctgcgtcagtaacgtatttttcgcgagttgctgggtaatcgtactaccaccacccataatctgaccgtggtggatcacgtaattgaatgcagaccgcagaatccctttaatcgagaacccgccattggtataaaaagttcgatcttctgttgagatcaccgcattttgaacctgcttactaatgtcgtttaactcaacataggtccctttttgaccatacaacgtccctgcttcttcattgttatcatcataaatgaccgttttggtttgcaaggtacttttaatattttgaacatcagcggttttggctttataagtaaaccaggcagagaaaaccaaaatgaccgttagtccgattaaaatcagccaacgaatcacctgaaaccggcggaagaaccaccgaatgccctgccagacacgtgataaaaattccatgcctgccctcctattgtgaatcttatttattgtagcatagccaggcgctacctaaatcccggcttcaggtttttaagcaaactttatggtcaaaggaaacgaggaaaactcttgttatttcaaaccgtcgccattgctaaaacgcatgccagcctgcgtgatcagcttcaatcctggttgattccccgcaaacggcaacatcagatgcgcgttgcccgttcgatccaggtaaatgggcattatcgccattttaacgaaccagtagtcaccggtgaccgtgtcgccatgacttacgacgaaccgattcgcctggcctatgtgtcggaaacgcctcacctcaatatccgctttgaagacgacaatttactcattgtcgacaaacctgcaggcatgaaaacccatccgaataagccgggcgaaaccggcaccttgatgaatcaggccgcggcctacttggcccctcaaccggcgctaatcacgcaccggctcgatatggcgactagcggacttttagtcattgccaaaaatccgcttgcacaagccattattaatcggcagctggcgaccaaaaccatgcaccgcgactatcttgccgtggttcagcgcggcatccccaaagaaggccgtattgacgcaccgatcggccatgatccgcaagacaaacgcaagcgcatgattcgtcctgacggtgccccggctgtcactcattaccaacggattgcggaaacggcgacaactgccaccgttctgcttcgcctggaaaccggccgcactcaccagatccgcgtccatctcgccagcatcggctatccaatcatcggtgatccattatacgcattgccaagtgatgaaccgcgaatgcgcctgcacgcctatcgcgttcgccttacaaagccgctcagtgacgaacgactcaccgtcactagtccggtgccattttaggtgatcggtcgcatagaaagacgaggtcgagccataattttctgaaagcgttcatagattagtgaattctgaacaatcaaaaaagctcaggtaataagttccgagtcgtgccaaactccacaatctccggccagctcaggtctggcgaccgcgaagctagagtggtgggcacgacttagagcctctgcaaaaccggcagaggctctaagctcggccttgtactacgccgggaagaccgcccggctagtacaatctcaccactgagccccatctggcctacgattgctccgctttggcactgatatcttaataatcctagcaaattctcctgggaaaacaaaaagcggacatactcaaatcattggaaagtatgttcgcttctgtattgtcgtcattagttatggttcaaccacgtcttttgttaactcgtcacgcctcaaccaaacaacaccgccatcaccgatcaaaagcatgccggtatgcctcctcaaaccacttcgcctgacgctcatcgggactgatgaccacgatggtatcatggccggcgatggtgccgacgacctgatcaaaatcgatatcgtcgatgatggcagccagcaagttaccgttactcggcagtgtcttgataacattcataaattgaacccgggtgattgacaagccgacttcacggatcgaacggcctagacgctccagttgtgattccgccgagccacgaaaaatcgtataccgcagcgttcctgttgcatcttgtgccttcacgattttcatttcgcgaatatcgcgggaaatcgttgcctgtgtggcatcaataccagccgcttttaaagccgccagaagctcttcttgggtggcgattggcttttgattgatgatccgcgccaacgctgcctgccgttcattcttgttcatctcaatacctccaccatgacgctgtcgctagtcgcgatgatctgacggactacatctcttccggtgcggccacaccgagcaaatgcaaggcattctccaaaacctgcgtggtcgccttcaccatcgccagccgtgccggcaattcactgtcttcgaccaaaactttgacgttggcataatactgattgaacgctttggccaaacgcaaggcatacttggcaatcacggaaggttcatactccttggcagcacgcgcaacaatggctgggaagtcgcctaatgcccgcaaaacatcccatgcagccggatcgcccaaagcaacttccggcgctggcgcaatgtctgctttccgcaaaatgctatgcgcccgggcattggtatattgaacataaggaccggtttcgccttcaaaccgaaccacttcttccaaattgaaatcaaagttgtccaaacgttcatttttcaggtcgtggaaaataaccgccccgacacccacttcatgggccaccttttgcgcattcggcaaatccgggtgcttttcggcaatttgctgcttggctagatcaaccgcatcgtttaaaaccttttccagcaaaataatgttgccacggcgggttgacagcttcttgccattcgccgtaatcaaaccaaacggaatatggtgaatatcattggcccattcataacccatctccagcaaaactgctttcaactgctggaaatgctcgcgctgttcattaccaaccacatacaggctttggacaaagtgatagtgattcttgcggaaaattgccgcagcaaggtcacgcgtcatataaagcgtagcgccatcggacttcttgatcagcgccggattaaggttgtacttgcttaaatcgacaatttcagcaccttgactggttttgagcagatgtttgtcctcaagcgttttaaccacactgtccattttgtcgttgtaaaaagcttccccgttgtaagaatcaaaatctacgccgaggatcttgtaaatgcggttgaattcagccagtgacacggtccggaaccagcgccatagcgtgagtgcttcgtcatcgccatcttcaagacgtttgaaccatgcccgtgcttctccttccaattcggggtccttttcggcttcctcatgaaactgcacataatagtgaagcaggtttttgatcggatcggctttcaccgctgcttcggaaccccattttttgtaagccacgattaacttgccgaactgagtgccccagtcgccaaggtgattgattttaataggactgtatccgacttttgccaaaatattggccagcgcattgccgataaccgtcgaacgcagatggcccattgacattggcttggcgatattcgggctgctcatatcgatcgggacattacctttgcccaacttggcatcgccgtaatgctcgccttcctgcgcaatagctttcaggacttcgtgggcaaaactaatcttatccaaataaaagttcacataaccgccaaccgctttaacctgttcaaatggcgccgcatcgattttttccaccaaatcgctggcaatcattttgggtgcccggtgcagaattttggctaatgagaaagttggaaaagcataatcacctaagtcagatgatttaggcgtttcaactaacgcggcaatcttcgcttcatccagttgacccgccaaggctggtttaagggcattgacaacaagttctttaaaatccataagttcctcctaaaatgatgatgccacgaaaaaagacccatctctcccttatcgaagagacgagcctttgcccgcggtaccactctacttgacatatgtccactcaaaacactgatcctcaaaagcgcgccgcctggtctgacgtgatcgtttgcactagccgatctcactgtcaaaacgccgattaacctgacatcctctttctcttcggacctatacagcggtcgacgagaatcgaactcgcgacaccagcttgggaagctggagttttaccactaaactacgaccgcaaatcaacgcatataagtgtatcacggcgatgcgcatttgcaaagtcgcaatcggtctttttttctatgatttcaatgagaaaacatcttaaaaatgagtacgcgtaattttgttgttaatctttctcaccgtgctataataataggaaagaagaggagtggtcgagatggcaaaaacgggacgtcactattatttcgtggcgcgcaacgagaaaaccaaaactggttatcgcatcagttttcctaatatccctaatgctgaggcagtcgggacaacgtatgaagaaaccgtttattattcatatcgggtcttggctgatttcttaagccatctgccaaaaaaagaagccgagatccgcgcctatacactgtcagatattccggatactgtttcaagtaacgttttctactcgttagtgagtgtcacgccagactttgatccccataagatggagacacactttaccttaccgcaaacaccgccagacgatattcggcaaaaggccgccaaacttgcgggtttggtgacgccaaatgacaatgttgctttgtagggtactgataagatgcgaacttttcaaatgatcttgttggcagtctttgttgttggtattctctcagcttttgtcggtttattgagttggctggtgttgatgcttaggcatcggccgcctgatcgcgctcgtcgtttgacgctgatgagtggtgcggtttctttaattgctttgattttgaatgccttcacttaatgattaacgctccgtacgccatcttttccgcgatgccggggcgtttttgtttggctggcgagccggtgactggtttctggcgcttttctatgcttaaatgggaacagcaaatattgaaggagtgtggacatgactgatctgcatacaagtattgataagtttcaatttgacaacgtgtttatgaatgcaagtggcgtacgttgctacaccaaagacgaactggatgaactggcacaaagcgatgccggaactttggttaccaagagcgcgacccaggcaaagcggcttggcaatcccagcccgcggtatgcccgcttagaactaggctcgattaattccatggggttgcctaatgaaggtctcgagtattacttggactatgcactgaactttcaaaaagcccatcctgacaagccgatttttctgtcagttgccggtctttccatggaagaaaatctggcgatggcccacaccattgaagattcagattttaacggtttggttgagttcaatttaagctgtccgaatgttcccggcaagccacagaccggttatgactttgaccggacgcaagaagttttg

SEQ ID NO: 313 - DNA, 8713 bp, Lactobacillus casei
cgccaaaatccgatccatcctcacaccagaacgatgcgagcggacaagcggcaattagccaagacacaattgagtctgacaagaaacagacaagtgcagcaatgagcagttctgagaacctgtctagtatcttttaagaactatcttcaggaaggccaatacaaccatttgaagactgctgttaagggcgcgttcacagtttttccaaagtcgccgacatttgtctagccaacgccatgaacgttcaacgatccatcgttgcggtaacaccgtgaacatatgcaactcgttgcgtttagctaccgtcgtcttagcattcaaaatgagcttcacctgatccgcaaagtccaccatcaaccatgacatgctgaaccagctctaaattttggctagccaaactaaacatagccaatgcacctgaacgatctggtacattagctcgtgtcacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaagcgataggaagcaacagttttttttaaagcctttctaatagcgaatcagctgtcgggtctggtttatctcgccacatatcgtaatagcggtagacagtgtgccattccggggaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaaattgcgctcgagaaatattgcttggataatctggcatgacaaactcctcagtcggttttccacaattctacctgattcagcagatactagacaggttctaactctgggatccctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacctcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtttgtacgaaccaggaactcagcgggcctttgctgatttgattgcaccagctaccgagacgatcgttgatgcgaccagcctaaccgtcgtcaacagtgacccactcagtgtcgaccgtcaacagcgactcacccattttgaagtccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacgaccacactcagccagttacaaactagtttgttgaataaaatgacgatactagcagattaacaaacgaacacgcgtagcaacgaccaaagccacttctgtacttagcgttcaaatgaccgctaagtacagaagtggctttagtttatatcaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcaatctggctaagaatctgttcgcgtcgttcggtgtcaaaagctgccatttcaaaaatgacctttaactctttcacgttagctttagcaaatgcaactcggtccgtaaaaattgctgtgacgaatgcctgtagactgggataacgctgccgtaattcatcctctgaaaaatcactcgctaaaattggcacaatgtgcgcggcaattggtgctaagatggcatcccgtaaggcagccttagtcttataccgccgatagaccgtcccctccgcaacgccggcccgttgtgcaatatcactagtactggtctggtcaaaacccttttcagcaaacaaatcgagacttgcctggaggatggcccgttgcttaggtgtaatcgtttcattctgactcagatcctgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactggccatgccatcgactggaaccaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaattaagtgaatcttgaagaccgtaattgtataaacaacggtcaggacagtctgaatgatggcaaagcccccataaccaattagatagcccataataatttcactccgtcgaattggggttgcaagtagccggcttagggttccagtagtgcgttcattcaaaagtgaaacgccagaaatcaagaacacaaagaagaagacaaagaaaccgagaaaggctggcaaaaagttttcaaagaacgttgaatcactactaccataaatataatgactgctagtggtataggttgtcgtttgtgattgactatttgttggcgccgtagcactcgctgtagcctgcctcaattgcttttgaattttagccgcagcagccgtattcccacttgcctgtgcttgggccaaggccgtctttagcttgctaaccgttgcctgtttttgcgtttgcaacacctttttttgtgctttagtagccgtgaccaacgtctgaatttttaatttgaccagtccgctttgcaaagaagctttgatcaatgacgtattggtcggattactattagaatacgtgatcgttaagttgccatctttttgcgtcaaatatccatccaaatcatgctgcttaatcatcgcttttgcctggttactgctgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcaattgccaacgacaagcgccgtttcatcccacccgaatagccactgacccgcttgtctaattgggacgttaaatcaactaatccggctgcataatcaatcatctgtgctaactttatttttggaacgctcatcaattgcccaaacaaggtcaggttttcacgggccgttagtgtctcatacaaagcgtcactttgggccatataccctacttgtgccattaccgccctattgggcatcaccgtatccatgactttaacagtgccactatccacagcttccatccctaaaatactcttgatcaaggtggtcttcccagctcctgatggcccaatcaagccataaatcattccagccggcagtgtcaaatcaatctgattgagcacttgctgatgaccaaagtgcttgctgacctgcttggcgatgacataatccgttgccattttaagaaccctctttctcaaagtgagtgtgtactcgctcacttaatggctttagtataatcagtacatctcggtttgtcaacattaaaatgagttatcactcacttattttgtttccggcccatttgtcaccgcattgtaaacaaaaatgcgccaccccgttgttgggatgtcgcattttaattaaatagcagcactgatataagcgttagcaatgttttggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttagtaacttagttagtgcttcattaacagtcgctgtcgtccgatcttttaaccggtatgcccaaaggaaccgtaattttcgatcgattaaagttaatacctagattgcaataataaagttaccacctagaaagaggcttgctcactgcttgaactggggtttgccaacggagacattttctgggtttgttattgataagcgctgtggctcgttgaatattggcctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccggacccggaaagtccaccatcagtcttgcaaaacccttgagaacagcattttgtgataagttttcaagcttagttgtcgccattaaacgtgtgacccgatcgacaatggtcaaaacagcagcctttgacccgcgaccaccgcgaattgtatccatctctaaatgtcctttttcggttcgccgattagctgactcactgcgaatctcaattgaggtgcctactgcttggttatagcgcgaccgaaggtcttgtcttcttttatgacattttccgtgatcaaagagttgacttggctgaaaatcgacttgtctttgataaatccagtggtaaatcgtgtgtggtgcacagtgaacggcataaccgaccatttcaggggaccaacctagggttagcctctcagttaccatccgcttcaacttaggcgttaaaatcgagtgccgaccacaacgatgccgacaagtatcggcatgatcctgagctataatggcgcagtaatcgccttcagggcaacggtgaagctcatgcctaatagaaatacgagagcggcttaaagtcgcggcgatgtattgaatcgtgtggtgttgcattagttctatctgagatcgttcaattaaggttataatggccatgggccctgtccttctctctagattgtatgttatgcaaacaccattttagcaagaagggacaggtcttttttcacattttctgggtggtaactttaattatgcaatctaggaataaaactgccttactatgcccacgaggaccaacgactgtatctagttcaaaatcgctgatgcgattacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccataagcctaccgattttttaatattattttattcatcaatttccggcgccgacccaagctctgcctgaaccatccagattttcttctcaattgcggttttgagaccaatgaaaatatcttgggtactgaagtctttttcaacatcggatacttcaatgccgtgttggtacaggtcttccaagtaacgatagccatcaactaagtgtgccaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttgggtccacgcatgtaccaatgcgtctgatggataatcattgacatctggctcaaatcggcaacgagttgatttaatactgctttggttttcgtatatttcattagattgatctcctttcgatatggtcattataacatagtggtagcttaatctgaaacgttatacactggcaaattaagttatttatagcccgtagaattaagtcgttttgaaaagatggagacgttatatggtagattgtaaaattaatccgaacgctgttcggattaattttacaatctaccaattaaataaatctacaattgaattttatttaccttatgaagatgttcaaaacgcgttaaaggaaagtgcgcaaaacccctttatacgtacaaaggatgaatgggtagtgggtaacaatgagtgtaaattaaataaggcacaaaaaaggatgcttaaggataaagaaatatataatcatttcaatttagaaaatattcccagttccatcaaaacggagctaaacaagatagtgcatgacatcgatgactaatactttaacaccaaacagaaaggggctatgaatatatagggtctataattaacaaataacccctcaaaaacattgaaagaatagcccccaatatctataatgtagatattgggggctattctaatttatttttttataagtgcccctaaactatagctattgattcaagatttcatgggagccagttgcaaccaataacaaaatcaattcatcatgatctagctgataaataacaatccagttgtcataatttttaccatagtttccatatctggcagggcgaaattcacgatagccacgccaatttccttttaatgcatgatctttaatctgtttcaaaacaagtacatcttgttcaacaattgcttctaaacaaggcttcaagacagttattgggaaatgttttttgactagtttttttaattcacgttcaaaagatttggtctgtttaatttgcatctaacttatcgatccaatcttcaaagtcagtcaatgaaccaatgtttttgacctgccctgtttctgcttcttttttagcggctaaggcttccggagaatctaaaaagctgactaatcgaacttcattattggccgctttaactaacgataagcgtatatactcagaaacggttagcccttgttttgctagattagctttagcccgttcactaatgtcaggtgttacacgagttgaaattgtcttgtttttaataatagtattactcattctaatccgcctcctttaagtttaccatcgtactacattataatattcgatttttaggttttctgcaactaaattaattttaaagtaaaggaactaacagcttatgcaacaagttgtcttacccatcaaagattcaaacgttcttaaagaggttcaagatacgttactcaataactttaaagctggccggcgtaactatacagtttttcaagttggcaaagctacgctactgcgagtcagtgatgtcatgcgcttaaaacaggcagatatttttaatccggacggttctattaaacaaaatgcatttattcacgaccctcaattttcaagtcaagtgcaacgatgataacgaattcttgatagtggtctaggctgttacgccatgcatcggtagtaatcgcatggg

SEQ ID NO: 314 - DNA, 3868 bp, Lactobacillus casei
ctttggcggcatcggcggtgcttacaccaaaccaatcgcacttgctaacgtccgggccttttcgcagcgcctcgatcctaagattcaactgatcggaaccggtggcgtgaccaacggccgggatgcttacgatttaattctggccggcgcaagtcttgtgcaggtgggtaccctcttgcaagaagaaggccccgctgcgttcacgcggttaactcgggagttacgcgccgtgatgcaaactaaaggctacaatgccattagtgacttcaagggacaattaaaagtcttatcatgaacgaaaagattaaagtctgggcatattttaaacacaatagtcaagactttgcccggcactggggcgcctattttctgcttattagcgtgaccaacttggtcgttggcctcgcgatcatcccgttgctgacctttggtgcccagcaagtcttacgcttaggaaacgttccctatattaccttgactaacctgggacagatcgccacagccaaaccggttacagcactgttactgctgctaatcgggctgatactgctgttgtttgtctactggcagtttgcatttttgttgttaggcattcaaaacattcatcggcaaacgcacttaagctttaggcaactggccggcgccactattaggaaaaccaggcgcctgacacccacgaccattttgagtttaattgcttacttcgtgttaatcttccccttttcaagcatcgtctttaaaaccagtttattggcaaaactgacgattcctgatttcatcatcgattatatttttgatcggtggtatttaaccgttttgatcgtggtgctttatttattgggcacttggctggctattcgcctcttgcctttactgcccgcactgatccttaatgatcaatcaccgcgggcaacggtggttcgcagctggcgggcaacccgcggtcaaacctggcgaactttatgggcagttatcctgattgtgattcccgtattagtgctttccatcctgctagttgcaggcctgtatgcttttcaaacctatctagaccagcagtggcaacagtggtcactactgggtgcaacgattaatctcggccttttgcaagtcgccatgttgctgatcacggtcttcttcaccgtcatgctttaccaactggcgacttcgcaagcggaaacgtttcatctgatcgacagtcaggaccacgttgtgcaaataccaaagcggcgacgcaattgggtttttagagtgagcgcatttgccttaatcatggtgattatcggcggaacgagtctgttttatcatgcctacctgattggcgcattaaccacccagccgttaacgatctctcaccgcggcgtcgataacggcaacggggttcaaaacaccattccggcgcttctggcaactgccaaagaaaaaccggattatgtcgaaatggatcttcatgaaaccaaggatcatcagtttgtcgtcatgcacgacgagaatctgaaggctctaactggcaaagacgctgcgccccatcaactgacgctggcggaaatcacacagctgaccgcgcgtgaaaacggccacgcagccaaggtcgcaagctttgaccaatatttggccgcagctgaacaggttcatcaaaaactgctagtagagatcaaaaccacgccacatgacagtccgcaaatgatggatcgattcatcaaacgttatgccaaacgcttattagccaatcatgatcaagtccattcgcttgattacggtgtggttaagacgctgcgccaacgggttccgaagcttaagacgttctttattttaccgtatacgttggttttcccagaaacgccggctagtggctatacgttagaatcaaccacactttctaccacggttgctgatcaagcccacgaccatcatcaagctgtctatgcttggaccattaacgatcctgatgacatgcagaaaatgacgttcatggatgcggacggcatcattactgatcaattgcgcctgttaaagacgacgttgcgcgagatgaatgatcaccctagttatgctgatcagctcttgaattatttgaatggtttttcaaccgaagacaatgcaccattttaatgcctcgagtgacatcttttgagcacagacaacgcaaaagccggcatcttttccagtttggaaaaggtgccggctttctttagacgatcaatatcgctcagttactgaacctattttatttaaagtaataacgtgccgtttctaacgcactggtctccatcaaacgcttaccatattcggacagaaccgcggatgatagtggcgaacgatcaccaaattccagtgcaaccgccatttcgtcatgggcttcgttagaggaaatctcattaggatagaacgttaatacgaggtaataattttgcttataccggtaaaggtcgctctttccgccttccaaacgcagcgtctgcgcaaggctgataaagtcttcaaagtcctttaatttcaaaacgagttcggtttgcggagcctttttagcgtcaatataaccgccttcgtcgactgcctgctgatcgtgttgatcattggcgtctaagccctgcagctgctgacgaatataatccggtacttgggtgtccgtactgtcatcatcagaaccggtgtcgctatcatcattcttttgaccattcttactgatcaacaattcgagcccggattgacttggcatgacctgaaacgtcacggcctcgtttgtggcaaacgtatggtctttgtcaacttcatcaaggatactgtaaaagaagctctcaatctgcttgtgattgccaagcaaatccaataccgtaatcccccgttgcgctagatcatcgttacctaacatgacccggatcgtatttgcattaatccgttccatttccatgattgctgcacctcactttagtcacggaaccctgagttctgtggttcatcacatgaccacttactacattatagcagatttactacgtcaaggcattctaccgcacgtaagcgctatgatcaagtctagtgcacagagcgtgagcaggagcgcttagaaatcggagtgtaagtggcctcaagcctaaatggctggtttttggccatttaggcttgaggtccttacacgtagatttctgcgactgcgatcgcgtttcggagccggattgcctacaatactcccttggccattgcaactgagctcctcacgcagacttctgcgccagtcaacgcatttcataaccaaattctctccaaaactttcgtcaaaacgaaaaaatgccccaacacttatacgcgtgtcgagacaattttgttatttgttttatgattaatgaccgattggctgctagcttgtgtaagtacaacagtcacgcgggtaaaagaccacgacttttcaaattaaaatcctgccaataattgcgcctgttgaagttccaaggtacgcacagaccgcggcaaaaagcgccggatctcgtcttcgttataaccaacctgaagacgcttgtcgtccatcatgatcggccgacgtaataaacctggatattttgctaccagtttaattagcgtgccggtcgacaaatcatcgatgttaattcctagctcctggaagatcttcgaacgtgttgaaataatttcttcggtaccctcttcggtcatcatcaataaccgtttgatttcatcaacgttcaatggatcagaaaaaatattgcgttctttaaaaggaatcttattttcctttaaccaggcgcgcgccttccgacaagatgtgcaacttggggacgtgtataaaataaccatgagcgctcgctcctttttctttgacgaggaatccttctcaactacaggtatagtatacgag

SEQ ID NO: 315 - DNA, 61072 bp, Lactobacillus casei
  misc_feature (48661)..(48670): n is a, c, g, or t
acttggggacgtgtataaaataaccatgagcgctcgctcctttttctttgacgaggaatccttctcaactacaggtatagtatacgagattgactcgaagcggcgcaatcatatttagaaaaataatttttaaaaattgaaaatccatttttgaaatctctgtagatctctgcacaatcaacgtttttataagttttcttgtgaaaaatagctcaagttataataactaattttttaacatttagttctcattttaagtgaacatttatgatcactatcagacattaattgtcaagtcatctgccgccaacaaaattggtatgcccactgcttgttttgcagcctgctgctttaaggtatcaaggtcgagttgttgcggcaaatgtgtcaacaagagttgctttacgtcggcatcctttgctaagcggccggcctcaggtgcggttaaatgccatcgtggtgtcggttgatccgccagaaaattggtatctgccatcaagagatcggcgctttttgtaaacggtatcaatccaggaaagtaacgcgtatcacttgtgttgaccagcactttattggtccctgattcaacaatgcgcacagcaaaggctggcactggatgctgcgtctcaagaaacgtgatcgtgaacggtcctaaatgcaaggtactgtcagcggagtagcccatgccttgcgtaaatgggccaaaggttagactgccaaagtttaacggatccatcgtgtggccgtaaattggcagtggcgagacttttttggtccccttccgcaactgataataatattgcaacaccccgacatccgccgtgtgatcgtggtgataatgggttagcaaaaccgcatctagttgcaatggatcaaaaaccttctccaaggcaagcagaccgccactgcctaaatccattaataaatggtaatcgccgctttcaactaagtaggtgctggtcgcgtggccggcatccggataaccgccaagataacctaaaactgtcaatttcatttagtttttcctccctttcaacctgaaaagccgctaagaagtttataataagtgtggaggtggtcggtatgtccacaatacaaacagtcttcggtagtaagtcgttccttgtcaaattgctcgatgagcgccatgatccccaactaaaattgttaaaaccggcacaaagcggcctggattacatgatttacgatccgagtggccgggcgacattcagtgcgccattgcgttacgacatcattacgagcttaggcccaaccgaacaaaacggctatgtgcagttcatgtattttaatttggacacggacgatgtcaaagtgttcttatcaaaaatcaaacaattgatcgataaccacgacatcttgcttggggaaaatcacatcctgttggcgcaagaagtcaaacaccctgataattttctgatggtttctgtctggcaatccagcaatgactactacgagttcaagaataccccagcactctcatcagtcaaggagttcattcgccgcgccgcttcggctaatggctttcatgaagcggggtataccgtcattgacccccatcaaaaagattaagccgagccggtcatgtagccggaaaatttttaacatgtcagtcctgtgagccggcaagtattcgtctaacctcaaagcaccagaatttgccagaaccgatcgccaataactaaccaccgttatcgctgatcttcgctggtcattctggtgctttttgatgcattttcatcagtcgctaacccaccggctaaccggcccatcaaccatacgaatcatgacatgcacagtcgcctgataaaacagccagtcaatcccggcataaatggcaatcatcagaccgagataacgcgacggcggattatcaagataattggtcatcacgctgattacacacagtgccatgataataccgaatacaagtggaacggcgaaaacaacccccgcctggcgataaatcgtgtggcgaatctgttgcggatccatccccagatgcttcagtatttgaaaatgccgagtctcctgacgaacggcgatgacttgtttgagcaataaaatgctgccggttgcaaccacaaaaacgccgcttaacagtaagatcaaaaatagtaaaaacccatataacgtactgacgaaattttgttgcgatgcttgcagcccgatcggattgcgccagaagttcattttggtacgcacccgattagtgaccgtcaaatcatcgcctgccagctcattgtcacctatattgacgtattcctgtagattctggctattgtccagatgctgcagttgtgccagtgcccgtcgcgcggtcttggtttttggcagcttagccatatatagccggtccggggtgccttctaacatgtcaaatgtctggtcactaaccagtaatccccgatcaaaatagttgttactgccagttggaaaaagattggttgtctgggtgagccgaagtgacgtatcactgcctggtaacataatcgcccgatccggattacgccgcgcgccaaccggtcgaaatccggttctgtttggcaacattagctgagcttcctgttggcgtaatcgaactggcgttaaacccttttgcaatcgtgctgcccgccgataatcacgcattgcaacaacattgtaaacaccaggctgctcgcgaacctgcccgacctgatcccgtaaccgaatctcggcatagactaatttagacgaaatggtaaccgcatgagtcggcttaaccttggcttttttcaaaacgtcggtcacattatcgacgccgacaccggatgccacgacagtcgttggaatttcgcgcaacaccagctcctgcttgtattggaaaagcatgacggaactgcccagcatcgtaatcgtcaccgcgcaaagaagagtcgtcaaccacaatgaatgggcattgccttgcaaccgtttgataattagatgacgggaaatcccacttgcattgcgagtctgcatctcatgacgacgttgaaaccacgccaccaatcctggaaggaagtcggcgaagactaaaaatagccccagtaacaaagctgccacgactacgaccaataaaattggcagcatcattcgacccgggatccatggcagcaagcgcattaaactgccgctaatcggcaacaggcgtaacatggttaataaactaccgaccagtaacgtaaaaccgccaatgccaagccaaaaacgccaccaggtctgcggtttaggcgcaaccggcacatcttgttgccgaatgaattgccgaagtggattttgaacgtaaatggcgttaaccgcaccgactaacagatagacaacgcccatcaatgtcaaaacatccagcaacgctgacggcgaaaccataaaaccaatcggcgtatgcaaggccatcaggcgaatcaacaccatgcctaacaatggcgacagaataagtccaagcaagacaccagccacaaacccgatagcaccgacaatcaagctttcaataaacacggtcaggccaagtttggctccagataatcccaaaagtcggtataagccgatctcctgatcacggcgggcaattaacaggctatttaaatacaataggaaactgatcgaaaacaaagccagcaggaccatgacaatcattaacagactgggtacaatatccagactgcctaggcgcttgctggcatcggttaaaatcaaccgattgttcgccaccgcgccaatcgcatacataatggcgttgattaacgcagcgatcatgatctgcaagccatcttcgtgccgatgtcgcacaaggttggtcttaatctgttgccacacgtgcatggcctcctccgcttaccgtcgcttccatatcaatgatgcgatcaaagaactgttcacgggatttgccgcgggttacttcagcaaaaaacgcaccatctttaatgaaaataatccgactggcaaaactagccgtaaacggatcatgggtgaccatcaaaattgtggttttctcctgctgatttaactgctggagataccgcaaaaagtctgtagctgccaatgagtcaaggcttccagtcggttcatcagccagcagcaggctcggctgcgtgatcaccgcccgtgcagccgccacccgctgccgctgtcccatgcttaactcgccgggaaatgcttttaataacgggtctaaattgagatgctgggacaccgtccggagacgttcagcacgatctggttgaacatgacgctgtaacgtcagtggtaaaaggacattttgcgcgaccgtcatatcgtctaacaaattaaaatcctgaaaaacaaagcccagatggtcacggcggaatgcagcttgttggctttcattcaaagcttccagatcatatccggcaattttgaccttacctgtgctaggcgtttcaatcgttgccaaaatattcagcaacgtcgattttcctgcaccacttggccccatgataccgatgaattcgccggctgcaacctgaaagctaaggtcatttaaagcgcgaacccgatcatgtcgctgtccaaagattttacttaaattagatacttctaaaattgccatggcttacctccgtcatcattctaccaaaaaccactgttgactgctgttcatcatcctcactgacatcctgtaaatgtcaacggcatttttcttattaagcaactgttctcgcggcttgtgcttcctggccaaaacttatacgataagtgcaggaatggagttgatcacgtgtttaaaatcatgatcgtagaggatgatcagaccatcagcggcctgatcgctgacaacctaaaaaaatggcagttcgaaccagtcgttgtgactgattttaacgctgtcttcgatgattttctgcaagaaaagcctcacttggttttgctggacatcaatttgccggtttttgacggttattactgggtccaaaagattcgcgaagtctctaaggtgccggttatctttatctcaagccgcaacactaatatggacatggtcatggccatgaacatgggcgccgatgatttcttaaataaaccgtttgcgatggaagtcttgatcgccaaaatcaatgctttgctgcggcgaacctataactatgccgatcaaggaacggatgttttggaacacaacggcctcatgttgaacttgaaaaacggcatggcccaggtgaatgacaatgaaatcaatctttccaaaaacgagtacaaattactgcagattctcatgcgccagcacgggcaaattgtcagtcgctcgcgtcttctgaaagatctctggcaagatgaacgttttgttgacgataatacgctaacggttaacatcaatcggttgcgcaaaaaaatcgaagaagccggcttaaaagattatatccaaaccaaagtcggtcagggctatatcgttccttaggaggctgccatgcgttttcgcgattacatcaaagaccacctgtggcccattggcggttacattttatgtgtggggttagcggccatcattatctggctggatcctcaacatcgagttaaaatgtcaacactctggtatgcggtgttactagtgacacttgttgcgagcgctttttttgtggctcactttggccgaattcggcggtttgcggcccaacttcatgaccgtcaagaggccaaggatgcggcgctggactggccgctgcctggtggcgaatcaggcctcgaacaagttgttgccgatacgtacaaccaaatgctgacgctgcatcgccaacagattaccgccttattagcccagcaacaagatcaaaaagacttcattgattcctgggtccatgaaattaaagtgccgctagcggcggtttcgcttttggctgagagttttgaagggcaagtaccggacgacaaactcgataatcttaatttgcaattggatcagatcgaattttatgtcgagcaagttttgtactactcccgactcgacagtttttccaaagattatctgctgcacaacacgccgttaaagccgcttgtgaatgatgtcgtcgccagtcaacggaatgggtttatcaacaaacgcctgtcatttaagctcaatggcgaggatcaaaccgtgctaaccgataataagtggctgcggtttattttggcgcaactaatttcgaatgccgtgaaatacacaccggaaggcggccgcatcagtgccaccatccgcaatactggcaaagaaacccagctcatgattaccgacactggcattggcattcctaaagatgaacaacatcgcgtgtttgaaaagggatttactgggagcaatgggcggatatcaaatcacaaatcaaccggtttggggctctttttggcggaaaagctttccgaaaagcttggccatcatttgacgctgacgtccgtgattaaccaagggaccaccgtgaccattcattttccatatgtcagctattacagcgatccaagccaaacggttcatcatcccaaaaccacccgcgagcaatcttctaatagttaaatgcgtcttttagtcagcaaaatccaacaaaaaagaacgagtgacttctgacatacagtttcctgcagaaagccactcgttctttttgtgatgttaccgaataagattcttccaaagtttaatctcgccagccgcttgcgttgccggcacgtcgatgatgcgttgattggcgctgccgcgaaattgtaaggttaaatctttttgtgccagtaagaagcggccgtcgaccaggatgtcgatgagccctaataacgtcaacttatcttcggaatcctgcatcagttcctcgtatgtgtacccgctccaactccaaatgtctttgtcgtggccaaattcctgccgaatccggcggcacaaccgaatgcatacctgcgtgttcaaaaacggttcgccgcctaataatgtcagcccttgtacatacgactgactgagatcttcaataatctgatcttccaactcctgagtgtaaggtttcccatatcgaaaattctgggcaacccgattgtaacagccggggcaggcaaaccggcagccagatacgtataaactacaacgcacgccttcgccatccacaaagttaaatggtttgtaatccgcaatacgttgctgggaaaggtcgctagcgagccattccttaggtttaggattctgtggtaagcgattggtggtcataacaatatctgcctctttctgaagtcattgtagcgatgctgtgtaagacttggtttctaccgaagtgctggtcggtaaaccggcaccttgtttggtaagtctttttttatcgtatcatcttttaaccccaatatatagtattagttgtacacaaaataccggcttgtcatctatatcttgatggcgagccggtattcatatcagagcttgattattctaagcacggttcaaatgcagcgtcatggcatttaacgcaaccacgatcgttgataacgacatgatcgccgcgccgactgccggactgagaatgaaaccaatcggcgccaggatacccgctgccaaaggaatggctaaaatgttgtagccagctccccaccaaaggttctgcaccattttgcggttcgtcgcctttgccagcgataagaagttaagaatatcagctgggtcgctgtgaactagaaccacatcggccgtatcaatggcaacatcggtaccagcaccgattgctaccccgatatctgcttgagccagactaggcgcatcgttgacaccatcgccgaccatcatcacaacgccacgctgctgataagccttgacctgagcaactttatcttcaggcttgagctctgcctgaaaatcggttaaccccagctggtcggcaactttcttggctgtttcatgattgtcaccagtcaacataactggtgtgatcccttgacgcttcaaggccgctacgaatggcttgcttgatggcttcaactgatcgccttcagctaccatccctaaaacctgatccttctgtagtaaaaaggacaatgagttcccggcagccgccaactgatcggcttgggcctgatcataacttaactgatggtctttcaagtaacgcgcattgacgatggtataagcttggccatcaacttcgccttgaagaccgatacccttgagtacctgaacattttgagcagcaggtacatttaattgctgttccttagccgcggctttaataccggttgccagtggatgctctgaatgactctcaagtgcggccatcaaggctaagacttgagcttcatcatgattggcaaatgcaacggttttggcaacggtaaatttaccttcagtcaacgtaccggttttgtccattaagataaacttcgcatgtttggcagtttcaagtgcctgacgattacgaatcaataagccattggttgcgccaatactggtgctacgcgcgatgaccaatggaattgccagtcccagtgcgtgcgggcaggcaatgatgaaaacggtgaccatgcgttcaaaggcaattgccgctccatctgatagccaaatgaagaatgccagaataccgactgctaatgctgcgtagaaaagccagccagcaactttgtcggccatcccttctgccttactcttattggcctgggcactttgaaccagcttcatcacttgcgacaggtagccgctttcgccagtaccggttactttgatttcaatgacgccatcaccattgactgatccaccaatgacccgatcgccttcagctttatgaatggctttggcttcaccggtaactagggattcattcacactactgctaccactgacgatctggccatcagccggcatctgttcacctgccaggacgcgcaaacgcgtgccgacctgaacttctgctaacggcatgtccatcacgtgatcgccatgcacgacatgcgcttggcttggcagcaacgccgcgagtttctcgaccgcattgcccgctgccatgaccgcattcatttcaatccagtgccctaacagcatgatcacgatcaatgttgccagttcccagaagaaatccatgaccataccattcggcgcgataaaatgattcatcacaaacgcgtaaagtgaataaccataagcaacggtaatgcccattgcaatcagcgtcatcatcgctggctgccgctgttgcaattcggatttagctccggtcaaaaatggccagccaccatagaagaacagaaatgacgataaaatcagaaccagccagtcagatccgggaaatacgatcggtagttgcaaagcgcctaagtggatattcatccccataaactgggaaagtaacagcactggaatcatcacaatcaggctgacccagaacttttgcttgagattgcccatatgcatcatatgaccaccaccgtgatccatgtccatatgcgacatatcgccgtgatgcatatccatctggctcatgtcaccatggctcatatgcatgtcgccatgattcatttgcccatgagccatggttccttggtccatggccatggtttccataccagcttggtgtcccatctgttcatggtccattggcatatccgccatgtcatcatgttgcatattactggtttttccagtcgttccgtttgcatgttccatcttactatccttcatgaacttcctccttacacccttctggcaagcaattgcagctgaccattgccggtgcatccggtaacttggctgtcaatgtttgttgtaggtcgttgatgtcttgttttgataaagtcacgtgcgttatcaagtgatccaaggtcttgcctattttcatctggcataaatggctaaataactcagtcactgctgcatccatggatgcttgctcgccgaccgtagcatggtacaaaaattcacgaccttgtttttccgttacaagtgcgccttttttgactaggcgacctaaaaaagttttagtggttgcgaccttccagcccattttatctgtcaaaatggcggcaagcgtgctgctttttaaaggtccgagtgtccaaataatacgcatgacctcccattccgattgggagatgtcgactgttggtgtttccataattgcctccgtttacacttgtaatctttcaacacttataatttacaactgtaaacgatgattgtcaatatcaattttttaattttatttggaagtgcctgcgcatactgaaaaaagggacatgcaaataggcaccgcgacaagaaactgtcacagtgcctatttcgttaatgctattcgccaaaatcaggttttaccgctgattgttttcttcaggctttgaccgcatggaaaccaatgtcagtgcgataatccaaaaccccttggatactttccatggcctttttagccttcataatagcttcagaaagcgttgatgccgcctctacaaccgagaaaattcggcctgaactgctaacccagccgttttccgtctggttaacgcctgctggcaaccaggtgccaatcggccagtcttttggcacaatcaccgggacctgctttaatcctgaaccgggataatccggattcaccgcaacaaagcacgcgtaagcttggccatttaacttcaaatcaggttgttgaccattcaacaaatccgttaccaactgataaaaatcattttcgatctgaggtaacagcacctgtgtttccggatcaccaaagcgcatgttgtattccagaattttaggaccatcagcggtaaaaatcaggccgatatacatcacgccttgcccactgaggccgtcctcctgcatccccgccaacgtcgtatcaactaatgcctcagctgcctttacttggtcggtagtaaactgtggtagcgggctaatggcgcccatgccacccgtgttaggaccacgatcggcggcaaaacggcgtttatgatcctgtgataaaggtaaaatcacgcggttttgaccgttgaaaagcgccattaccgatgcttcttcaccgtcaaggtattgttctagaagcaccgttgcatctgggtgcccctcataaagtcgatcaatcgcatcgtccaaggcagcagcgtcttgggcaatgatgaccccttttccggcggcaaggccatcttttttaaggacgattggcaatcccattaacgttgcctcggcatgcgcttccagttcactatggacggttttgctggcagcagtcggaagatggtggcggtgcataaagtctttggcaaacgtcttactggattcgagttgggcgagtttttttgtcacgccaaaaattggctgatgagcttcttgaaaagcatcgacaatgccagccgccaagggtacttcaggaccgacaaacgtcaaatcaatctgatgatcccgggcaaactgaatcagttccggcacttcggcttcttttataccgattggctcaacgcctaaaagcgtcatagccggattaccgggtgccacatagacgtggtcaacttgtggcgactggttgaattttagcgcaagggcactttctctggcaccgccgccaatgacaagaacctgtttcataaaacctcctcgcgcgtatgggcgcatatttgtgggtgatgagggtagtgtttacgcgtttgctggtgtggaaatttcgtgtaagggccttaagcataaatgaccaaagaccgatactgcagctttccggcgccaaaacgcgttcactggcgcagaaacctacgtgtaaggaccttgaccgcaatggcccaagaccagtactgcagctttctggcgccaaaacgcgttcgccagcccagaaacctgcgtgtaaggaccttgaccgcaatggcccaagacctgcactgcagctttctggcgccaaaacgcgttcgctggcgcagaagtctacgtataaggaccttaggcgtaatggccaagttcgggccatcacgcctaaggccacttatactccgacttctaaccgcgccagctcacgctctccgctctaatgcctaaagtgccgcacacccgttgttaccatggcgatgccgtattcatctgctttggcgatggagtctttgtcgcggatgctgccgcctggttgaatgatggctttgatgtcgtgttttgccgcgtaatcaacgcaatcgtccattgggaagaaggcgtcactggccatgacggcgccggcaaagttgtcgttttgttgcgcctcggtcaatgccaattcgactgacccgatccgattcatttgaccggcgccaatgcctaacgtctgatctgcctgggcgaccacaatcgcattgctcttcacgtgtttaaccacggtttgcgcaaacgccaaggcttttaactgatcagcagtcggttgcaccttggtcacaacggtcatgtccgcaggggtttccgtcttatcgtcgcgcgtctgtaccagtaggccgccgaaaatcgaaaccgtttcggtgcccagttcttctggcacatcggccgtattaatcgttaacaagcgcacatttttcttcttagccaaaatctcgtaggcatcatcgtcaaagcccggcgccatgatgatttcaaggaataatttatgcattttttcggcagtcgccaagtctacttgccgattcagcgcgataatgccaccgaagatcgacatcggatctgccgcatacgccttgtcccatgcagcttcgatcgtttcgcccaagccaatgccacaaggattcatatgtttaactgccacaacagccggctgcttgaattcacgcaacatcgctaaagccgcatcagcatccttgatattgttgtacgaaagctctttgccgtgcaactgcttggcagccgccagactcgtcggatcaggatccggttcaacgtaaaacgccgcttgctgatgactattttccccgtagcgcaggtcttggcgcttgtggtaagtcggtgtgaattgctccggaaatggttctggatctaagtaatgaacgatttgggcatcataagccgccgttactgcaaaaaccttggctgccagtttctgccgcaacgccgcatcatcttgatcaaggccggtcaaaactgctgaataatcagctggatcaaccacggcccagacactatcactatttttagccgcggcgcgcaaagcagaaggaccaccgatgtcaatttgttcaatagcttcggcccgggtcacatcagcccgtttaatggtttcggcaaacggatacagattcacacacaccacgtcaatcggctggatgtcatgatcggccaacgcctgcatatgcttcggatcatcgcggcgtgccaagatgccggcatggattttaggatgcagtgtcttaacccggccatcaagcatctccggaaaaccggtcacatcttcaacactggtcacagcaacacctgcttcagccagttcacgatgggtaccgccagttgaaatcagttcaaaaccccgttcaatcaatcccttagcaaaaggtaccaaaccggttttatcagagacacttaacaatgctcgtttcacttaaatcgctccttcttgaatgagtttcttgacagtttccggaaaagtgtgatgctcctgacggtgaatggcggcttccaattcggctaatgtcatgccgggcagtacccgaacaggatcctgggcaatgatttcgccggtatcaatccccgcatcgacataatggacggtcacgccggttactttcacgccataatcaaaggcatccttaatcccttggcgcccgggaaagcttggcaacagtgccggatgcaggttgataatgcgccgaggaaatgcatctaacaaggtcggaccgataatgcgcatgtagccagccagaatcaacgcgtcgactggcggaagcgccgtcaaaatatgagcttcggctgccgctttatcggcatagtccttgaaattcacgacaatggttggaatctgatgatgagctgctttgcgaatcaccggggcacgtgcccgatcacaaaccaccaccacaatacgaaaattgctatcctgcgcctgcgaagcctcaaacaatgcttcaaaattggttccgttccctgatgcaaaaacagctaatgctttcattcgcctgccacctgccagtgaatcttttccgctgggtctgcgacaacttcgccgatcactttactgcttggcaaggctgtctgtactgcggaaaccgattccttagcgactaccaaaatcataccgatgccaagattaaaggtcatccgcatcgtgctttcactcaaatgaccggcatgttgcagacgatcaaaaagttccggccgtcgccatgcttgcggatcaacgtgggcacttaagccatccgggatcactcgtggcagattctcggtaatcccgccgccggtaatgtgcgctgccgcatgaatcaaaccctgttgcatcagcggcaacacctgcttgacatagatccgcgttggccgcatgagcgcttgcatcatttcagagccatcttcaagtgtctgactgcctaaatcggtttcggccaataatttccgcaccaacgaatagccattgctatggacaccggaacttggtaagccaattaacacatcacctgcagcgacatcctgcggcaatctttttggtgccgaaacaacgccaaccgcaaacccagctaaatcatagtgatgttgcgggtacatatccggcatctcagcggtctcgccaccgatgagcgccatctcggcctgttggcaaccaaacgcaatgccgcgaaccacggattccgcccgcgcaacatccaaatgatccaccgccatataatcaaggaaaaataacggttgtgctcctgtcgccagcaagtcattggccaccatcgccaccaaatcaatgccaaccgtttcatgcgcatcgcactgcaaggccaacagcaacttggttccaaccccatccgtggcgctgattaaagtcggctgcgggacagacggcaaccgatatgccgccgcaaagccaccaacactagctaacacattttcattcgttgtttccttggctaacgcggcaattcgttgcaccgcttcgtcaccggctttaatatcaacgccggcgtctttgtaatctgtcatgcgctaacctccgcaacattaactttgagtgacgcaacttctttattcaggtcggattcataatcgtcaagcggcgtcggatattttccggtgaaataagccacgcataacccgccattcggagccgtggtcggcaagccaacgctatcctccaacccctgtgtcgataagaaaccaagcgactccacattcaacaaatcacgcatttccggaaccgtgtgattggccgcaaacaattcactagtcgtttgaaaatcaatgccataaaagcacgggaaccgcaacggcggactggcgatacgcaggtggacctccgcagcgccggcttcttttagcaacttcacgatttgtttggaagtggtcccccgcacaatcgaatcatcgaccaaaatgatccgcttcccggcaacgacgggcttaatgacactcagcttcattttgacgcttttttcacgcaaggcctgcgtcggttgaatgaatgtccgcgccacatactggctcttgaccagtcccatttcataggggatcccgctggccttagcataaccgatcgcggctgacagggacgaattaggcaccccgacaacgatatcggcgtctgccggttgttccttagccaaacgttcacccatgcgtactcgcgcctggtgaacgttgatgccatgaatgtcagaatccggacgggcaaaataaatatattccattgagcaaacggccagcgtggtatctgtcgtgaaatgatcaagatgcaacccggcgtcgtcaattgtaattaattcaccgggttgaacatcgcgaacaaagtcggcccccactgcatccaaggcagccgtttcactgcatacgatgtacccgccatcaggcatcacgccaaccaccatcggccgaaagccatggggatcaaccgcggcatacaagccatgctcggtcagcaaaacaaacgcaaaaccaccgtgtacttcattcagtgccgtttttagctggaccaaccaaggcttgtcgacctggcgacgaatcaaatgcatgagcacttcggtatccgaagtcgattgaaaaatggcaccttgatcttcaagttcccgccgcaagctaatcgcgttggtcaaattgccattgtgcgctaacgcgattgactcatcagaaaaccggaaaagtagcggctggatattttccagaacgcgaccgcctgctgttgaatagcgaacatgacctaaagcagcccgacccatcaatggccgcaactgatcggtgttagtaaacacttcacttagcagtcccaaaccataatggcgccgcatgccttctttggtgagaccaacgatgccggcaccttcctgtccacggtgttgcagcgtgtgcaggcctagatgggtaatactggcagcgttgggattgccccaaatgccaaagacgccgcattcttcatttaagccttttggttcatgtaccatgggagtgcctcctcaaatgcagtttgcagctggctcaaggccaccgaaaattgatgactgaccgttgtgacgtcgaattgtggtgctgcctggacatggccaatcagtttggccgaaccgtttaaggcttcgaatgctgcctgattttctggtgccaccgttatcaagaagcggccttgggtttcggaaaagccccagctggttggcaacgtcaccttaatcttggcgcccagaccattggcaaagcccatttctgcgagtgcgaccagcagcccaccatcacttaaatcatgggcggcagtcaccaaatgttgccgaatcgcttttaagacgaacgcttgattagtctgttctgcttctaaatcaaaatcgaacaatcgaccggaaacgccgccagtttgaagtttttgcaactcactgccgttaaagtcgccatgcgtttcaccaaccagataaatcaaatcatcggcgtgcttaaaggctgctgtcgtgatggtgctgagatcttcaatcagccccaccatcccgatcatcggcgtcggataaatcgcgtgcccattcgtttcgttatacagtgacacattaccggaaatcaccggtgcgttaaacgctttggttgcctgaataatgcctttagctgcttcggcaagttcataaaaagcttcaggcttggtcggatcgccaaagttgaggcaatcggtaatgcccaatggctctgcgccgctggcaaccagattccgtgcggcctcggcgacactcattgcggcaccgacttgcggatcgagatagagataccttcccttactgtcggtcgtcatcgctagtgcccgatgcgtcccgcgcacgcgaatcactgcggcatcactgcctggaagaaccacggtattggtttgcacttgcgcgtcatagcgccggtacaaggatgacttgtcggcaatggtcggcatcgccatcatcgctttccaggttgcgaccggatctgtcacaatcggatcaaaatcaggtgccgggttagccagacgctccggctgcttagcctcttgttcataaaccggtgcatcatcggttaaagagctgaccggcacatcgcaaaccaatttgccatgatgataaagtttgtattgatgaccttcaatcacgtggccaacaactgctgcgtctaaatcataggcagcaaagacatccaagacttcttgttcaaaaccggcgcgaacacaaagcagcatacgttcctgagattcggataacataatctcaaatggcgtcatattggcttcacgctgcggaatcaagtcaagatccaaggccatgccactgttggctttaccggccatttcaacactggacgaaaccaaccctgccgcacccatatcctgaatgccgacaagcgcctgctgatgttgctgggtgatctcaaggcacgcatccatcaatagcttttccataaatggatccccgacctgaacagctgagcgatccgccgcctcgtcatccgaaaattcactggaggcaaagctggcaccattaatgccatcccgaccggttttggcaccgacataaatcaaggcattaccgacgcccgcagctttgcctttttgaatctgatccttatccatgatgcccacgcacatcgcattcaccagcggattgcgcgtgtaactgccatcaaaattggtttcgccacccactgtcggaatgccgattgcattgccataaccgccaatgccggcaacaatccggtcaaccagatgctgcgtgtgcggttgattaagatcgccaaaagccagtgaatcaagcatcgctacaggcttagcaccaatggagaaaatgtcgcggataatcccgccgacaccggttgcggcaccttcataaggttcgacggcggaagggtgattatggctttcggctttaaacaccaccgctttgccttcaccgatatcaatgacaccggcaccttcaccaggccccatcaaaacccgttcatttttggtccagaactggcgcaggatcggtttgctgtatttgtaagcacagtgttcactccacatgccgcttgccaaaccgatttcagtgtcattaggttgatggccgattaattcggcaaaacgctcatactcggcctcagtcaatcccaagtccagataggatttcttttccgcaatggccgttggactcatttcaacgtgtgccacgaatgtcggctcctttcgtttgttggataagcgaatgaaagacgcctaatccatcagtaccaccaagtaaggcctcaactgcacgctccggatgcggcatcatccctaaaacatttcccgccgcattggtcacccccgcaatgtcatgaacactaccattcggattgtcgatgtatcgaaacaccacttgaccattagcttcgagctccgccaacgtttcgggatcggcataataattgccttcaccatgggcgatcggcaacgtcaactgttcaccgacctgatattgattggaaaacgccgtgtccgcgcgatcaacagtcaacgccaccggctcgcagataaagtttagatcgcgattccactgcaaggcccctggcaacaaaccggcttcagttaaaatctgaaaaccattgcagataccaagcacatacccgccagcgtccgcaaaatcttttagcgccgtcatgacgggtgaaaaccgggcgatggcaccgctgcgcaaataatcaccgtaagaaaaaccaccgggtaccatcacgacgtcgtaactgcttaaatcggtttgatcctgcttgatcaattcacaatcagcaccggcaatttgttgaactgcccattgcaaatccagatcacaattggatccgggaaaagaaataacggccgctttcatgcctcatcctccgtgattggctccaagtcaaagcgataggtttccatattgacgttagcaagcaactgatcacaaatcgtatcgacttgctttcgtaccgctgcttcggtgccgctaagctttaattcgaaatatttaccatacaagacgtcatcaacattgtgataatccatccggcttaaggccgttttgatgacttcagccttgggatccagtacagaaggtttgtaggtcacgtaaactttagctttaaacatgagcagctcctttttcttgtagtcgattaagcacttcttgatataccggcgttaacggtccccgattttggcgaaaaacgtctttatcaagcgacgcgcctgtttgttgatcaaccaagcggaaattatccggtgacaattcgtctgctaataccaatgtgccgtcttttaacgttccatattcaagcttgaaatcaaccaaggtgatgccaacttcattgaagcgttttgtgagataggcattaatgcggtcggttaatgaacgaacttcgcgtaactgttcaggcgttgcttcatgtaaagcaaaaatttgcgcctcgttcatgaatggatcgccgagttcatcggacttgtaataatattcgtggatcggcgggtcgagcttcatcatcggctttacattgaatttcgtgacaaagtgtcctgatgcataattacgcaccaccacttccagcggcagcattgtcgcttttttgacgatcattgtggtggcatccggtgaatcaatgtagtgggttggaataccggcggcggacaactccttaaacaacaaggtcgaaatggcccgattcagctcacctttatgatcaatctgcgctttcttctccccgttcaatgccgtggcctgattggtgtaagccatccataaaacatccggatcttcggttgcaaaaacctgcttggctttgccggtatacagtaacgttgtcttcttcaccatgctgcctccatttgtttgagtatgtccaaaacattgcgatcatcggtcaccgtgatatgccccatcttacggccagggcgaatctcggccttgccataatcatgcatgtgccattcgggatgctgcggccacttggctttagcctgggttaagtcgtcaccgagcaaattgcgcatcaccgctggctgcttcaatttgatcggcgggattggcaggccacagatgcttagaatgtgcgcatcgaactgggaaaagttacatgcctcgatcgaatagtggccggagttatgcggccgcggtgccagctcattggcaatgacgttatccccttcaaggaaaagctcaacccccagcacaccgcgtaaatcaagtcctaaggcaattttggtcgccaagtcatcgatcttatgcgctaacaccggtgaaatgttcggcgctggtgctaaggtaagatgcaaaatgtgatttttgtgccgattttcaacaatcgggaaaactcggacttgatcgcgaccatcacgcgtgatcatgacagaggcttcgcgatcgaattgctgacgtttttccaaaatgcaggggccgtgcgcaagtaacttttccgcagccggtacatctaccaacgtgttgatatcctgttgaccatgtccgtcatagccgcctgttgtggttttcagaatcgctggcaggccgatcttggcaatcgcggttttcagtgttgccggtgaatcaacggccgcaaacggtgttactggaacgccgtgggtttcaagaaaggttttctccttgatgcggtcacgcgttgctgcaaggattgccgtgccttgagggatgcgagttaaatgtcggacagtctcaagtgcagctaagtcaacattttcgaactcataagttaaaacatcggattccttggctaacttggtcaacgccgcttggtcatcgtagggcgccgtaatttggaagtccgcgatctgacccgcgggtgagttcggagtcggctccaaaatgccaacgcgatagcccatggttttggcgctttgggctaacatccgaccaagctgaccaccgccgataatgccgattgttgccggagacgtcaccacatcaatcatttgagtgcagcctcgctttcttcggcgcgtttggtctgttcggcacgaaaggcttcgagacgttgggttaatgcctcatctgtcaaagctaggattgaagcggcaaataaagcagcatttacagcaccggcatcaccgatggccatggttccgactggcactccgccgggcatctgcacaatcgacaacaaactgtcgacgccatttaatgttcgggttttgattggaactccgatgacaggcaaaagggtgttggctgcgagcatccccggtaaatgagccgcaccgcccgctccagcaataatcaccccaaagccttgatcagccgcttgcttaccgaattccgcaagcttatccggcatccgatgagccgaaataacgcgcttttcataagggatcgccagcgccgtcaattgcgttgcaacctgttgcatggttggccaatcggagcttgagcccatgaccacagctactttctgcatcttgttccctgctttctttaagatattttgagaatagcacgttcagaaacaacattcaaccgtaaaatggaactatattagacttattccaaattaatgttcgtattttactggatatattaattcttgcagtgtctaaaacttgaatcatcgctaacttcaatgggaaaatttggctgcgtaaagcgcttcaaattcagcaactgctgcgctaatcatcttcagttttcttgaaaacaaaaaaatcggctccaaagatttgtttcatctttggaaccgatttaaggcctagatgcctaaccccttacaatacggggagacaagaacctgccagtcatttttatgaatgctgcgatggcttaagctgctttggtagaaagcgacttgccatctttggcaataaagagttgtggcgcgaccgttaacaaaatgccgacaacgacaatcgccaatacggtactgaacagcgcagatccgccgttaacgatcaacgaatagatccaggcattcatgccttttggtgcataactgccccagaaaacaacgccagcgataaagtgaatgaagtacttagcaaacgtaccgatgataataccggcgaaagcatagccgctagcctttaccttttcaccaccgcgaacgttcttttgaaaggcagcataggtcaatcccattaaaccaactagcgtaaaggcgattggatattcaagaaagccctgaatcgggttcagaacactgccgccactaaggccacgcagaatcaaatcaagaatgccccagacaaagccagcccatgcggcaggaatcgccccacgccgcatcgccagcaccgcaatcggaatcaagccataattcaactcaatcgccgaaaccccggtggtgtgtggaatatacgtcagcgccatcgcaaacgcggcaataatcgctgtttccaaaataacaaccagacgcttatgttgttgcataaaaaaagcctcctagtgaatccccactcacaaagaaggtcgcttccgaccgttcacaaatccctacgctcgcattaacgaacaggttcgaagggtccgggtttccccgatctcagccaatggctcccctttgtgaaggttcatcgaattaattgatacaactttatcctaccagactttggagaaagggcaaatattttacccagagcgtgagcaggagcgcttagaaatcggagtgtaagtggccttgggcgtgatggcccgggtttaggccattgctaccaaggtccttacacggagatttctgcgactgcgaacgcgtttatggagcgtgagtgcacttcagaaaagccgcaatctcgcaccatgatttttttctcaccgactcaaccgcgccttttcttcacggtgcaaagcctccaacgacttccctgccgtttccggtacaaagataacgacaaacagcaacgagacaatgttcgtcacaatgaagcaaacgaaggtccaaaacatccccatttgtgccaagccaatcgggaaaagcaccccgaccgcaaaattacctaaccacaggaagaaggtcgctgtgcccataccgagtccacgcaactgctccgggaaaatctccgacataagcagccaagtcatcgggctaatcgctccttggaagaaggctagaaagagcatcatcatcagaatggttgtaaaggcacgcagcggcgatcctgccggcaaacgggaagcaaatgtcacacctgtaatcgccagtgacgtaccaattaaaccaataatcaataatggtcggcgcggcacatgtttaagcagttgcatcgtgacaattgtggcagcgaccgccgtgaccccattggcaatgttggcaatcaatgcactgttgcggccaaatccggtcatctgcaaaattgatgttccgtaatacatcatgacattaatcccggcgatttgttggataacgcctaagccgataccgatcatcaatagtcggcgaatccacttaaccttgagcgcatcaaccggcttgacctttttatgttctgcactttttgcaatcgtctgttttaaatgttcaagctcatttggaacctcttgtggggttcgcaaaaccgcgagactgtcttcagcatcttgctgacggcccttcatcattaaccagcgcggtgattcaggaacaaaatgggtgccaacacccagaaggatagctgggatcacggccaagacgatcatccaccgccaaataccgtgaacattgccaaaattcgtccctaaaacggcattcaagatgaacgcaagcagttgacccgagacgaccattaattcattttgggtcacaagccgaccacgccgattcgttggcgcaatttcggccagaaaactaggaaccaaaaccgaaacaccaccgactgccagccccaagaccatccgggccccaatcaaccaaccagcactaggcgctagtgaagaagcgagggtggcgagaaaaaataaaccggctaatccggtaatcaaacgttttcgcccgtatcggtcactaactcggccgaccaacacagcaccaaatgccgcgcctaacgttaaactactggtgacccatccttgtaaacccggtgctaatttaagttcactggaaataaacggcaaagcgccattgatgacgccggtatcatagccaaaaagaagcccgcccattgtcgaaatgagcgccactagtcgtaaccgaacacgcgcagtggaaaaagcaccagtcctgcgctgcaagcctgtttttgtttgatgttgtaaatacatgcaattccccctcattcggtgaaccaccatacttactatcacagatctgcatcgcggctcgacctttttagtttacataataaccataccacttttctgaaaatgctgcatgtgcaccaggtaaatacgatctgcccaggcattgccgtctacttaccaagccacttaaaagaaatgacaaagctctcgccaaagctttaaagcaattaaaaaagaccgccaccctgtttgggatgacagccttcttcaaatcatgacgtcattactgaccggttgtctttttaaccaagtccgcattttcgtcattcgaaatattttcatttagagcaacatcggccatcttagccatgtcctcggtggagagccgcttcatcaagctgcgcaccttaagaacagaagttgcagacatggaatattcgtcaagtcccataccaagcagcaacggaaccatgatcggatcaccagcagcttcaccacacatgccagcccatttgccttccttgtgggctgagtcaatcacatgcttgaccagccggaggatcgatgggttgtatggttgatacaggtaagaaacatgttcgttcccacgatcagccgccattgagtactgaattaaatcgttagtcccgatcgagaagaagtcgacatacttagcaaactgatcagccagaactgccgcagcaggaatttcgatcataatgccaagctgaatgttgtcggataccttaacgccatccttaaccaacttgtctttttcttctgtaaagatctgcttagcctgtttgaactcggaaatggtcgcgatcatcgggaacatgatccgcagattaccaaatgcagatgcgcgcaacaaagcccgcaattgggtacggaaaatatcctgacgatcaagactgatccggatcgcacgataacctaagaatgggttttgttcttgcggtaatggcaggtacggcaaatgcttatccccgccaatatccattgtccgaacaacaaccggctttggattcatggtttcaagaaccttcttgtaggcctcgaactgatcgtcttcagtcggcaattcggaagaatccatgtaaaggaattcggtacgatacaggccgataccttcagcaccatttgccagcacaccatcaagatccttaggggtcccgatgttagccgcaacatcaaaatgcttgccatcagccgtcacggatttcgccgtcttcagttgcgcccattcagccttttgcttggcaaatgcttcagcagcttgcttgaatttggcaacctcatccgtcgaaggatcaatgaccacttcaccagtcagaccgtcaacggaaatcaattgaccgttttgggccttcttggtgacgtcatcggttccgacaacagcaggaatttccaatgaacgcgccatgatcgcgctgtgagccgtccgaccaccgatatcagtgacgaaggccttcacatacttcttgttgagctgtgccgtgtcagaaggggtcaaatcgtgagccacgataatgacttcttcatcaatcaacgccggattcggcaatgtacgacccaacaaatgcgccataatgcgctttgttacatcgcgaacatcggcagcacgttcctgcatatatggattatcagtcatgccttcaaaggtctgaatgaagaattcggaaacttccttcacagcttgttcggcatttactttttcgtccttgatcttggattcgatctgaccggtaaagtcaggatcagccaaaatcatcatatgggcatcaaaaacttgagcctcttcttcgccaagcgattcagcggcctttgcacggataacctttaactcatcattactttgatcaagtgcctgcttcagccgattgatttcctttgaaggatcatcaaccgtttttttgtcaaatgataaatcaggttgaaccagtaaataggccttcgctgtggcgatcccatcactagcagcgattcccttcaaatgttcagccattattcagccaagccttcttttttcatagtatcggtaatagcagcaattgcgtctgcttcgtcggcaccttcagcagaaatggtaacatcggcgccttggccaacacccaaactcataacacccataatggacttgaggttaacgctcttacctttatattccaagttgatgtctgagttgaacttgctggctgcttgtaccaacaaggttgccggacgtgcgtggatcccggtttctgcaataatgttaaattcacgtttttccatgactgatctgctccttcatattaactagatttctagtgtttttccgaatagtttataggcacactaacacctaaaacaattcatgtaaaccttaccattttttgtagcttgccacaagcgtcacatgagatttgacgcttatttagcgggaatcaactgaccggtaatggtattcgatgacaccatcgcgtttggccgtccccacaatttcttcacgatcgggataatttgtccatgccgcccgaaacgccatgaatgtttcgggcgtcaccgtgatcttgtcacgctgaccagtctttaactcatccattaaagcgacataatcctgagtcatctatttgcctcacctcactccataaggttagcataaaagtaggcattgaaaaagcgctaatgcctgatatcactgaaatatttggaactttttagcactcttgtgtgtcgagtgcttgcattctcaacataagggtgtatactattgccataggtcaagaaaggtcaaacctttttcgactatatgtggcacctaattagacaggaaggttgtgacaaaatgttatgtgaaaactgtcataagaatccagccactattcatctttcaaccgttgttaacggaacgcggcaggagatcaatctctgccaaaactgttatcaattactcaagaaacaagcaggaggaaatatgaatccaacaaatgctactgatccgtttgggttcgggagcttagatgatatcttccgtgcgatgaatcagggaatggctcggccgcaacagcctaacgcgcagatcccgcctactcaggcaggacgcggcggcaatggtaacaacggccgcaatggcaatggtggtaagggattactgggtcaattcggtgttgatctgaccgaacaggcacgcaaaggccaaattgatccggtcatcggccgcgacaaagaaatctcgcgggtgatcgaaatcctgaatcgccggacgaagaataatccggttctgatcggtgaagccggtgtcggtaaaaccgctgtcgtcgaaggcttggctttgaagattgccaatggcgacgtaccggcaaagctacaggatcgtcacgtcattcgtctcgatgtcgtttcccttgttcaaggaacgggtattcgtggtcaattcgagcagcggatgcaacaattgatcgatgaactcaaacaaaataaaaacattatcctatttattgatgaaattcacgaaattgtcggtgccggcaacgctgaaggcggcatggatgcaggcaacgttttgaaacctgccctcgctcgtggcgaattgcaactggttggtgcaaccaccagcgacgagtatcggcaaattgaaaaagattccgcgcttgctcggcgactccagcccgtcatggttgaagaaccaagcgttgacgaaaccattaaaattctgaaaggcttgcagccgcgttatcaagacttccatcacgttaagtacacggaagccgcgattgaagccgcagctacactcagtaaccgctacattcaggatcgctttttgcctgacaaggccattgacctgttggatgaagccggttctcgcaagaatctgacgattgcaaccgttgatcctgaaacaatcaaagccaagattgcggatgccgagaaacaaaagcaggcagcactgaaacaggaagattacgaaaaagccgccttctatcgcgatcaagtcacgaaattagaagacatggccaagaaacaatcaaatctacctgaaaatgaagtgccaaccgtcaccgaaaaggacatggaaaagattgtcgaagaaaagaccaacattcctgtcggtgaactgaaagcacaagaacaggcacagttgaagaaccttgccagcgatcttgaaaaacacgtcatcggtcaaaacgaggcggttgacaaggttgcgcgggccattcgccgtaaccgtattggcttcaataagaccggccggccaatcggttccttcctcttcgttgggcctaccggtgttggtaaaaccgagctggccaagcagcttgccaaagaactgttcggttcggaagatgccatgattcggtttgacatgtcggagtacatggagaaattcagcgtctccaaactgatcgggtcaccgccaggctatgttggctacgaggaagccggccagttaactgaaaaagttcggcggaatccttatagtctgattttgttagatgaaattgaaaaagcccatcccgatgtcatgaacatgttcctgcagattctggatgatggccgattgacagattctcaaggtcgtaccgtttccttcaaggataccatcatcatcatgacgtcaaacgccggatcaaccgatgccgaagctaatgttggttttggtgcaaccttgagtggcaagacgcacagcgttctggatcagcttggcaattacttcaagccggaattcctcaaccggttcgatgatattgttgaattcaagccactttctaaagatgacttgttgaagatcgtttccttgatgattactgacaccaacaataatctcaagagtcagggtctgacgattcatgtcaccgatccggtcaaagagaagctggtcagtctgggttacaatccatccatgggtgcgcggccattacgccgggtaatccaggaacagattgaagatcgggtagctgacttctatctggatcatccggatgccaaggaacttgaagcacgcatcagcaatggtgaaattacggttggcgaacctgcgaaagccgaaacgccttcaaaaaccagtaaaaagtaacaacccgcaaacatcacccgatcataacgatcaggatgattgatgcaaagacagaaagcccgtggacaaaatgttcgcgggctttcgattgtacataatattatttttccttaaattgttttataataaaaccagtaggaagagaaatggagggcctgaccatgcgactaattaatgtcaccaacagctttagaaatttggtaagccagcaactaagcggcactgatgcccgacttgtcaaagtcttttcactcggtcaaaccaccgttgtttatacagaagcgccttcacacatcgagatactgttcaccaacgaacgccgcaacattcaacgtgaggaaattgccttcacgcttgaccggctgctcaaaaagtccattgacgaggtttcgccaatcatgggccaccatttagccgaggtaacggtgcctaagctagaacgtcaggctgaataaaagagagtttttgttcattcgttaggcgatcaaacgatgcatcgtcatggttctcgtgtataagcgaaaaggcacctcaaaatccggcaacaaaaaaacggccaacagccgtttttttgttgccaagattaaagcttagccgtcaatttcacatccggatacttgtccgcaaaccaccgctcggcgtattggttttcaaacaagaacaacggatcaccgtgaatgtcttgcacgagcaagttccgcgaactgctcatcttttcgtccatttgatccggatcaatccagcgggcaatacgcgagccgatcggggtcatcacaacctcggagtggtattcatgcaacatccggaactggaaaacttcaaactgcaattgaccgaccgcaccgagaatgtagtcatttgtatggtaagtcttataaagttggaccgccccttcttggaccagctgctgcatgcccttatgaaacgacttttgtttcatgacatttttaggggtgacgcgcacgaagatttccggggtaaactgtggcaacttttcaaattggatcggcgttttcccttgataaatggtatcgccaatctgaaaattaccggtgtcatataagccgacgatatcccctgcaaccgcagtcgaaacggtttcgcggctgtctgccataaattcggtggaattattaagccgcatggttttacccgtccgatgcaaaacaacatccatgccgcgctcaaattcgccggaaacaattcgcacaaaagcaattcgatcgcgatgagccgggttcatattcgcctgaatcttgaagacgaaagccgaaaactcgggattggtcggcattacttcatcgccttgctcagtctttttggggcccggctcaggcgcatatttcacgaaactatttaaaaaggtttcaacgccgaaattagtcagggctgatccgaagaaaaccggtgtctgatcaccagacatgattttcttgaggctaaattgattacccgcatcgtttaacagctcgatgtcatccatcgtttgcgtgtaaatggaatcctgagtcaatggttcactgggatcaagctcgcctttgtcattaagcggcaaaaaccgatcgtcaccttctcgtcggtacagttcgatccggttattcacccgatcgtacagccctttcaagcctttgcccatcccaatcggccagttcatcgcataaccttcaatgcccagtaaatcttccaattcagcaatcaaatccaacggctcgcggccgtcacgatccaatttgttcatgaaggtaaaaataggaatgccgcgctgcttaacaactttaaacagcttcttcgtctgggcttcgatccctttcgccgaatcaatcaccatcacggcagcatcgacagccatcagcgtccgatacgtatcttcggaaaagtcctcgtgcccaggtgtatccaaaatattaatacgtttgccttgataattgaattgcatcaccgaactcgtaaccgaaataccacgtttcttttcgatttccatccaatccgatttggcaaaatgccccgactttcggcctttaaccgtcccggcttcacggatgacaccgccaaacagcaatagctgctcggtaatcgtagtctttccggcatccgggtgagaaataatcgcaaacgtccgccgttttacgacttcttgtgctaattcctgtggtttcattatctggttccttccaaaatgttcaaagttactgccagcacctgctccaagtcattttgagccgtgctagctatccgtctccttggacgatacttctgtcgatgtctctaacgtcggcacatcagttaaatgaatgtgaacgttgacaagccgtgacccttccactttgccggtcgacaacatgacgcccggtgccagctcaagcttttcgctatgatgcgtcgaagggatcgcaccaagctgcgtcaacacatagccggcgatggtatcaacatctggcacatccagactggttttgaataaatcattgaactccgaaatcggcatccgcccggaaacgacatagtcatgctccgtttgtttcgtataaagctgctccgcctgatccgattcatcatcaatatcgccgacgatttcttcaagtaaatcttcaatcgtgacaatgccaacaacaccgccatactcatccaaaagaatggcgatttgttgttggcgagtttgcatttccttgagcaatgcatccacggtaatggtttccggcacaaacaccggctccgtcatcaccgattcgattttaacatgttcaaaaccgactcgccgtgcctctttgagtaagttcttgatatggacaatcccgatgacatggtccttatcctcttcgtaaaccgggattcgtgagtaaatattatttaaaattgcgtcgattgctttttgatcaggttcttcggcatcaatcatgaaggcatctgttcgtgggaccatcacttcgcgggccattgtgtctgacaacgagataatcccttcaaacatttgatattcatcaggatcaatggcgccagcattccggccattttcgatcatggcgaccatttcttcacgcgtaacagattcgccttggtggttaaattccatgggggtcagcttcatcagtagttgagtcgacgccgataaaagccagacaaatggacgcattaacgtcgctagccagctgatcggcgtcacgctcattttggccacgcgttctgttctttgaagcgccacctgcttgggataaagttcaccgaagacaagcgaaaaatacgacaaaatcaacgtgactaaaataaccgctgcttcatgggcaaaggaccactgaccaaaaatcggggcaattcgatccgccagtgtagttgcagccgaagccgatgcaaagaagccggcaaaggtaatgccgacttgaatcgtcgccaaaaaccggctggagtccttcataatggcaaccaacttagctgcctttcgatcacccttatctgcctgtgcttgcattcgggtacgtgagcttgaaacgaccgcaatttctgcggcagcaaatcctgcattaattaaagtcaaaaagataatgaggattaactgtccccatatctgaccgtctgggtcactgcccattcaaaaacacaacctttcgtaaaaaaaacggggactcatccccgtagttcgatcacttcagtatagcaagtccttatttctttttcaattcagaatcgtgctgcgcgccgtcctgtggggtcggctcgggtagttcgcgctcatcatcaaaatcttcgtcatccttatgttcttgatggaaccgatatagttcgtataagtaagtaatgacggttttgatcacggcataagtcggtacagccaaaatagtgcccagtagcccccataaattgcccgccaccatcagcaaaataatgatggtcaacggatgaatgtctagagaccgaccgatgacattaggatagatgaagttcccgtcagtcatctgaataatgacgacgaccaagacaaccagcaaaactttggtccatccctgggttgccgcaatgaccagcgctggggcaatgccaatatacggtcccaaataaggaatgatggtgaccacaccggcaatgaaacccagcagatacgcgtatggcatgccaatgatcagatagccaataaacgtaaaggtgccaacgaataaacattcaattgcctgaccaccgatataatgcgatagtgtggcattcaagcgtgtgaacactgttgccacctccgcatgataccgccgcggtaagagtcgctgaatacttggcacgaagttttcgccgtctttaaggaagtaaaagagcatcaccggaatcgtaataatgctgaccacaatacttgccaaagaaccgatcatacccggcaatccacttgagaagctgcctagcacctgactcagcaatttgcttggcgatatttgtaagcttgccacatatttgccaatgttaagccgctgataccaagtgtagtgcgaagccttactgataaaggaacgcaacccctttaagaaatccggaatattggtaatgaattgggtgacctggtaaatcagattcggcaggaccgccatgacaattaagacgatggcgccaataaccaccaggaaaatcaaaagaatcgaaatattgcgactgatatgcagccgttgcaacagcttcacaatcggattaaacaaatagaacaaaaatccagccgacagaatcgggatcagcagcgttgaaaagaacgttgcaaccggcgcaaataagaacgagacttgggtcaagcctatcaccacgaaaatcaggaccaataactcgactgaccagaacattaattttgaatggcgtaacttatcaaacataatcggcctccccaacctcttctcgctagtgttataatagcaaacaatttatcaaaacggaaagaaggttcgtaccttggaaataaagacaacaactgctttagattcaccgattcatcaagatagcgttcagatccggacacatgttttcgtcaaggaacagcacgtcccggcagatctggaagtcgacagtgatgaaggaaaagccacctactttgtcctttatgacgctggcttgcctgtggctactgctcgaattttaccggaagcaaacggctatcacgttcaacgcgttgccgtggaaaaggtctaccgcaagcatggccttggcaaaatggtgctaaccgccatcatcaaatatgcccgccagcatcatgtggcgtttctaaaactcggcgcccagattcaggcagttggtttttataaaactttaggatttgaattaacgaatcgaccggaattcctggatgccggcattcaccatcgtgaaatgatgctgaaactagattaagcggtgtttcaggttagtccgattaaaccattcaaatttgaaaaaaatacgcttctaatttgattttattagaagcccatcactgcaagcaggccatgccgggcttgcttttttattcatattcgtcaaccccggtcaactgatccggatcaatataaaggcgataagccaccgttttgaccgccgccccatcaagcagataactttctagataatacgggtgatccgtctgacctaggcgttcgggcagtggataccctgccttttcgatgatctgtaagcctttattaaagctggtagccaacggtaattcttttgccaaaacttgactggccggttgcttcacttgcccggccgtcgccgctggcagttggaaacagtcgtaagcttttggtacatctgtccccgccggcaataagctgccaatccagtacagaaaggtatcatacggcgaaaagatcaccatcgccgttcggttaggcgttttggccaactgatcaagcgatttaaatcccagtcgctgttcgaaatccgtccacgcagggcgaaacgtgccgagttgatcgctactttcggttgtataagcatgacctgcaaataattgtgcaggttgttgcggaatttgtttcatattgcctccaacattcataccgtcttcagattcgatgggccaattgtaagtaccggcgataccacaaatctacataggcttgggaaaaaggccccttaccgtggttgatccaatcgaccagcactttaacgttggctttcaaaatacgatccgtcgtggcggggtactgccacattttgcggtgggcttcatattcatcaacatccagcaggcgcttttccccgtccgcaaacactttgacatctaaatcgtaatcaatatatttcagtgcttcctgatccatggtaaaaggggtcgccaagttgcaataatacgaaacgccgccttcacgaatcatcgcaatcacattgaaccagtaatgcttgtgaaagaaaataattgccggctcccgcgtcaaccagcgacgcccgtcagactcggtgaccaaggtatgatcattgcagccgatcaaggcgtcttcactcgttttaagcaccatcgtgtcacgccaggtgcgatgcaaactgccatcatgtttataactctgaatggcgaacgagtcgccttctttagggatcagcatacaaaacccgctttctaaaattccgatttccattataacaaagcttatcggataccgctaaaaaactagagctctagtcctcttctgccaaatccgccaaaacatcatcgatggcatccaaatcgaaccccttgcgaaataaggccgacttgaccttttgcttacgaattcgcgcttcgtagtgttgttttaaccgccactgtttcgctgcctcggcttttaaaagtgccagctcactttctgcatccggttgcggatcgagaatttcaatcgcagcagcaatcgttgcttcatcaaagcctttttgaatcagggcaacccgcagtcgctgtaattgatccttaaatgcccggttttgatggtggcgcagatttttttgacccgcacgcaccgctgcttcagtccaggttgttgaagggatggcggctagttgctcggttaacaagtcggccgcaatgcctttctgttcaagcttgtgacgcaccatgcgcggccccgcttcgcccattttgctgttggcttctaaataacgctgaacatactcggcatcgtttaaaaatcccagctcggttaaacgctgtaagatttggctgatgacgtcttctggaaattcttctttcgccaaccgttccttgacttcgtgatgggtacgactttgatggttaatgtaattcagaccgatctccaaccccatggcaacgacttcgctgtccttgatctgggcctcctccgctggcgtgagtgtcatccctttggcgagctgataattcaccaacgttgtctcactgaccggaaaggcatactcaccgtccagaaaaatattatagcgtccccgccgtttttgcgctgttatctttgtaatttgccccatgcgcttttgaccacctttctaatcatgccatcacttatgttatacttttcataaataagatggaggtctgttatgtttgaagctagtttttttgaccgtcatagtttgattaattatcaactatttcgggcaatgaagaccttgccacaaacaaccatatcgatcaatgcacttagccgctcaacaggtttatcatactcgcaaacctacacggcgtttcagaccgttttggttcagcttaataaaatcattcctgacgaagccgttgacgaggcaaattttacccaatttttaaaacgggtcacgctcaaccaataccgctttgccttgcttaaagacagcctgccgtttgaattcttcgatgacgtgttcaaaaatccgcatcctgattttcaccagtttaaagaaaatcatcagacaagcgtttcaactctgagacgccgaattaccccatttcgggattatttggcggacaacggtgtcagtctcaacagcacaacctgggcaattgaaggtgatgagctacatatacgcttggccatgtttaccttttttatgcttgcttatcgtggtgcgggctggccgttttcagctgatcaggaacagcaggcaaagacgcttttgacggagattaatcaggttgcgccaacctttttgttggtaccggtgcaaccgatgtccaaagaagcattggtcgtccttgccattcagctaatgcggatcaaagccggccataccctattgccgaatcgccgcatgcagttgcttttttccgaacacgacgatttaccggatttgattttcacccaatctcggtttcctaatctgtcggcatctgagctgaaggcggaaaagcaattttattattttatgcgcatgtattttatgaccgtgactcggcaaccgcaaacactcgatcggcaaatcatcgaccatttcgacgaaaccgataacctggtgaatcgattcgtttttggattgctcagccacttaaacgatcagctgaaagaaaccgatcgccagctgattgccgaaagccaagtcatgattgccaatctgtatcgtctcagttttaatgaatatgtactcgatgggcgatttagccagcgcatcgattttgcccaatcaccttacgaagaagccgatagcagtcagttagctgcggaaattcaaaggtacctcaaaaagattcctaaatcgatgccggaatctatttttgccgacttccccgagccattcgtcagcggcctttatctgttggtgaaggacaattatcctgaacttaaccgggacatgcagatggttgtcaatgttctcatcgagcatgactcgtttgccaaacgggacttgctcaactttttggatgatctgggctttatccgggttgtgccacctgatgcagcagtcaaaccggatctgatcatcaccagcctcaccaagccaaaacgggtgatcccgcgtctgggccacccgtttgatcccgcaaccccgctgattacctggatgccggaaccgactgatttagattatttcaatctttatcgccgactcaaacaattacagcgtcaacacggctcatcagcggagttgtgaacctttttattttagtgaaaaggcttggcggtatagccgacaaaataaaccaacgcctcatagccggccagtcccagaacgaccgcggtaaccaacatcgtgttgttcaggttactattgcggttaaaccacaaaaagaccaccattagaaacatcacgacaaagtaggcattttgcaggctgcgattgatctgaatttcaaatttagcctcaggactttggtaatcaatcgcatgtaccttgttcaatcggccaactttataggttattttgtcgccgcgttggactttgagatctaacgtttcgccaacgtgcatgacatgtggcgtgtcgttttgccaaacggtcgccgtcatttttttgctcatggtattcgaataagtaattttcacagtcaatcctcctgaaagtacattatactagaatttttcagggatcgtcaccatttgtcagcgtaaaggagtatttatggcaataacggttaaaatcggacaacgttttccattgactatcaagcgtttggatatcaacggcgcaggtatcgggtactatcaacgcaaaatcacctttgtcaccggtgcgctccccggcgaggttgtcgttgctgaagtaacggcgattcatgaccgctatcttgaagccaaggtgcacaaaattcgttcagcctcaccagatcgggtgaaacccgcggaaccgctctatggacaaattggcggcgttgaattaaaccaccttgcttatccggcacaattgcgcttcaaacgggatgtcgttgcacaagccttagccaagtttaaaccagccggctggcaacattacgacttaaaacccaccatcggcatggcacacccgacgcattatcgcaacaaggctcagttcccggttcgggttattgacggtcatgttcgcgccggtttatatgcgcccgggtcacatcatctcatccccttaacccattttttgacacaggcgccgttgaccatgaaagtcgtgactgctttgtgtcagctgcttgaagagctccagattccaatctatgaggaaaaaaagaacgccggcattgtcaaaacgttggtcgttcgggagtcttttgcaaccggtgaagtgcaagtcacgttcattaccaacagcgctaaactgccgcagcagacaaaattggtcacggccattgcaacgcgtttgcctatggtcgtcagcattgcccaaaatattaatccaggcaacacttcaattatttggggcaaggaaagccgacttttggctggccaaccttatattcatgagtcattgttaggccgcacttttcaggtttcaccgcaagcctttttacaacttaacccggcgcaaacagaacggctttatactgtcgcaaaagatgcccttgaattggcaccaagcgatacactggttgatgcgtattgtgggatcggcactgtcggtatcagcctcgctgaccgataccagacaatctacggcatggatacggtgcctgaagcgattgccgacgcgaaggccaacgcggctcataatggctttaccaaggcccactattttgttggcaaagccgagaccctgtttcctaagtggctggaagaaggaattcaccctgacgccgtgattgtcgacccaccgcgtgccggccttgaacgtccttttatcgatgccttgctgaaccttaaccctaagaagtttgtttatatttcctgcaacccctcaacattggcgcgggatctcgttcccttagccaaacattacaaggtcgattggattcagagcatcgatatgttcccacaaacggcgcgctgtgaggcagttgttaagtttacgcggcgctgatcgcattaaatgaagcagcatcttcactaatctccattcgtcccccaattcatctatccaaagcgaggttcctgccatgaaaatttattttgccaacgcccttttcagtcatgccgactttgattacaacgcaaaattagccgcgcaaattcgcgccgccgttcctgacgtcgatctgtatgtgcctcaggaaaacgcggcaattaacaataaggaagcttatgccgattccaaaatgatcgcccaggctgatactgatcgcctggaggctgctgatctgttggtggctatcttggacggcccagtcatcgacaatggggtggccactgaaatcggggtcgcctatgccaccaaaatcccgatactcggcctttacaccgacagccgacgtcttggcgctactaatcagcaaaagctcgacgccttgcaacgggttgccgaaaatcaattccattatctgaatctttatacgacagggctaatcaaactcaacggcgacatctacaccgatgaagcagcgttggttgcggccataaaagttcgggcaaccgcctaagcctagctaatcaaaaaagcttccgccaccagataacaatctgatgaacggaagcttttttatgacgcaactaaacattcgcagtggttttttctgcatcttcaagcaattgccggaatgggatcagactctcagcatgatacttcttcacgaaggcatcaacggcttcgggatcctgggtttgcttgtcgagaaccaattgctcaaccggaatcggccgcaagttggaaatcttcacatcaatcacaaccggacccttacgatccttcgccttagcaaacgcatccttaagttcatccagggtgtggacttcaaagccttgagcgcccatggcttcggcagccttgccataatcggcgccgatcagatcgacccctgagtgcggctggtgcgtatcgtcttgctctgcttcgatgaaccctaggctttggttcgtcaaaaccacgttaatgatcggcagatgatacttcacttgcgtcatgatatcttgcatcaccatcgcgaacccgccatcgccagaaattgaccatacctgacgatccgggaactctgattgtgccccaatagctgccggcaatgcgtaacccatcgttgcataccagccggacgttgtgaatgcctgatcgtcgttagccttaagatagcgcatcccgttaatcgtcacgttaccaacgtcgacttggaaaatggcatccttttccgccatttcattgatgagcttgaagattggctcaacccgcaatggcgtttcagcgtcgtcttcaaaggacttcatccaatcaacccagtttgccttattggctaatgaagcgcgataccaagccgtttccggtaatggctcagcgacgttggtcaatgctttgatgaacttcttggcatcagccagaaccgctaagtcaacggtgtgacgccggccaaacttgctggcatcaatatcgacttgaatatatttggcattcggtgcgataaagtatggctggaatgggaaatccgaaccaaggaacaagaccatatcggcaccacgggcaacctcaacgcccggcttggacgcaacccggccagcagaacccatattcgctttgtagtcgtcaggcacaacgccttttgccaaagccgtcgtgataatcggaatgtgcgttttttcagaaaaagcgattatctcatcccgggcaccacgcgcgccattaccaacgtataagattggcttcttggcacctttaatgatgctccaagctgtcgcaacctgctccggatccggctcaggtaaaagcggcttctggtagagattggctgacgaaacataattgtcgtcaatttgttcccaaccaagatctttaggaatcgtcaccaccgctacgccctgatgcttgtaagcctggcgaatggcctcgtcaaccacatgtggcaactgagcagccgtcatcgcggtccggttgtaaaccgaaacatcggcaaacatcgggttctcattcatttcctggaaaaagttggtgttcatggcagcagttggcacctgcccgaccaaagccaaaaccggcacatgatcgtattgcgcatcatacaatccattgagcaaatgcaccgcgccagggcccgcagatccgaatgtcgcgccaatacgaccagttactttagcttcaccggccgcggccagcgcaccgacttcttcatgccgaacctgcacatagttgatcgtgtgacgccgattataaagtgcattcatcgtgctatcaaaagaaccaccaggcaacccataaatgttatgaatgctccagtcttcgagcaccttgatcattgcgtctgcagcgttgattttttctgtcatgacacttgcctccattattacttacattttgtaagttcattacaaaaatgagtataacaattaatcgtcagcaatgcaagccctttcacctcaactaatcttgcaaaaaggccaaaaatctagaaatcgcttccatgaccggcataataagcccatgggaaccataacagtcaaccaaattgactaatacagattggtagattcttcaccgctcgccgaaaataatcgccataaaataaccagctgcaaatcagattaatgtggcaaagtcgatgaatcagccggctgcttttcgtacaagcgttcttgcccaaccacgccggtcaacacaaactgcccccggaagtatgccggatccggccgataatcttcgggatcataaggcaccttatcgctgaacagcgtctcgtattccggcaccgtcagctgttgacgatcatccaattggcgggcgtgagcggctgactgtagttggtctttgaagcctggctgcaaaacaccactgaaaaactccgccaccgcaccagagccatacgaaaagagcccgatacggtctccggcctgcagtgttgcatcgtgatccaataaggaaagcagtcccaggtaaagcgaacctgtataaatattgccaatccggcggcagtagcgggtgctagcttcaaaccgttcctttaagcgcttcacagtctgatcatcgacttggggtaagactaaatccaacgcctttttgcccattttggtgtaaggcaaatggaaggtcatccccgcaaaatcagctgcggtcaaactgttttctgtctgataacgatcccagaccgcctgaaagaaggccaggtactgttcagtggaatactttccctgtgcaattgcagtatcttgataaaccggccgccaaaaatcattaattgatgccgaacgataaaccgaatccggctcgatcgtgatcagtcgcggatccgccttgacgatcatcgccacggcgccggcaccttgagtgacttcacccgctgtcgccaagccgtaccgggcaatatcagccgcaatgaccagcacgcttttatctggatgcccagctacataatcccgcgccatcatcaaagccgcagttccgccataacaggcttcttttaattcaactgcacgtacccattcaggcaagtccagcagctgatgaataaacaaagcagcggacttgcttgcgtccacaccactttcggttccgaccagcaccattcccaggctgtcccggactgccggggtcattaatggcgctgcagcattggcgcccatcgtcacaatgtcttgacttgaaggcggtaccgcctgttcatcttggccgataccgatggtgtacttgtccggttcatctccccgaacctttgcgagttccactaaatcgacgtaaaagtccggtgtatccattgcaatggcatcaatcccgattttcattgtttgattggcctactttctgatttgatcgaatgtttgctaaataagttttggcatgtgctaggtccatttgctcttcccgcaatgcagcgaccagagccggcagttcgcgttcgtccgcaccggccgcaatcgctaaggcattagcttgcagcttcatatgcccggcttgaatacccggtccggccaatgcccgcaatgccgcaagattctgcaccaagcccaatgccgcaatcacctgctgcatagtggctaaatcgcgataaccaccaaggcggcgggcagcttgtgccaatggcaaggcaccgattgcaccaccgactgccccaagcggcaacggcatttgcagcgttccctctaatttatcggcatgcatcacccagcgcgataaaggttgatattggccgctggcagccgcaaaagcccccgcacttgcagcaactgcccgcgtgtcattgccagttgccaaaactgctccaatgacgccgttaagaattcctttattatgcgttacggcacgttccggatcgacaaaagccaattcgctaagttgcacgatttttttggcaattacctcacctgacaccgtctttgtggcaaggctcgctgggtccagtcgaactatcgcggtcactaactcggctggggcgtttgttaaaatgctaaccaaaatcgtcccgtcaagccaggttttaaccgctgctgcaactgcttcggctaccgtattggcataattggctcccattgcctctttagggtcaagggttaaacgaatcttcaaaaagcggttagctagcacagagactgttacgccaactaacccgccaccacgctgaatcatggaaggatgggcagctgccacaaccgctttgatatctgcttgatgggccaaaacagtttgcttggcagcttccaaatcggctaaatccgttaaaaccacctcggcgaccacctgatgtggagcaacccgtgccacaaccccgccattttccgcagcaatccgcgcaccattactggcggctgctacaacagagggttcttcgttggcaagtggtacctgatgtaactggccattcactaacaggttgcgcgcaactcctaaaggtagcgaaaattcaccgattgaattttcgatcagcttcgcttcggttgcggcaggaagggatgaggtcgccgcgaataaactggcatccgcctgcgtcagcgaaccttcgcgaatcaattgcgcgcgcctttcttcaggcgttttttcgtaaaatttcatcacgccctcctaaacatgccggacgacttgcatcgcgatgccgataccgccgccgacacataaagctgcaataccggtcttttcatcacgttctgctaagttataaagtaatgaaaccataatgcgcgcaccggatgccccaagtggatgccctaacgctaaggcaccgccattgatattcacctgttcatcggttaatcccaagtcacgcatcaccgcaacgctttgggaggcaaaggcttcattgagctcgacttgatcaatggacgaaatcgaagtgctattggtctgaagcaactggtcaatcgccaatttaggcgcatagcccatgatatccggatcaatgccaacttcagtataatccgtaatcgtcgctaaataatgtagtcctagttgctcggctttacttttggccatcaaaatcaaagccgccgcaccatcattaataccgcttgcattgccagccgtcactgtaccgccaacttcaaacaccggcggcagtttggctagttgagccagcgacgtgtctggacggatggcggaatcggtttcgacggtgacatcgccatggcgaccggcaatcgtgactggcgccatctgcgatttgaatcggccctcagccgctgcagctgccgcgcgtaaatgcgagcgcaaggcaaactcgtcttggtcgcggcggctaatctcaaagcgcgtggcaatattttccgcggtgatccccatgggttgctgactaaaagcgtcatttagaccgtcgcggctgagtccgtcaacaaatgccgtgtcgccaaatttatggccggcgcgcatggcttcggcgtaataaggcacctgactcatgctttctgttccgccaaccagcacggctgtggcttcgcctaattgaatcgccgcctggcccagacgaatcgccttcaatccggatccgcacacttcattgactgtcatggccgtggagcgatttgccataccgctttttagtccaatttgccgcgccacattctgacccgaaccggcctgtaaaacattcccgaaaatagcctgatccaattgctcaggatcaacccgcgccgctttaatcgctgcacgtgccgctgtaactcccaaatcaaccgcactggcgccagcaagctcgccgcccaacttcccaatcggcgttcgcttagcactgagaatgacaactttttccatggtgacctcctaatacgtacaatcgcgctttttacgattcttagataaaccgttacagtttatcacagacttaaatgtaaaacattgagctataattagaggtatgtgagcaggaacgcttagaagccggagtataggcaggcttcagcacaaaaaactgtgcttacaaaaccagcgcacgttcttataaattttcccaaacatactgcacaaattaaccactcgttatgctgtcttcacctcataaagccaaatcaaacataagcttgcgtcaaccacccctgactaaagtcagtggcttgtgagcaagcacccctgttacgagcgcttgaatcacaatttgcacagatacaccactgcaggcagttcgtagaactgcttgtcttacacggcaattaccagtgcctttagcgtccccaggctgccatagggacgagcctaatcaggctaatttagcaatacctttgatcagtatgttctgagcggcattgtgatcgcgaacatgatgggtctggcatttaggacacgtccactctcgatcagcaagcgtcagcttatcagtgccttctgtccctctgacgaagtcgcaatgatggcaggtttgcgtggtattcttaggattgaccgttacaaactggcgaccataaaggtcggccttgtaagttagcaagcctaagaaggtacgccagcctacgtctgcgatactcatggccaaggcatgattttttagtaagttcttactgcgcaattcctctgcaaccactaaatcgtggttcttgatgagtgtggttgagacgttgtgcaggaagttcttacgacgatccagaacctgggcatgaatcttggcgactaacaagcgctgtttttggtaattcttactgttacgtaacggccgatgttccttctttgcccttcgggcacgacgtgacaaaacgcgttgttccttggccaatcgtcccctgattgttcgatagtagcgcgggttggctacgactttgccatcactggtagtcaagaagttttccgtgttgaggtcaatgccggtttgccgattggtcttagcaggtttcgtcatgaatggtgtatcggaacccagctgcatggataaaaagaaacggtctgcggcgtccttagtaatcgtgaccgtgccaatacgagtttctgcttttcgattcagtaatcgtttgtgggagcctttaatgcgtagccgacctaacttaggcactaagacgtgctggcaatcttcaaagcagacggtcccgttggttagctgcgccgttttctgctggatatattggcaattagtttgatagcgccacgcatagcttttacggtggaattttgggacgccagtactatgaaccttccgaaaggctttccatgccttgcggtagtttcggatagcgttagctttagcaagactgtcaattcgcttgtcttctaaaaactggaaatgatttgacagctgcttggcattttgtcgtaattcaagttgcttgattcgatcttgaaccgtgtcaattggtagcttaacttgttttaattgccagagttctttaccgatcgcaaccatctcgttatagacgaagcgactggcatcgctgttaagcttaatcaatttcttttggcgatcactcgggtagatgcgaaccttcaagccataatgatattctaattgtgccattgactccattttatctcacctcttttcttgctataatggtattatagcattcgtcaatgactacaacaattgaggtgacttttatgactaaagaaaaaatccaaggnnnnnnnnnntgaaatgaaaagcattctgcaaaaggttgccgatgataataagattgtgatcgaaaaaatggaagtcatgcccgatcatgtccatgtcttgatcagttttccgcctagcaaggcgccaaccagtgccatcaaggcgctcaagggtagaagcgcctttatttttctcaaacggcatccggaaattcgtcactctcaggattggggtgggcatttgtggtcacccagctactacatgagtacacttggcaacatgagcaaggacgtggttgagaattacatcaacaaccaaaagtacaacgaactaacaaaacgccctaaaaggcgttgagagcgggcctatcgattccaggactaaagacacgggatttccggccagccataattaaattgtatgcgattgttctgataagcaccaacagtcttcatgaatccttaacttttgccattagaaaggaggccgccaccatgcgagtgattgatttactcgctttattagccgaccaaaacaaaaacgcctccgtgttgctggacacgcaaccaacaccgagccgttttgatgattttatcctgacaaccgctgacgatcagccgcaactgatttttaaacccaatttgacccggaaagcgcctttacgtgtctgggaattgcagctcttgttaaaaaagccggatctccaagcgcgatttttgtatctgacagacgcaaatgggccacgcgctctttttgggttcatcaagcgccagaacggtttagtacttaactaggctgggtgcttggctgcggctaattcctcggccaccttttctaaatagtgatggctggcaatcatttcctcacagttgaattgatccttcaacccgatttcataaatccgactggccttagggttgagcagcggcaaaacccgcgcccagtcgatccgcccctgtcccagtggcaggctgtcatgcgttttgcccatcgaatcgacaagatgatagtgccgcaccaaaggctttagattcgccaaactggccatgagccgatcattatcgccgtgaagcgtgatgaaagtgtgactggtgtcataggctagcggtagctgccaacgcaatatccgcgcctcaaaatcaggatcgccatagcgaaaaatgggtgacatggagttttcaaagacaacgtgtcccggtgcctcctgtgcaaaggcaatcatccgcgctaaagcaacatcctgcgctttagcaacgtccgtccacccagcataatcgcctggtgtgtccacgcgataaccgccatgaatcaacgcagtcgcattcacttttttagccagattcatgagcttaatcgaactggtcatcataaaatcataacgcgtcggatacttggttggattcatagctaactcattgcgttgaccacggaatcgcatcggatgatggaaaaccactgtgggcacttggctgcgcacccaagtcaccattttcaaaaaatggttccatccttcagccgtaaaatcattttcggttaagtgaaattcaaatacgtccggatgatactgcaaccgatcacgaatctgccgttcatctgtactagcttttaatcccagtaacatcgattatccgttgcctcctcatcaaattgatcacacaagtgtcaaacttaccataaggccataacgcgttcgccgacgcagaagtctgcgtgtaaggaccttggtcgcaatggcctaagcccgggccatcatgcccaaggccacctacactccgacttctaagcgcgccggctcaagctcacctcaacttggcagtcttctcataagccgcttgagctttttacgatcaatgagcataacccctagatcatctgccagggcgattgccgagtcggaaaagtcactgttggtgatcaccgctgcttgatcaagtttataaaattgatggccggcccaaacttcctgcaccgctttattgccgacaaaaccggtatagcgtttgcattgaaacccaatggactgccctttttttcgagcgataatgtcgatcccctgatcaccggaagcttgtgtcagttgaatatgtttaaacccgttccgcttcaacaagtatgcacaaaactcctcaaatttctcgccttccatgatatcgacattttccatttttaaatcacggaagcgaaaatggtgatggtacagccaaatggcattcaccaccacaaacagactaatgatcacaaaacttgccggatcgccatatggtcgcaactgccggggcagaatgtcgcgggcccagaaactgtaagcaagtgccagaataaatagtgcccacagtaattgataggccttcttaagtaacgttctcatggttccacccttctctttccttatcaagcctagcagattcaagtcatgattgcattgaatctggagcaatttttctgtaggcttaaactattgagagaggaagcgttttcgccatgaaactaagcgccaaaatttttgccaaagtcggtcaggaacgaattacccagtatactttggtgaatgatcatcacatgaccttacgctttttaacgttcggtgcccgggtccaacaggttcgtctgcctaacgcgaccgggtttgaccctaacttactgcttggatttgtcactttagaagactatctgcaccagccggggtttttcggcgccatgaccggtccgctgcaaccagcggaagcgaatgtctctggcgcatggcaaaactggaactgggcggtgaaaaccagtcaagagcctgatttagtcatcacgttctcgctagacttgccagaaggggctgatggccagcccggcacgcgtcaacttagcattacccaccgactcaacaatgcgaacgtctggacaattgacatggcgatccaaaccagcgcttcaattcgtttacatccccgcctggtattgccttggttgctcacggctgatcccgcgcaaacgatgatgcaggctaaattaacaattgcctctcagccaaccgcaattggaaagcaaccaaaagtttattccgagcaggactatggtttggcagccgctgattggcaactccattacctgactgatgcgtcagctacccgaatcgatccgttcgccgacgttggtacgcaaaacaacttcaacggcatcctcggacagccgcatgtggcaatcggctttgctcctgaagctaatttgcaagctcaagcctgggaacttcctgcaggtgcgacatggcgccatcatgctgaatatcacctagacattcggcagaagtcgtaaaccagactcagttgtgtctaacaaacgcatttagttgatcaaaaaaccttgtacgcgtgacccgcacaaggttttttgattgccaatattctggttaatagttcaggaaaacatctttataaactttcacactgtcaaaaacatcttgaagcgtcacatattcgttggtctcatgtgatgtatcatttcccggcccataaattgccagatctaacccatcgtgatagaacaaggccgcatccgtaatcccggtccgatacgccactgccccgcggtcaagcccgacacgttgccgggcctgctgaacggcctcaatcaaggcattgtcaggcgaagcagcggccgcacccagcactgagtcaattgaaagtgacagatgcacgccttttggtacaggcgttttcgccgcttgttttagcgcctgaataaacgcatcattgtcggcaatcatggttgtgcgaatattgccacgcagataggccgactcaggtagcgagttgatctggttcccgccatgaataatatcaatattgtgcgtagcgtgtcccaaaatcggatcatccttggcctgcaatggcgctgttgcggtcaacgccgcattagcaaatgcaaacaaaccgtgaatggcattggccccaagatccggacgcgatgaatgtgctgctttaccatgtgccgtcaacgtataatcgataatcccgcgctcagccgcatctacgttactattgccaggctctgccactaaaagaccattgaggcggtcgccataacccgctgcggccaattgccgggcgccataattatcgatttcttcaccgacagtggccatcaactgaatcccatgatccagttgcgcatgcgcgacttgtttcaaagcgacaaccaccgctgccaacccggatttcatatccgttgccccgcggccatataacttgccgtcttttgtctgtcctgaaaacggtggaaactgccatttagattcatcgccagcatcgacgacatccatatgcccgtcgacacctaaccaccttttggcatttggatcaccaacggtcaaaaccagattatcccgtccaggagcataagtgacccgctcgcgcttgattaaaccggcttgcaactcaggggctaaataagcctcaatcaaatcagcaacttgaccttcttttgcgccgacactcggtacttgtaccattgcctgcaataaatcaacgacttgctgctcttcatctgtcaatccaaaacctccgcttctcaaaactcatgattaccgattctaaaactactttcgccgaaaacgcagtaacgcatggcctaagatgggtgtgacaataccacctagcaaagcttcagcaaccgcgttaatggccagcgccgtgatcagcagccacccgagattggaggcgttggcacctggcacaatttgcgcagccttgctcgaaaaaagcaaccaggtaaagccaatgaccaaaagtgtgttggtcaaggcaccggccacaccggcaaataccattttaatcgtttgcgccagcgcactttgatggcgtttaaacatttggtgaaagataaacgccgccacaagaccaaccatgacgcgcggcaccaatgcaataatcggattacgaaaaagcaataaagtcacaggatccgtcgctgacgtataagcacgaatcaggctcgtcagcccccataataagccaagactggcaccgccgccatatcctagaacaataccaccaataatcacggtcaaatgaatcgtcgaaatggcaggccaggctggaaaaatctgaacataacccaccatcggaatataagcctggaggataattaaagcaccgagaatcccaataatagcaatgttatacgctttccctcgacgcgtcatgctagacaccccctatttgtttacagttagctctatcagattatacacgttccaggcagcaccaaacaagttcagctttcagtcaggacttgtcaacttttcgccattctggggttcaaccgaatagtaaatttttgttgactttgatcatctgattttctataatattgcttgtgcttaaatatccatgcgggcatggcggaattggtagacgcgcaagattaaggatcttgtgagcatttttgctcatggaagttcgagtcttcttgcccgcagtgtaaaaagatccgaccaacaacgataacttgttgatcggatcttttttaatgattggttatccgtaaccgcttaattcgaatgagataggagtaacttaaaatgcttcgtgaagcccaatttgttgatctgtctgcaatcgtggatctttaccaacagcttacaacggaaatggcgacattggcgccggacacgtatcgaccattagccactgataaccgccagtattttgccgattatctgcaaaacgaccttgcccggttatttgtgaccgaaagtcatgggaaacttaccggttttgccttggttgtcttagcacaaaccagtgcaagtcctgaatttgtgccgcaacattttgcccaactcatcgatctctttgtcatccctgatcagcgtcatcacggcttggcgaaacagctgatggcggcggtcgcggcttttgctaaaagtcaccaggcttcttttattcaactcaatgtcctcagtgccaataagacggctcgtgaagtatacgccaaagccggttttgaaccagtcaatttaacgttacaaaagccactcaactgatcaccgttttttgtagtcgcaacttgcctcggcagtggccacaggcataccgtctgacgtcaatccgccgccgacgaatgaattgccgaccgcattgcgtacagacataaacatattgacgaccggtcgtgggcagcggcggagcaaagcgggacccgccaactgctgccagtaattggcggaaatcatgatcgcggtgttggtacccgcgatgctgagcgtacaaatgatagtgcaccagttcatgcttgatgatgccatcggtgattgccgggggataagcggcaaagagtttggggttaaagtctaaattcatgtcagctggatgaaaccggccgccggttgttttcaagcgtgcattgaaaaaggcgtgatggcggaacggctggtgaaacgccgccatggagattgcctccacacgtgcctgtagttcttggtttgtcatcgttgaacattacctccgagccaacagtgtacatcaagtgatgcgcgattgcacgaatgacgctgaccgctaacctgttcacaaacaatctataccaataatacaaaaatcggttctaggcgttcatgcatgattgatgtgcacgatcatctagaaccgatttttaatgtcattgcaaaattaaatctgactcacacgtcacgcattttttatgcatcgagacgcattgatttgaatgcttcagctaactaaaaatattattttagctgaagaatgccaacacatcgttacgggttagcgcagcttttctcttttgatcaaaatcagccacaatctggccggcatccaaaacgattaagcgcgtgccatagcgtaacgcatcttcgacttgatgggtaatcattaagcaggttaaatgttgatccgaaacaatttcgttagtcagcgtcatgattgattggctcgtgtgcgggtccagtgctgccgtgtgctcatcaagtaatagcagatcaggctctcgcatggtggccattaacagactcagtgcctgccgttgcccgccggaaagttgttcagtcggcttatcaagcgcttcagccagaccatttccggttttggccgcaagttctttcagccgatccttttgcgcagtaagtccccgtgagcgcaaacttaatcgctggccacggtgactggctaatagcaagttttcggcgaccgtcatccgcggggctgtgcccatttttggatcttggaagactcgggcaatgtggcgtgcccgttgctcgggacgttgcccattcaactttttaccggctaaggtcaccgttcctccgctcaccggcagatcaccggtaatggcgttaaacagcgtcgattttcctgcgccgttatggcccaagactgtcacgaaatcacctgtcttgaccgtcaacgtcacgtcttgaagtaaggtttttacttccgttgcgaccgggacattgactgtgacgtgatccaatattaattcagccatgtgcctgcacccctttttgcaaaactcgccgtaatcgcagttgatgatcgatttgcggcaccatgatggcaatagctaggactactgccgaaatcaatttcaggtcgtcggcgttgaatcccagcgccaaaaccactagcaggacaaatcgataaagaatgctgcctagaataacagccactaaccgctgcgacaaagtcaattcgccgaaaacgacttcaccgatgatgatggcggcaagcccgataacaatgatcccgatgcccatattgacatccgcatagccattgttctgcgctaacaggccaccggcaagtccgacaagcccattcccaaccattaagccaagcaccatttgatgatcaggatcaatccccaaactacgcgccatgttcgggttatctccggcagcgatgaagccctggcccaactgggtgtttaaaaacagcatcagtaatccgacgacaacgaccgcaaccaccagcccaatcacaacgctgttaaagtatggcggcagatccttcaaaaacgattcctgaaaaagattggcttggtgcaacaaggataagttcgcccggcccataattcttaagttaatcgaaaacaaaccggtcataaccaaaataccagcgagcaagaccggaatccgtccttttgtcgttaataagcctgttgccaagcccgccagcatccccgctccggtagcaagcagtgtcgcaatgatcggcgaaatgccatgggtaatcgcgctgaccgcgactgccgcaccaaacgggaaagtcccttcaactgtcatatcgggaaaatccagaacccgaaacgttaaaaataagccaagtccgattaacccataaagtaatccttgaccaattgccgaaacgcctaaactcatttgatcaccgttcccttcgtctctgcctgcttgactaacgcgctaggtaaggtcaaccctaactgttttgcctgtttctcgtttaaaataagctcgcctgttttttcaaaatgaatgggcgtcgttgcgggtttggttttgcctttcaaaacatccgctaacatgtgtccggtgacgacacctaaatgaaattggttaatcccaatcgtggcgaccccgccttgtttaaccatggtatcgacagtcggaaaaattggcaccttgcgcgcattagccgccgcaaccagcgtttgcatcgcgctggcaaccgtgttgtcagtcggcacgaaaacggcatcaacttggctgaccatttgacttgccacttggtttaaatcattggtggaactaatggcataccgtttcaccgtaaacccttcttttgttccgagttttgccaccattttagcttgtgtctgggctgagtcgtcgctagaagtggcaatcacacccagcgttttggcgtcaggcatgatctggcgaatcagcttcagttgggccgcaatcggcgcctggtcagaaacaccggtgatattgccacccggttttttgacatttttgactaatttagccgccaccggatcggtaatggcgccaagaataatcggcgttttctggttgacattagccagtgcctgagccgctggggttgcaattcccacagtagccgccgcattttcttgggtaaaccgttccgacattgacttcagattgctctgatcattttcagcattctggaagtcaatcttgatattttttccgttaacgtaacccttgtcctttaaccctgaaataatgcctttatgaatcgcatccaacgccgggtgggtcgtcagttgtaaaattcctactgttggctttgtttgcgcctgttgcgttgtcgtaccgctttgaaaatatgcaatgcctaaaaagccgaagatgatgatgatcaatccaagcattcgcttcatgcgtgttcctccaattgttgtgatttttggttggttgtgatgaggttgttatgtgtgtcgagccgtgacacgtttatcgacatgtaaaggtcttgtggtcgccatggcttatgcctttccaaccatggcagctagttctaatgacgtctggtcgataaatcctgctttcgctttcaataacgcgctccccggcgcaggggtctgcgtgtaaggacctcagtcgcaatggcctaagttcgggccatcacgcttgaggccacttacactccaacccctaagcgcgccggctcgcgctcacataaaaattgccgcggcaggtttagaccttcgcggcaaataaaaaaccgcatagtcccgttgtggggtatctatgcggacaaattgatcagaagccaacatagacacaacctgcgcgtctggcaggttgcgtctgcaacctacctaaagttggctttgccaagtttttaaggtaagcagtgctttcatgttggtttcctccattcgtttaaacttgaaataagttggtaaattaaagatacgtgagcaaacttctcatgtcaagcaaaaatgattctttgatggcgtcaacttttcgtgggttcaaatctgaattttttgctagaatgatttttcttttgacgacaagtacggcgatcaccctctggccgcagtgttgacgaagtgagtggcgcttatcacagctggcgccgtgatttgttcgaatattgcttgtttctgattcgattttcggaacaaatggtttgtcgcttcaacttctcccgaccaaaccgactgcttgctcttccttctatatcgacgttaaggccatatagctgatagttctcttaaacttagtgcttggacaggctagtgtgtgatgccgtattgccaaccgcgatggcggccactggctagttccacaaacgatgcctcgactgcctgggcatatttggccatctctgatttataacgaaccttgatccgatcgtcgatgcgaatatcgattttagctttgtgttggcgcttggcattggcttccaacttttcaaacacatgaccgccttggaaaacgaagacccgagtctgggataaactatccgttcctgcctgcgaccagcccataggccgcgagctaaagcgttctgagagcatatgactaatatgatcttcagctgaagttccgtgaaagcctggcgcgtgattggcttggatttgtttccaattatgccgaattaaagtccgtgcgtgaaggactgttttacgttctgatggacgcagttggggatcgttgagccgcacgcggaaatagtcattgagataactggagtgcccctgcatggcccagctcattaagatatcgccgagattgcctgggacgccgactgccgcttgtttgcacgctttacgcagatgaaacttgtcatagaccaacgtacagtttggtaaaaaatctgcgcctgtcttgatccaattcgcaccatcaccagctaggaagaaatgtttgggcatctgaccgccatattgtttcatgatgcagtcaagcaccgtctgccagatctcttctgtcccttcagttccgggatattcacccgtgatatagaagggacggatcaagctgaactttttcccaatggcccggtatccctcgtgtacgtaaaccattttaagaaaatgattggtgccatcctggtgtggcacatgatcttcatcggcttcaacgaacaatgtctcagggaccggcacgggttcatcctcaagctgatctaaagctgaaatatctttccctgagcggtggacgacatgcatcaccgcactcctggagatcttggcttcgccgccatgacgttcacctgattgtttgtatgataagcgggtcgcatcttccaacaattcggctttgagatcgagtgagagccgactgtgcttttcaatgcccgctacttcatccagcaggaaaagacgttcattggttcgtttatcctcatagtatcgacgagtgaaaaccaagggcccaattgatgaaataaaggtgcgctcgcgtttgtccttgattcgataaaactgacggcgataggaactttccatgatgacctggtctttttcctccaagacttggctaatcaattggcacagatgacttctgaaatcctgcttactggccaagaccatctgacttagatccaccttcccctcgatcaaatctgtggctaaagaactgaactgttttaccatatctaagatgatttgttgtaacatagatggcaagagcgaattcctcctaaagctagcttgtttttctttccagttaacattctagcacgaagggattcgctccctttttgtctattcacatatcacccacttaaactttacgccatgtgattcttttcacgaagaaatgtcaaccgcaagcgatattgtcttaagtaagcagttagccaaagtgtcacaaaaactgtaacctcttagaagatacatctaggaggaatcacatgaagaaggttgtcttaacaatgaaagaagaagaacgttaccgagtcatcaaagcagtggtcaatggtaagacctccgtgcaacgcgcagccgttaagctcaagcgctccgaacgaaccatctaccgattgatcaagctttacaagcaacaaggcaaagacggctttatccatggcaatgccggtcgtgagctcgccaacaaacgcaacgcgcaactcgaacgccagatcattcatctgtacaccaacaagtatgccggattcaacatcgcccattttcacgagttcttaaccactgccgaacaaatcgccatctccgaatcctcactccggctcttattcagacaccaccacattctgtcacccaaagcccataaagccaccaagcgccgagtcaagcgtgagttaaaagaaaaagaaaagaagtccaagctcctatccaaacgtgatgaagccaccttgtcagccatcgaagtcgttgaaaacatcaaagcccatccagaacgtcctcggaaacattattctggtgaacaggtacaaatggatgcttcctgggagtattgg

SEQ ID NO: 316 - DNA, 41292 bp, Lactobacillus casei
cgcagatgccaatcggtttttggtcggctttatcaagcgttacaatgaccgcttcgcatctaccatcaaaagtagcatgtcggtgtttgataagcaactaacacccaaggaaattgacaatattttgatcattgccaatgagcgcagcatcggccacggacattgtgttcgctttgataacaaacgctatctgccacaccggaatggcgaattggtttacttaccaccgcatacaaaggtcttagtcatcaaaagcttcacaggcagactttatatgaccactgatgatgaccaggtgtacgatcttttctgtgtgccaaaagaacagttcatgtcagccaaattcgatcttgcgccagcggtggcaccaactcctaaacgaaccaagaaaatcccggcaattacgcatccgtggcgccgcgccaactatcgcgattaccttgattctcttggcattaacaggacaagggttaaacagttggtcgccgaacgatatccatacaagaattcacaagcgattcaagtctaatcaggatcatctcgcgtccagttttcggacgcatgttttgtggaatttactgtcaaagtcgaaaatcgcttgacagcaaaaatgattcttttcacgaagaaatcactgtaagatcgctgaaatcttttgaatttgcttggtaaatttttggatcgcttcgtcttgcgctttttcggctgcattaaacgctgtgacatccacttctaagtccggcttgaggctttcggtcatggcttcacacgcctccgtgaaggccgcaaagttgtgaattagtgtacgatgcggcccaaccaaccgtgcgggaaccgcgacttcttgcaatcgagtgagtaactttttgtacgcatcggtaccctcacgaaacacgacccgcgtgtcatcataggtgccctgatcataatcggccaatttgccggcatcaatcgcttcacgtaacggttcaaacaaaggcgccatcttttcctgattgtcctgagtttgttccaccacatcattgatcgtggtaccatagtgcgccattttaatttgttgcttgttcatgaaaagcacgaatcctctcttgaaaactaatccatcaattttttccgaatgctgaagatttacagaccgcgccgcttacgccgagcacgttcgaagatcttgacgatttccacgagcacaatcatggtaaccccggcgcttaaaaccgttaaccattggtgccaatccagcgttgttacgtggaatagtccattaaatcccggtaccagaatggtgacagccaacaacacaaaggaggcaagaatcgcccagttgaaagctttatttctgaaggcaccgactgtgaagaggctttgatgaatgcttttgacgttaaaggcatggaagagctgaatcaagcccaaagtagcatacgccatcgtcaaagcgtccgcatgcatcgctgcttgaccactgtgaaccggatacgtgatggcaaaccagtaaacgcctaaggtcaataggccttcaagaataccctgccagatgaccgctggaccgacgccgcctgagaagaagttggatttgcgaccgcgtggcttttgcttcatgatccctggctctgtcggttcaaccccaagagcaatcgcggggaaggtatccgtcaccaggttaatccaaagaatgtgcaccggtgccaggatatcccagccaagcatggtcatcatgaacaacgtcagcacttcgccaaggttggcagacaacagatactgaatcgccttttgaatgttggaaaagacttttcggccttcttcaacggccacaacgatcgtggcgaagttgtcatcggctagcaccatgtcagaggcacccttggaaacttctgtgccggtgatccccatgccaatgccgatatcggcggccttcaaagcaggcgcatcattgacaccgtcaccggtcatggcaacaactttaccttttttctgccaggcgttgacaatccgaactttatgctctggtgccactcgtgcataaacgctgtatttaccaacatttttggcaaattcttcgtcactttgctgatcaagttcggcgccggtaatgacagcatcatcatcaccttgatcgatgatccccagccgaaccgcaattgcttcagcagtatcgcggtgatcgccggtaatcatcattggccgaatcccggctgattttgcttctgcaaccgctgcttctgcttcaggccgctccggatcgatcattccgaccaaaccggcgaaaatcagattattttcaaccgtttccgagttgactggttcaggaaccgaatcaatgaccttataagccatgcccaacacccgcaaagcttgggtggccatgtctttattggcctttaaaatggcatctcgttcgctgtcagacatcggcgccgcctgatcaccagtggccagttcggttacccgcttgagcaattcatccggagcacccttagttgtcaccagaatcttgccatctgcccgccgatgaagggtcgacatcaatttacgttcggaatcaaacggtacctcatcaatccgcggttcgtccgccaatgcatgattaagatcaaacgattgggtcttcccataggcgaccaacgcggtttcggtcggatcccctagcaatttgccatcatcttgaacctgtgtatcgttggcaaaattcataatggtcatgagcggattaccgccatgtataccatcgctggcattatttaactgaccgtcgtaataaaccttctcaacggtcattttattctgcgtcaacgtaccggttttatcactggcaatgatatcggtgctgcctaaggtttccacggcaggtagcttacgaaccaaggcatgccgcttggccattttctgggttcccaatgctaaaataatcgtcacaattgccggcaacccttctggaatagccgcaactgccaaggacaccgccgttaagaacatttccggcaaacttgctgcattgcgccagatgccgactgcaaagacaatcaccgcaatgaccagaatcatcacggtcagtgtcttaccgagactcttaaggttttcctgcagcggggtcgtggtttcttctgcggcattgatcatcccggcaatccggccgacttcggttttcatgccggttgcaacaaccaccccgacgccgcggccataagtgatattgctattcataaatgccatgttggttcggtcaccgatgccaacatcatcatcgtccagcggtgccgtggatttatcaaccggcacactttcaccggtcaaggcactttcttcgatttttaaattagcgctctccaccaaccgtaaatcagccggaaccacatcaccggcttccagcaacacgatatcgccgagaaccagctgactgcttggaatcgtcaaaacctgatcgccacgccgaacatgcgcattcggcgttgacatctctttgagcgcgtcgatcgcttcttcggccttgctttcctgaaaaacgccgaaaacggcattcagtaacacaacagccaaaataatcccggcatctgcccattcactcaacaagaacccggcaatcaaagcagcggcaagcaagacaatgatcatgaaatccttgaactgatccaaaaagcgcgccaacatgctctttttctcggcctgggccaattcattcggcccgttttcacccaaccgggtttgtgccgtttctttagatagtccagtcaattgggtttgttcctcttgcaaaacttcttgactgcttaatgcatatggcggtttctttgccaaaatagtgcctccttctttgtttgggccggtagccaaaaagagacttatggcctaccagcagtagatccataagtctcactatttaagacaacaccagacatagccttgttggtgatgttgtcgcagaaaagctctgctagttactcccctatgttggttcaagtatatcaggtcaaagcagccttgcgcaagcgatccttaaaaatctagagcgtgaactggcgcggttagaagtcggagtataagtggccttaggcgtgatggcccgatcttggccattgcgcctaaggtccttatacgcagacttctgcgccagcgaacgcgtttcaacagagcgtgagcaggcccggtcagaaaccggagtgtaagcggccttgggcgtgatggcctggtctttggccatcgcgaccaaggtccttacacgcaggtttctgggcctgcgatcgcgtttcggagccggattgcctcacaggccttattcccccaagctcaggttcccccaagctcaggctttggccattgcgatcaaggtccttatacgcagactcctacaccagtgaacgcctttcagcaagccgaattaattcacaaagggtcggcccggcctagcccttttgccgcaatgtttggaacaaacgaacagcttcatcgtgaagattgagcgcatgcgaattataattgctcaacaaaatcaccgcatctttgccatcgtggctaatagcagttgatgccatttgcccggccacagtgccattcgttgagtaaaaatcgctatgattataaatgcctgccgtataaaccccgtcatcgcgattgcgcaaggtctttaacgctgacaacggcaaaacttttccatcatcgatgccccgcagcaaccgatacaaatcagcaacagtcgtatacatattgccggtacccagctcgcggttgtaccacagttctggttcgccaatggaggtttgataaggattcgttaccggccccgtgtacgtcaatgagcggttggtatctgtcagcattcccggcaagaatccggtgtgtctaagccccaatcggtcaataatcgtctttctgatctgctgctcataagaacggccagcgactttttcaaccacaccggcgagtaattggtaattaaccgcctggtacgcgtagtttcgctgcggtaaataggtcatattgccgattgcccagcgaataataccggcatcgtccataacggaaggctgatactttttaagcgcaaaaccactacgcatatcgatcatcatgcgcaatgtcacctgatcaccggttttgatgccggataaatacttgccaaccggatcatccaaatgcaacttgccttcttcagccagctgcatgacggcaactgcagtgaccgctttttggatcgatccgatctggaacaaagtcgttggcccattaacgcgtttcgctgcggcatcggcgtaacccacgccgccattgaagataatttcaccctgtttgatgatcaaagcactgccaataaatttatcgtttgttaaggtttctttgaacgatttgcctgccgatgtgtcgatcggccggtccagacgctcatcaaaatgcgttgctgccgtttgcacggcttcacggtgagtcgcctgctcatgccgctgcgacgacaaaaccttagcctgtctatccggaatagctatcttcttctgccagacaaaagccacagcgcctaataaaagtgcacttaatgtcacaatgcctaaccaaagagcccaacgatgacgcactgcgtttcaacctcctactgccatgtgtaccaaagcataccttaaaccagcgcaaaaaaacagccataacacctttgagaaaagttcgctgatgtcggctgtttgccatgcttatttccaaaaagtatcaaaaaccgtaatcggcagatggcgcttatgtgcggttttctggtaccaacgttcgatcgtctcggcagcatggtcactcacttgcttgccttctagataatcatcgatgtccttgtatttgacgccaagcgcaacttcatctggcaaagccggccgattgtcttcgagatcggcagtcggcgccttctgataaagatgtgccggtgcgcctagtgtctttaacaaagccgcaccttggcgtttgtccaagcgataaagcggcgtcaaatcggcaccgccgtcaccaaatttggtataaaacccggtgaccgcctccgcagcatgatccgtgccaatgacggcgccggacatattaccggcgatcgcgtattgggcaatcatgcgcattcgggctttaatattgcccttgttaaaatcggaaatggctgatccgttggcttccactgccgcgaccatggcatcgacactaggtttaatattgacccgtttaaccacgtctgcctgcatgaagtcaatggctgccatggcgtccgcctcatcggcttgttcgccataaggtagacgaacggccacaaattgatacgcctgatcgccggtttcggcgcgcatctcttgcatggctttttccgtcaacgtcccggcaagcgtcgagtcttggccaccggaaatacccaagacatatgttttcaaaaacgtatttttcttaagatagtcttttaaaaaatcaatactccgccgaatctcggtttcaggatcaattgttggctgtacgcctaatgctttaataatctttgcttgtaatggacgcattacttcactcccttaatcatgtcatgataaagtgcttgggctagatcccgcgtcacctgatccgtatttgccaacagcacgaccgcattttgaccgctgctatccatgacagttgccgctgattgtgcggccacaacgccatgcgtcagcgtgtagttgccaaaattatacacacccgccgtgtattggccttgattcagatcacgtaatgtggcgaccgatgagcgcctgataatcttgccttgattgatggccgccataatctggtataaatcaccggcactcgtgtaaatattaccagtccccaattcccgattataattcaaagacggctcgacgtaacggcgcgaataaggattcgccttgggaccattatacccaaatgattgattaggttcacgatacaattcaggcataaatcctgaatgcgtcaactttaactttttaaatatttcctgctgaattaagtcggcgtataaatgaccggtcactttttcaatcactccggctaataaaacaaaattaaccggttcatacgcgtactgtttcgcaccataattcaaattggcgatcgaccaccggacaattccggcatctgatagttgggtcggttgattccgcttcaatgaaaagccgctacgcatatccaacatcatccgcaacgttacctgtttgcccgtgcgaatgcctggcaaatagcgactaatcggatccgtcaggtgtaccttgccttgttccacaagtttcatgagcaagactgcggtaagccctttttgaatcgagccaatttgatacagactctcaggcccgttcaaacgaccggattcagcgtcggcatagcccaaccccgtgttcaggatcactttccctttgcgcatcattaaaacggtaccgctaaaatgatcggcttccagtttttttaaaaacggttgcgcttctgaagggataacctgttgcatcaaccgatcagtggtgttcgttgcctgacgcgtggcattttgcaggcgttgctcgatcgcgcgatgccgattcagctcggtttcatacttgcgccgggcgcgttcttctttggcttcagtttgcgggcggagataaaagtaatcataactgccataaaccgcgatgccgatgacaaggccggcgaagagtcccaagatcaaccagcgtgtccaaccccatttttttgcgtgtttcatattattcctcgcggtcagcaaccgccgatttcacttttttaattaagtccatcttgttatcccacacccgctgcgataagtcgaccggatagtcttgcggattcaaaatgcgccgatattcatcccacaaagcattggtactgcgggtggcatatgcctgaacctcagcgagcggcggggtttgataaacctgttttccctgatcgtaaatgagttgcaacagtggcttggcttcaaagtttttaaccgttttattgatatacggaaaattggggtggaacatgtagaggctgcggtcagtgtcaatctgctcatccgccaaggccacgtaatcgccttccgatttaccgtcatcccgacgcgtaatccgccaaacctgtttcttgcctggcgtcgacaccttttcggcattattggataacttaatcgtgtcatgcatcttaccgctggcatcttcaatcgagacaagcttgaacacagcccccaacgctggctggtcgtacgcggtgatcagtcgggtaccaacaccccagatgtcaattttggcaccttgcattttcaggttttgaatcgtgttttcatcgagatcattcgatgcataaatttttgccgaagtatacccggcatcgtctaattgctgacgcacacgcttggaaataaacgccatatcgccactgtcaatccgaacgccaaggaaattgatccggcctttaaactcattagccactttaattgccgcgggaacaccggaacgcaatgtgtcataagtatcaactaagaaaaccacatccttgttgctctgcgcataggctttaaaggcatcgtagtcgttgccataggcctgaaccagcgagtgggcgtgggtgccgctaatcgggataccgaactctttaccggccaaaacattactcgtcgcgttaaaaccgccaatgtaagctgcccgagtgccccacaatgccgccgcggtttcctgtgcccggcgtgtgccgaattccatcaaggggtcggcgccggcaacactgcgaatccgcgccgctttggtggcaacaagcgtttgataattgatcatgttcaaaacagcggtctctactaattgtgcctgcgccagtggcccttcgatttgccagatcggttcattattgaaaactagatccccttctaaggccgatcgcaccgtgcaggtaaatttaaaatgccgtaagtaatcgataaacgcgtccgaataattcgtctgcgattgaagataagccaagtcgtcttcggaaaaactgaggtgattcaggtaatcaatcacatgctccaacccggcaaatacggcaaaccccgaaccaaatggtaaatcccgaaagaaaacctcaaatacggcgtgacgttcactgatacctcgttcaaaaaatgtgttcatcatattcaattcataaaaatcggtgtggagtgtcagtccttcacccaattgcgtagccatcatctttccccttccagcaacatacaaaaacaacgtacgttaacttttgagcatttaattcaatcatataggtaatgattatataccactacggactgctttgcaggaagcgtgctgggccatttttctcatcatcgcaaaaggccagaaaacaataagttctgttttctggccttttggtcgtgctaatactgattcattaccgctctagataaaactcaaatcgctcgccaacatactgcgtgcggacatattcaaacggtgtgccgtcgtttaagaacgaaacctgccgcagacgtagaattgcatcgccgcgtttgattgccaagtattcggaaatccgctcgctggccaacatcgcactgacggtttgctgcgcgccaccaagaacgtagccgccttttttctccaaggtgtgatagaaactagccgtcatttcttttttggtgaagttcttgaccaaatcatacggcacggcagctgtttcaaagctgatcggcaccttgtcggcataccgaattcgttccatccgcagcacttgctcgcctggagccagtttcaacttttcaacttccgaactggttggctgggccacgtgataagataccgtcttgctggatggtaccttaccttgggcctgcatcaaatccgtgaagctagttacgccggacattttttcttgaactttttgatttgcgacatacgttccggaacccacgcgtcgttctaaaataccctcgtcgactaaagtctgaatggcctgccgcaacgtcattcgggaaacattaaaggtcaccgcgagatcgcgttcggaaggaatacgatcgccgacctgccatttcccggcttcgatatcagcccgaatcgcgttatgaatttgaatataaaccggtacctccatcaatcatcatctccaatacgtggttcagtcttcagtgtcatgtttgacgccataactataagtggcaatgagatcatggttgcgatccaacatgttaatgtcggcatccttaccaacttcaagagttcctttggacgtcagattgaattcgcgagcctgattgactgacgacatttcaactgcatcaaacagggaagcatccatgaagctcatcgcatttttaaaggcatccttgtacattaaaacggaaccggcaagcgtaccatcggctaaccgcgcctgtttatctttaacatacaccgtctggccgcctaattcactttttccttccggcatccctttgctgcgcattgaatcggtgaccaattcaatccgttccggacctttttgatcaaaggccaagcgtaacatgtcaggcacaatatggaagccgtcgcagatcaattcgcagtacatattgtcttcaagcatcgcgtggccagtgacgcctggctcacggtgacgcaacccacgctgtgcattgtatagatgagtcacatgggtcgctttgctttgcagcatctgttcgcgcgttgcattactgtggccgactgatggcacaatgttgtgtgctaaaagataatcttcaaattcgcgggaaccttcatcttccggcgcataagtgatcagcttaaccagaccgccggataattcctgccattgtttaactaaatcgatattaggattcttgatatattcttctggttgggcacccttgaagaccttgctgatgaagggaccttcgaggtggacaccttggataatgcgattgcgttcggctgcctgtttcacgccgcgcatggccttatcaatattttcggttgattgtgtcatcgtggtggcaaaaagggtggtaaccccttcgtgcgtcatcattttggtggccatttcatcaatctgatcggcatcaccatccatagcatcaaagccataaccgccgtgagcatggacatcaatgaatcccggtatcaacgttttaccttgaacgtcaacgacctgttcaccagcctgagccttataatcaaacatatcgccaaccgccagaatcttgtcgtcaaagcggatatagccatcttcaatgcgttccaatcctgtataaattgttgcgtgtttcaataccgtaaccgtcacaataccactcctaatcatttaatgtcctgactatcactaaccagtataaccggtatagaccagagttgcaaggtggcctacctcgtatttacaggaagtttaattatttttcatccctgccgatctttggcaatcgtcgcatcgacgcctttgaccacagcggacatcagcccggcttcttccatggccaacaatccggcaacagtggtaccgcccgggctggatacctgatcgatcaagtcaaacggtgattgggtacttgccagaacatttttagcactgcccatgacggcttgggcagcaatggcagttgcttcacttttttctaggccgtacttgacaccggcgcgggcaagactgtctatgaataagtaaacaaacgccggagaagacccagccaatgccacgaacgttgaaaattggtcttccggtaacgacatggttttgcctaaaacattcagcaagtccaaaaggccatccagttgaccagctaccgaatcattcgcggcgtaagcgatcatgccggcattaattgcgacgttcacgtttggcatgatccgtaaaatcggttggtcatgatcgttcaatgcttcttctaacgccgccagcgaaacgccggttaacattgaaatcacgggtacatgccgtttcttcagggttgccccgatggcacttaaaatcggtgcacccagtttcggcgcgaccgccagaaaaacaacatcggccgcttcggcaaccgcctgattgctgtctaaagctttgacgccgactttggctgcatagggttcataatgcagcgggtgaccaccgtgaacgacaatgtccgctggattgatggcctttttggctaacaatccgttaatgatcgcttgcgccatattgccggcaccgataaatccaattgtcatccttattctcctttagtttcttgttttgattggtgggcatcaaaccagtccgtaatcgcggttagacgtgcgatccgcaagttgggtaagccactgcgggataagtcgtggtttgatttcgggaaccgcatgaatttggtttcaacgccatgtagtttcaacccgatataaaattcttcaccctggccgatcggacaccgttgatcgtcttcgctatgcatcaccagcgtcggtgttttggcaaaatcgatatgtgccaatggtgagaaatcccatagcccttgcacatctgacaaatcgccgctccacttgccttccagctcccaaggcgtgaagtaatacccgatgtcgctggtgccatacatacttaaccaattggcaatcgagcgctgggtaacggccgctttaaagcgatgtgtgtgggtcacgatccaattcgtcatgaagccgccataagaaccgccggcaacaaataagcgctcaggatcaatggtcgtatccaatttcaaggcctcatcaaccgcggccaagcaatcttgatagtcatcctggccgtaatgtttaataaccgctgccgtgaacgcttcaccataacctaatccgccccgtgggttgggacagatgacgccatatcccttggcagccagatattgcatttcatgaaagaaggtatacccataaccaactgctgggccgccatgcacatataaaatggccggatgcgatgcggctgctttttgcggtgggaaataccaaccctcaatttcaaaaccagcacgattgaaattaaaagtctgtggcgtaaccaacccaagcgtgcgcgtaacccgccgatttgggtcatataaaaccgtttcctcttcggaggccagatcaaagtacactaatcgactcggaacggtcatcgtgctttcagtgaacacgacgccacggtgatcaggtgtcaaggcaaaatccgtcacgtgacgccgaccgtcaatcaacggcgtcaagcgctcatccggtccaccagcgtataggctcgtcttcccgtggtcaaaaccaatcgtcagataataatcggctgtgacaaaatcggccactttgcctgatagatcctgctgaaagtcaccattaacatagcccggaatgtcaaaatcaacgtcatcagcaacgtcctgcagtttctgactctctaaatcgtaatgccataagtggccttgcgacacattaggtaaatgattgtcagaaccatgcagcagcaattgttgcgaatccgctgaaaaggctgctggggttaattctgcttgcggcaaatgctcattcaccatcgtcacctgctgcgtggttaaatcgagcaaataggcagcttggctaaagtcgttgggatcatccggtaaccgttccgcagcaaacgcaatttttttgccgtccggcgcgattgcaccaatttggaagtcatgctggcgctgcatcacgatgtggctagttttttggcgtcgttgctgcacccgcaattcgtaagtcacgttttccggcaacaagccgacaccattgagcttatactgcgcgcgcgtgaccgtcaccggctgcggttttttggcatcttcctgtgataccttctttttggcgccaatcgttgtttgaagaaaaacagccttgctatcaggttgccaagcgaaatccgtcacgttctctttttcagccgtcaactggtgggccacgccgccgtcaactgcttgcaggaagacctgcgttgttttgtctgcagcttggctcaggaacgccaaccattgctgatccgggcttagtttaggatgccggtcgtgtttttggtcagtcccataaacggtcatctggccacgcggattcacgaaacaaagccgctggtaataggtattgtccgcctccgaaatccggttttcctgaaaaaaatagccccgatttgtcgcaattggatacgataacgataccaatttgaaaagatccgttgcttttattgccatgcaatcacacccttcattgtcttgctttaagcgtagcggttgggctataccgtgtcaaactactggaccggtgaaatcaaaaaaacagccgagatgtgttggcatctcgactgcgagtgataaaaattggtaatcgttaggcatcacacgacacctgctaagttagattagatgtttagtgcgaacgcttcttccgggtaaagaacaaactggatcctaagcttaacaagccacctaagatcaccatcaacagcgactgctgctcaccagttttagggaaatgatcctgactggtggcaggtttagccttggatttggctttaacggtaggtgcagctttaccggcttgatattgtgcatcaatggctttaataccattgtctttcgcctgctcaacgagatctgcactgccggcagcatcaatcgcctgtttggctttcgttgcttgcgttgtgacagcctgtttttgcgcggttttttgggcatcgctcaacaagttatcgctatcaatctgagccatcactttagcggcttcggcgtcaattgcttgcttggcttcagtttggcgagttgcaatggctatggctgactgatgttgagcatcaatcgctttaatcccatctgccttagctcgatcaacgccatcggcatccccggcagcatcgatcgcctgcttagctttgtccgcttgcgctgcgactgcttgtttctgggtagtcttttgtgcatctgttaatgtggcatcttgatcaatggctacgatgacatttgtggcctccgcatcaatggcttgtttagcttctgccttacgaaccatgaccgctgcgcctgactgatgttgggcatcaatcgctttaattccgtcagtcttggcttgatcaacggcatcggcatgcccagctgcatcgatcgcctgcttggctttctctgcctgcactgcgactgcttgtttctgggcagtcttttgtgcatccgtcaatgtggcatcctgctcaatggctgcggtgacgtccgccgccttcgcatcaattgcttgtttagcctcggccttgcgagttgcgaatgccgcgtctgactgatgttgagcatcaatcgctttaatcccgtcagttttggcttgatcaacgccatcggcattccgagcaacatcgatcgcttgcttagctttatccgcttgcgctgcaactgcttgtttctgggcagtcttttgtgcacccgtcaatgtggcatcctgatcgatagctgtagtgacattcgcagcttccacatcaattgcttttttagcctcggccttgcgaagcgtgatcgccgcgcctgattggtgttgcgcatcaatggtcttgataccttcagttttggcgtttgtaacagcttcgatgtttagggcatcgtcaatcgcttgtttagccttgaccgcttcagcaacgaccgctgctttctgttgctttttggcagctgcagtcaacgttgcatcttgatcaatttcatgctgaactttcacggcttcgtcatcgatcgcctttttgttgtccgctttgctacgatccattgcctgaccggatacatgttgcgcaccaattgcctgaataccggcatctttcgtctgatcgacgctgtcggcatcctgcgccgcgtcaatggcagctttagctttggttgtttcattcgcaactgcttgccgctgcgccgttttttcagcaatcgttaatgtcacatcctgatcaattgcttgcgtcactttgacagcttcagcatcgacggcggctttagcgtcatctttgcgggttgccaacgcgttgccagcttgatgagtcgcatcgatcgtcttgaggttctggtttaccgcttgatcaacaccatcggcatcttgcgcttgatcaatcacaactttaactttagcagccgcatcagtcgccgcctgtttttgcttagctttttcggcagcggtgagcgtcacatcacgattaatgctgtcaatgatttgtgcaacatggtcatcaatcgtctttttcgcttcatctttgcgcgttgcaaccgctgttcctggttgatgttgaccatcgattgcttgaatcccggctgttttggcttgatcgaccgcatcggcgtcagttgcggcgtcgatggttttcttggccttggctgcttcggctgctactgcctgtttctgaacagctttttgggtaccagtcagcgttgcgtcttgatcaatgcttgccgtcaccttggcagcttccgcatcaatggcggttttgtgtgcttctttgcgggtcgttaaatcctttccggagcggtgctggtcatcaattgctttaataccttgagcaatcgcttgattgatctgatcaacatccttggcttgctgaatcttcttcttggccttaatgacctcttcagcaacggactgtttttgtgaagctttttccgcgccagttaacgtcacatcctgatcgatggtttggatgacctttgcagcttccgcatcaatcgctttttcggcaacttgcttgtgtgcctttaacgtcgcgtcagcttgatgttgttcatcaatgtgcttaatgccgtgggttttggcattattgaccttatccgcatcggttgcggcgccaatcgccttcttctcttttgcctccttgtctttaacagcgcgtttttgcatcgcctttttagtgctagtaagagtcacatcgcgctcaatcgcgttgataactttaattgcttcggcgtcaatcgctttttcggcggcggttttgcgtgtggccaaatcggtaccggcgtggtgctggtcatcaatggccttgattccgtcgacttctgcctgatcaaccgcatccgcatttaaggcgctgtcgatattgtttttcgccttggctgcttcatccacaactgcttgtttttgtgtcgccttttggtcagtcgtcaaggtgacatcctggtcaatggcctgctcaaccttgccagcttcagcatcaatggcttgtttagcggcgtcctttcgggtgtccaaaagggtgccggattggtgaacggcatcgatagccttcacaccatcgaatgtcgcttggttaacaccatcaatatcttgcgcctgggcgatcgcagctttacccgcagcagctttatcagccacagtttgtttttgctttgctttttcgccgctagttaacgtcacatcttgatcaatcgcatccgtttccaaagcagcttcagcatcaatggccttttgggcttcggtttggcgggttgctaaatcggtaccggactgatgctgatcatcaactgcgcggataccgtcgacttgggcttgctcaacctcgtcggcgtcttgagcgccatcaacgatcgccttggctttagcagcctcatcagcaacaccttgtttttgcgcttgtttttcggcggcagtcaaagtgttgtcttgatcaatatcgccggcaactttagcagcttcggtatcaatggcctgcttggcatcatccttgcgcgttgcgagtgcagtaccggcttgatgctgaccggcgatggctttgtttccgtctgccttcgcctggtcaactgcatcagcactttgcgcaccgtcaatggcctgtctagccttatctgccgctgcagtgacggcttgtttctggttgtctttttcagcttttgtcaaagtgacatcttgatcaatcgcagtcacggttttagcaacttccttagcaatcgcttgttttgcatcatcgcggcgattggtaagcgccttgcctggttgatgctgatccgcgatgtttttcaaaccgtctgtcttcgcctgatcaaccgcatcggcgctttgtgcggcgtcaattgctgccctggctttaaccgcttcgtcagtagccgcctgtttttgcgttttctttgcggcagctgttaacgtcgcatcttgatcaatttcatctgcgatcttgacggcttgcgcatcaatggcttgcttggcatcggttttacggacgtgtaaagcgattcctggttgatattgcgcgttaatgtgctgaatgccgtcattttggctctgatcgaccgcatcagcgtccttagccgcgtcaataactgccttggccttggtgacttcatcggtaactgcctgtttttgctttgccttttcagcgttggtcaacgtagcatctcgatcaatcgcagccgtcactttcgcggcttcggtgtccattacctgcttggcatctgctttacgggtatccaaaagtgcgcccgactggtgagccgcagcaactgctttaaccccatcagccttaccctggtcaaccgcatcggcgtcattagccgcatcaatggcagccttggctttcgtcgcctcatcggcagcggcttgtttttgcgttgctttttccgcagcgattaatgtgacatcttggtcaatcgcctgctgaacttgggtcacttcagcatcaatcgcctttttcgcttcggctttgcgcgtgtctaaaagtgtgccggcttgatgaacgtcatcaacgcctttgatgccagctgcttcagcttgattgacgccatcgacatcctgcgctttgagaatcgcgtctttggctgccgctgctttgtcagtcacagcctgcttttgaacagctttttcgctggtggtcagagtaacatcttgatcaatcgcatctgcttctagcaccgcttcagcatcaatggctttttgagcttccgccttgcgaacagccaaatccgtaccggcttggtgctggtcatcaacggctcgaatgccatcagtttgcgtcttaatcacactgtcagcattttgagccgcgtcaatcgccgccttgaccttggcagcttcatcggcaactgcttgtttttgcgcctgtttgtctgcggctgtcaaggtaacatcttggtcaatatcaccggtcactttagcagcctcatcatcgatggcctgtttcgcggttgctttttgcttgtttaacgtcacccctaattgatgctggccgtcaatagctttgatcccatcagcctgtttctgattcacgtcatcggcattttgcgcctgatcaatggctgttttggctttggcagtcgcatcaacgacagcctgtttttgggtcttcttttcggctgtcgttaatgtcggatccttgtcaatcgcagtggtgattttggctgcttcggcatcaattgcctttttggcggtgtcttgcctagccggaagtgcaaccccagcttggtgctggtcgtcgattgccttgatcccatccgctttagcctgattcagatgatccatatcctgcactttgtcaacggcagctttagcactgtctgctgccttagcaactgcttgtttttggccttgcttttccgcagccgtcaacgtggcatcctgatcaatggcagcagtgactttcttagcttcagcatcaagtgcctgattagcctgctctttttgcttatcaaaatcagcgcctgattgatgttgaacgtcgatagccttgattccatccgttttagcctgattaatggcctcaatggtttttgcctgatcaatcgcggttttggctttcgttacttcatcggccgttgcttgcttttgcgcggttttttccgcggtcgtcaaagtatgatcctggtcaatggcggcagtgactttcgcagcctcggcatcaatgtcctttttcgcatcacttctgcgcacatccaaggccgtacctggcttatgttgcgcgtcaatggtcgcaatcccgacagcctttgcttgctgaacgccagtatcgtcttgtgcttgatcaacaacagtcttggcttttgtggtttcagcggtcacagcatctttttgctttgccttttcgctggcagttaatgttggatcactatcaatcttggcattaacggtagcagcctcgccgtcaagatcgtcttttgcctgttccttgtgcgcacctgtcaccacttgtggtaaaaccttggcaaaatcatcgtcaactttgacttgatcgatctttttcttagcctcggcttgaacggccttggagtcagtggccacgtcggcgacagcttttttcttcatcgattcaagcagcttggcgttgagtgctggaccaaaatctttgtattcgagaactcgggttgagttccatgcaggacgaatcggcgttaaatttttcaaccgactgctttccatttgcacggcaatccagtcatcaggcgtaatcttgtgcgcctgcatataaatcacggcatccgcagtcccgccaactcgagttctaacgtcccattggtgtgtaaactggtgggtcgtgggatccatctggttaataaccgcagtatctaaaccgtcgggcgagatcaccacccgtttaaccttaccttccagttcatcattgaaggaatacgaaaatttcagataacgatccagtccaccggcaatgtttgccgacccaaaacgaatcggaatcttaaaggtgtccgtcttttgatcatacgtgatggtatcgttgctgtacttaaatgtgatgctgtcaacgactcttttatagtcagtacttttatcaccaccgataccaccaatgaagatgttgccaacttgcggcttcacggccgcctgcaccacaattgtggaatcccaaaggccaattgtgacaatgccagttgccaaaaagaatgttaatgttccttttttcaatttattgtcgctccccctcttgctaacccccaaaacagcacgcatttaaaatggttgcccattattaaaatattaatattatttatcacctttcaattgtcaatgcgttactgttgaaataaatctctccgtgttgctataattcataacgatttaaatgtcgttaatgcaacacgcaaattagtataagtaaatcgttgggtggtatcaggtcaaatgttgcctaacgttaggcaacatttgagaaattaacaaacatcaagggggtaagggttatggaggaactgctagagaatagtttgctgaagcactattacattattagttttttgttgaacaaagactggacgaccattgaccgtttagcccaagaaatcaaaattcctgcgcggaccatcagacaagatatcgggaatattaatcaatacattgccccagccaaaatcgaaagcagtcaacgtttcggtattcgactcacttacgatgcgtcacacaatccgctttacatttatgcggctatttatcgccaatcgacccgcttcttgattcttgaagaactttttctacaccgcttttcatcgatgacccaattagccgaagaactcttcatcagtgagtcaaccttaaaacggcacatactggccattaatcaagtgttggaacatgaaggctttagaattgatacgcaaactctggatattgtcggcaacgaaaagaaaattcattttttctattactgctattttctggaaagatactggttcattgacgcctttttgtctcaagatgaattacagcttattgatgagatcattgctgatttttcagcccattttccggttttgaaatcgccgagatatcagtcgttttcgtttttaaacaaactgcgaacgaccgtctttatctgtctcacccgcaatagtcgcggccacactttcaaagatgccagtttggtgaaggaaaatgacacgttttcgcctgagttacggcaaaagattactcgaatttataggattaattgttcctcgtttgtcttttcacatttgttttatctcttctttaattcacgcaatgccctgacttaccaggatctcctggttaaagcccgccataatccggtaattcattcgatttatcaagcactgtcacactttcttgatgtgacggcggcatcgcaaaaactgaaactggctaatcgtgatttggtgctgctgcgtctgtataatgccattgagtacacttggggaccgaccaagattctgtataatccggatgaagcattcttcatgaatatgaacaaatttgagcagacattcattaaacaaaccaaagaaacgttaatcgccattttgcgcgccgaaaaaatctggaagcaaattgacgaggcgttgatcacccgcctgcttttcatcttggtcacgtcttgggacaacttgaccattcaattagaagaaaaagcgccaaaagtcagaaccggcctcttcttcaacacaagttttgagcacagccaatttttattgcaggaattaagctatcacatgcggtcaagcttgaagcccgaattgatgcacgtcaatacgcttgccaaattaaaagcggccgcccctcattttgatatgattatcaccaatctgccgctccttaacctgccgaaatgccacatcgtctccattcagccacatcccacacctgaagactttgacaatattctagctgtttacaacaagattattagcgcaaaaacggttaaaatgccggcctcttaaaaagcaagcaaatcaatgtcagttcaatcaggcatcattcttttttaaaagctgaaatgcttctgtattttcaaccacaaatattaaggtataagtgcccgcaatcgcaaaaaaaatccgcctaacgcaatgatcgcgttaagcggattttcgtcgtttcggcagcgcaactacgcactgccattaaaaaatggaggagatagggttcgaacctatgaacccgaaggagcggatttacagtccgccgcgtttagcctcttcgctactcctccatacgtttgcaagtagccaactcaaatagtgtacaaaaacaggttataaaaagcaaccattttcaggcagtttttataacccgttttgcatgtcattgacgaattcaggatttagccaatgacggtacatgcaacgtgaccagcgtgttccgccactccgtcaaccaatcatgactttcccattcaaataagcgcttcagcccataacccagcggctggtggtaataggccgttttaccgagtagtttaggtgcatcgcgaaaatgttcatgaccaaatgcgaccgcatcaacctggcctgtcaacagttcgccaagtttcgctgatcccatgagcgccgtcgccatttgccacgacggccggtccaccgcatagaccatggcgccgcgaatcggcacgaaatgcgtcacataaatcatttgccgccctcggttggcatcgattgctgcttgggttgtctgtaaaacccgttgcattcgctcaccatcgctcaacggcgaatcaattgcgctatcaatccaaaaagcgcgtttccactgggcataagctgcatccgttttagtttttcccaactggccaagcgaataatcataccagccattgttgccaatgatcacggcattggtggacggaatcggtagcaccttttcgtgtaaataaagcggatcaacatctgactgaatttcatcataggtagcgcccttgaccatgtcgtgattgccggccaaaaagcgtaccgtgacctgctgacctacttcctgttgcaatgtccggtagtaggccagcgttttggtgaaatcattgtacgtatcaccggcgttgacataaatctgatacccgttttcaaccagatagtctgcctggtattttagcatttcaaagccatcgacatgattcacatcaaaatgattatcgacgctgattgcaacttttatcatgaggacacttcctgttagcgactaacgcaaaagtgagccagccgccattaattgaccccttgcataagcttctcgatgcgtggcgtgtaaaaagctaagatgatcgcaaatgccactgaaaccagcccgacaatcgcgaagtaagctacttcgtgactcggcgtgtagaagcgcacaatttgcgcattgaccgcctgcgctgacgcatcagccaagaaccacatactcatcatttgggatgaataggcttttggcgccagcttggtcgtcaccgacagtccgaccggggaaatcaacatttcgccgatttcgacaatggcccaactcatcactagccacaaaggtgataccttcgcactactgccaaaaagcatgaccgggataaccatccacagataagaggctccggcaaaaatcaaacctaaataaaacttcttcggtgatgtcggttggcgtttgccaagtttcatccacaaccaggcaaacaacggaccgtaaagcaaaataaacaacggattcagagtctggaagttccctggaaggattttaaagaacccaaaatccaatttggtttgctgtgccgcaaacaaggccaacacaaccgatccttgttcctcgatggcccaaaaaatcatcgccgccaaaaatagcgggatataggcaatgacccgtgagcgttcggttttggtcacctttttgctgcgaatcatcaaaataaagtaccaaaccggcaagccgatcgcaatgaccgtaatcagactgatgacattggcaatcgtcaacgccttgaaggctgccataatggccaaaatgacgccaaccacaacgaccgcgccgacaatccgcgtgaccagcgggcggacatcttccggctttaatggatccggcgccgtattgtcagccggattgatatacttgcggccgtcaaccacgtaaaagatcaagccgatgaacatcccaatggcggctaacgaaaagccggcgtggaaattgactttatcagccatccacggaacaaaaatcggcgcaatcagcgagccgaagttaatccccataacgaaaatgctgaagccggaatcacgccgtaaatcctcttcagggtaaaggctgccgaccatttcggaaacgttgggtttaagcaacccagtgcccaaaacaatcaaaacaatcgagccaaagagccccaccgcgccaatcgggatggacaaaacgatgtgccctaacataatcagcacaccgccccaaaagacagtacgtcgcgagccgagcaaccggtcactaatgaagcctccgattgtggcgctcaaataaaccaacgacccataaatcgacataatcgacaatgcagtcggttgatcaaatcctaagccacgcttttccactgaatagtacatgtagtagatcaggatagcccgcatgccatagtaactgaaccgctcccagaattcggtcattgacagggttaataacccccggggatgacccataaacgtgcggtcctctgaattattcaattgaaatacatcctctcgctagaaaaataatcttcctagctgctctcatgacacttccctcaaaatgtcaatcaatgaatcttcattataatagttacgctcgcccaaaacaaatttatgcaactttacgtcttatgcaaatgtcaactttccgaacataggcccaattggaaaacaaaaagcaaacgcacccatcgttattcgtaggtttgtttgctttgacattgaagtcgtaaacgatgaacagattaatcagcacgcaacgcgatcgctgcatccttgttggccgccatgcgcgctggaatatggccgccgagaaccgttagaatcgtactgattaagatcaaaatcaccgcgtggatagggttcagctgcgccacgttcggcaactgggtcatgttatataagatgacgttgatcgggaaggtcaggagccaggcaatgataatgcccagtaccccggaactcaccccgagaatgatggtttcggcatcaaagacccgcgtcacatccttgcgccgtgcacccaacgccttgagtaccccgatttccttggttcgttccagaaccgaggtatacgtcagaatcgcaatcatgatcatcgaggtcaccagcgagattcccgcaaatgcgatcaggacaatcgtaatcgccgacataatcccgccagtcatactcgaaatcgtgccggccaaatccgtgtagatgacctgatcggcttttttcttgccgtggttgaatttatctagataactaagaatcttgtccttgtctttgaaactcgtcggataaatcgtgatttgcgttggcgtttctgagccgcccagactggtaatcaactgatccttggtcgcatcgtcaatttcttgattggtgaaaatattcacgtcactattgcgttgcgctttgacaaccgcagagtctttattcatcgcgacaagatctttggttaaccggtcggagtaagcaaatccttgactcaaaagcccgtcactggtcttcgagcgcgtccggagcacccctgtcacggttaactcgcgattaccgctttgttgatacgcatccgcatagttcttggtcggcacataaacactgccaccaacattttgatagtagtgatcattggcaatggcctttagttttgtccctacaatatcgctgaacttaagcttctgaccatttttaactgaaaagccaagattcttcaacgcgttaatattcgttgaattgtcccgatcaacaatcaaaatgacatcgctgtctttcttgggataacttccggcaacgacttcataatttttcttcagataactggtgccgccttcgcgatcgacgggataaaccgatgaactggcactggaaaagccgcgttgtgattggttatttgtcggtttggctgttgaaaattgtactggcttcaccttcccgttgacgtcgcgcagtaagttcataccggtgccatacgtatagccaatgttgtcggtcaggcgtttactgatgccattcacataatcaatatacttttgatttaatttgttcgtgtgctgcgctttgtcactggcactttgctttgccagcaccgttttggtcgtcttaaacgttgacgtcttggtattatcttgtgccccggccgttagattggtcgcgttcgttgaaattgtgatgggaaactgggccaatgtttctgcttgggtattatcaatttgcttttgaaacccggatgaaagcgccaggacgaccgcaatgccaatgatcccgatgctggaggcaaacgccgttagaaaagtgcggccttttttggtcataatgttcgtaaaggacagcttcagcgccgtcaaatagctcattttcgtccggcgcagatcaaaatgactgccctgttcctccgcatcatacggacgcgaatcggacagaattttaccgtccttgaactcgataatccgctgggcataatcgtgcgccagttgcggattgtgcgtcaccatgatgaccaaacgctcccgcgacaagtcggcaatcaacttcatgatttcctgactggtttcggtgtccaaggcaccagtcggctcatccgccaacaaaatcgacggttccgagacaatcgcccgagcaatggccacccgctgcatctgcccaccggaaagctgattaggctgcttgctcatgtgctcttttaggccaactttaaccagcgcggcctccgcctttttgcgccgctccttggcagaaacgccgctcaacgttaagccgagttcgacgttttccaaaatgctcaggtgcatgatcaggttataactctgaaaaataaacccgacagaattattccgataagcatcccaatcagattccttgaagttttgggtggaccgaccatgcaataatagatcgcctgaatcgtagcgatcaaggccgccaatcacgttcagcagcgttgttttcccggagccgctggggccaagaatggctacgaattcctgttcacgaaactgaaccgaaacatcatcgagggccttcgtggtgtagtcaccggtttggtaatattttttaatgtgctttagctctagcaacgttcgctcctcctcttgctgtctatggcaaggcgttgaaatgaaataacttgccatatcttagcatacttagcggctacttgataatcggtctaaagcctaagacgttgccgatttgtcaaaaaagtcagcttttagaatgcggcgcctgcgtaaataaaaagaacctgccttaaaaaaggaggtcctccgatagatccgtgccgatcaatttaggatggcacactgagcaacggtcgccaataaatcaagtccaaactatgatccggataaatgtaataagtaatgttcaatttggaaaaaggattcgccattgccattaaatagatccgttgcggtgcgtgagccaatcccgcaacagaaacgagaatatacttggccatttgttcaaacaacggttgcgtcaaaccagatgttagctcaaaatccagatccacataaataagttctttggtttgccgcgtcagcctgatatggtgaatcggcatccccccgaaattaccttctcggcttagttcatcgaccatttgtttaatctggcgatgtttaaactgcgggcgggcaaacatcatgcgccaaactgccaagcactcaccccctctgcttcaattatgccacattgaagccgggaagcggactaaaaaatcggatcaaggatcttggaaaaggccgaatcgatctgcgcacgagcagcctgctgttcagccaaacctgcatcgaagcgttcgtgatcgatttgatctgggccaatcgcctgcaggatgtctaacacgccactgcgaataccacgcaggccgttgaccaacacgcgatgaaaggctgcataattgcacggtgcagcttcagcatcaacgctgtcaacgaaactgcagaacttaatcacattcttggtgaaatacacacgcaaccgatcgagactttcgctggcatagcaattgcccttctcgatgttcttgcatgtgtggacgtattctttgaaaactgtctcaaaaacaaggagccgttccagattctgattaattacttcaacataactaggtgcattgctcgtcgcgtacatttaaaagtccctcctaatcttgtgcgttcatcaacttacacacttaattatacgtgttaatggcttataatcaatataattattgactaatatttaaatacctaacgttatataacccgtttaaaggccattattagtggactttgcatacattacaccagtctgtgaaaaccgttttctttggaattgtacgcaatgtatctttttgtgaaaactgaacttatcaacgcctgaacaccctgtcttgacatctcggctgtgacgcgtcttttatttgctaagcgcttccatcaaaaataagataacgaaaatattttttagatattttgaacttatatttcaatatttctcaacaatcgtgcaaatactggctataaagattcttatttcaacgttgttataacttattttattttaacgaagggagttaatagcaagttttcacaacatcacctataatcgaagagagagcatgatgcgggcactgcttgaggttaagcgcttcatcggttgagcgaagcttatcccgtatgacgcgtcatgaccgttattcctttttggagggtgcaaacattgaaagactatccaaagaactacccccttgatccgcgtactttttttggaatcaataccatggggctcattagcacaacggcgtactatctttatacggctgtcttaatgatgtttattaccgattattccgggatttatacaggcatccctggtaaagcggcagctgttgcaacgaccttattatttgtgggtcggctttgggatgcggtgaatgacctgtggacaggttatgtaatcgatatttccccgcgaacccgctggggcaagttcaagccttatgtactggctggcactttttttgcaggtatcttgggtatgatgctgtttcacattccccaaggcatcagcgattttggcaaggaagtttatctctatgtcgtctactttctatttatgcttgcctataccattattgtgaccgtgccgttgaccagtacgatgtcggcagaccaggaaattcgctccaaacttatttcatggccccgcattaccagtaatgttgtcggtgtcgtatttgccttcttcatggccattgccaccttttttggaactaagaagagtcccaatatcccgctgacagtggacgtgatcgttatcccctttttgatcattgccctgatcggcggcttcatggtcaaagaaggtccggttgctgaaggcaccaaaccaccgaaactgcgggatatcggccgaatggtgaaaatcaacaagccttttcgggtcaacctgtactttacctttgtcggcggctttgtctgggccttgctcaccgcgacatccctgtactacatcaaatacgcgtttggcgtggctaatctagggattcagtccatgtattttggcttgttaaccttggtcacgttggttggtgggacgttcatctcgcaaaaggccatgaaatatatgtcggcacttcgcgggattcaactttgctatttaggcatggcaccgttcctgctcttaatgttcgccatcaatgagtttcaggtgatccacaatccttggctgttctacatcctgattgggattgtcatgacgtttgccggcgcgcaatttgttcccgctaacctgatcatcatggagacgatggattacaatcgcctcaagctgaattcagggatggaagctaccatcaacgcggtcaacatgttcttacagaaacttcagtccggactggctacaattggcgtcggcgcagcactcttactcgtcgggtacaacgcgcaaacccttgaaaaagcggcgcaggtacctgatagtctgcttcagagtttaggcgtcgtgttgtttggtttaccggccattttctcgtttgtcgcctatctgttgaccaagcaatatccgctgcaaggcgaagcccgtaccaaaatgtatgccgaactcgcagccaaaactgctgcagctcaaaagaaagccgctcagtcttgagccaaagctggttcgagcgggttgtcggctgtattttaaaacgccatctaaaagacgctagcgatcaagtggatttgtcgctagcgtctttgttttatttgtggattaactctcccgcattattcgcccgcgtacatcgccggcatgttgattatcctagccgattaatcgctgcccagctggcaagtgcttcgggatgaaagccattccaggtggccaaaacatccccggtttcatcgtcgcgcacacgcacaatcggaaagcgatcataaccatcctgccgaaacttcacgactttttgcgcactccaagcacgcttgagtggatcgtccgaattgggatccaccaaattcgtttcaccacggcgattggttgttcgaaaacgctgatgatgcgtcaacaaccaccgccgcgtcaaccggcaagcttcgcaatggggcttttcgtaaactacaaaatgaattgccatacgcatgccctccataaatggctcagtgtcgctgtcatacatttgatacgaggcgtatgtcctgtcgtttatactatcccctattttaagcgagcgtgcaatgatggaaattgtgttggccttttgtgatgtcgcacctcaacgccaagaattcagttcgactccgaaagcacggtaagaatcttttccagtgcgtgagtggcagcttccggcaacttatcatagccaccatcggctgtctctttggtggccaaaaatgctaggcgagcttccaaccgcttgcgcaacaaagcccgataatcaggtgccgtaaagtctactttaaaagctggtaacaccaaataactcatatctggtaacggcccaaatggttgaaattgtgcagtaccatctacaatcgccgcaattgcatccaacgtgtcagccggtttcacttttttcccgcggtaaaaaccggtattgagaatgtaacaagtcgtgccacgttcctgaaagagttcataaaaatcctggtagtcttcggctagcggataacaacgaaacggattggcaaacggttcaatgaccaactgatcgcgatccacatgagccccgacgttttcggcagttgatcgcttagttgctaacgttgccccaaatgccgccgccaaatcaggattctcgatccgaaccaccggtggcaacgtgtcgtctttcatgatccaaaaaacggcatcaatactctgggtcaaatgatcgacacgattaggcgtcacgaaccgcgacttaaccgttcgcccgttcccattacgaatgtcctcggtgaccagtgttttccggccatgatcatccaaggtaacccccacattttgtacggtaagaaaataccgaatccccggatcgcttaacggataatcctgggttttgtcaaaatacgcgggttccagcgcagtcgtggcgccagtttggcgatcaatgacgaatgcgtcatcgtgcagcactttcactgggtagcgatcgccgtgactcgtcagcgtgatcgttgatttacccgagccagacaagccaaacgctgccatcgtaaacgtgccgtcttgccgctgatactgtttcatcccgccatgacaggcaacaaagccatttcgatgtgccgtcgcccacgccaacgtcaaggtgccctttttcaattcgccaaagtagcgtaagcctaagatgattgccgcattgtgtagcgaatcaaaaatcgccaggccatccggatacgccggatcgtaccaatcaggatcggcataaagataaaggtcatcttctggaagcgggcgcgactgggcgtagtgtttttctgcttcagccgtcatgatttgaaagttcaataaatagctgtaaaggttattcgcatatgcttcaggcaacatcatatgcgcttcaacagaaaaatcgggcgacagaccaaccgcaacccggccactcaagaaccgcttgcgaccgccttgaaagaccgcttcacgcgcaacttttgccattgtgtctgcgtcaacgccgggctgtccgataatccggcgagcagcagcggttcggccaacaaccagaccgtcatttgcaaccaagatgcgggcgtcttctggcagcccgagatcactggcatgctgaatcggcaaatccgtgataatgacacctggcgcggctttggccaattcgtatgcttctgtcaatgtggtcaccggccggacattcgtgccatgaaatgccgtctcgacggtcgctttgagtggtgaaaaatagccactcgctgcggtcacatcacggatcggaaattgttgttttgttgtcatggttgcatcccccttgtacatccggtacaccgcaatggtccttaccctctgcgccgctatctcctccgttttgtgcaacggtcgccggagcgcaaacaatgtacgttcagtcgttttttgtaaaggctttcacaactcaattatacatagttcactttagcaacgcgagttttaaaaattcaccggatcacaaaggctatttcaatcacaaaccacattcacttaccaatcaagcggtatttaatctcgttatgctttacgccgtttgtttgcctgaaccattttggcctgatcaatcaacggacagccaacatcttcacattggctgcaaccgcctgctttgttttttcgaaaaaaggtgcgatataagacgaaaacgatcgccaaaacgacgacactgccaatcaaccacgttgccatgataaaagatctcctttttaaatatccgtgctataatccgacgcaaccacggggtgtggacgtttgagccacaggccgtaaataatgagtgtcactgccagtgcgacaagtccgaaactaagcacattggcctgaccactcacaatgagactgccttgataaatcaacatcgtcagcaaatacgccacgcctgtttgatagccaacggcacgccaggtccagcgcgcattgccaaactccttgtacatggtgccaatggccgcgaagcacggggcacataaaagattgaacatcaaaaacgcataccctgccatcgccgggtacgtcgcccgcagtgcctgaccaaagctgccagtcccaccgaagctaatgtgcagcgtgctgacacagttttccttggcgatcaaaccggctaaagtagccactgtggtatgccaatcaccaaaccccagcggtgcaaaaatcggggcaatgaccccaccaattcctcgtaacatactcttattttgctggaccatgtgtaacgtaaagtcaaagttcgaaaggaaccataacaaaacacatgacaagaaaataatcgttccggccttatgcacaaaggctcgtgcccgtgacatgacactgcgataaaggttggtgacacgcggcaaatggtacgctggtaactccatgacaaatggagctggtggtccggcaaacaaagcggtctttttcaggaaaatgccggagcagacaacggcaataatgcccatgaaataagctgacggcgcaacccagctgttattcggaaagaaggttccgctaaccagcgcaataacagtcaatttagcggaacacggcataaaggttgtcaacataatgctcattcggcgatctttttcgctttcgatggttcgtgtggccataataccaggaaccccgcagccagtagcgatcaaaatcgggataaaacttttgccgctaagattgaaccggtgaaacagccgatccatgacaaatgcgattcgcgccatatacccgcagtcttcaagaataccaagacatagaaacagcatcatgatctgcggcaggaaccccaacacggaaccaatcccaccgatcaacccgttcacgatcaggcccgacaaccacggcgcaaccgcccagctcttcaacgccccgccgaccaccgccggcaaccagccgccaaagaccgtatcattaagatagtcactgccgatagttccgactgtttggatcgaaaggtaataaaccacccacatcaccagtacaaaaatcggcaaggccagatagcgatctgtcacgatgcggtcaatccgatcgctgaccgacatgacaaaatcctctttatcgacgacacacatcgccatgacgcgggcgatgaaatcatatcttgcattcacaatgatgctatcgctcgcatcgtcaaaaagatgctcggccgtatgtaaaatttccgtgacttgttgctgttcagcgggtgtgaaagccagctgctgcgcaatttgcggatctttttcaaaaagcttgatggcataccatcgcaaacgatcggtgggcacccgttcaccgatgacttcctcaagcatgcttaaagcggattcaagccgcggatcatattccgggaaagcatacggtttaggtaacggcgcttggatggcctgaacaagttcctttaaagctgcaggtttggtggcagtggtaccgatgactggtacctgcaaggcataacttaactttttcaaattgatcgtgcggcggcgggctttttcaaggacatccatcatgttgagcgccacgattaatggccgcccggtttccatcacctgcaaggttaaatacagattgcgttcgagattcgtggcatcgacgacattgatgactaaatccggttgcttttcgagcaaaaaatcccgcgtcacaatttcttcactgctataaggcgacagtgaataggttcccggcaggtcttcgatgaccaccgctgaattggctttaagccgactggattttcgttcaactgtgacccccggccaattgccaatatgttgtttggcaccagtcagcgcattaaacaaggttgttttgccactattagggttgccgacaagcgctagggtctcatccatggtcatcagcggtcacctccgttaccagcacatgcgccgcgtcttgcttacgaatactcaacttataaccacgtaccgctagctcgataggatcgccaagcggggcaatctggtgaatcttcaccaacgtccccttggttaagcccatatccatcaggcggtgtcgcagcggcggatctccttgaatcttctgcaccaaccccgtttgcttcagcggcaagtgggctaacggtatcgccggcctctcagcatctgcggcaaacggtcgcactaccagcaaagcagcaatctcgtcactgatagccaatcgctgcccctgaaagaaaaccaccagaccggtcactttgcttgcaagtttcaccactgttagctttttgccggcgaccagtcccatttcagccaaatgccggcgcaatgcaggactgcctccgacactcattaacaaataagctcccggttgtttgatatcaagcaatgcctgcatctgcttacctccacgatgattaccagcaaatgaggatcatctcaatccgtcttgatattgctggcatttaaaatgttgccatgagaacatctgtgatcatttttccacttgttacgacgcgtcaatcgcccgtacttaatcaaacgtctacagaggtcattgtgcttttgccaaaacggcttttgcaaccgtcgcaacataatgcgtctggccatcggttgacggatgggttttgtcggctgtcagccaatcatcatgcccggcagaagcaccatgccaatcaacaatatgcaaattcttgtaacgcttggccattttgcccagatcgcgattgacctcatccgtccatttcgcatcagaacggacattaatccaataaacctgacgctgatcaccaatacttgtcataatggactgaaatgcctcattcgtaaacgtgccattcgtgcccaaaccgatgatcacagtattggccaatttaccggaagcagccagcgacttaaacaaagccggaacctgatagatttggcggctaaccgtcgcatcaaaatagatcttcgggaacaactctctatacagatactcactgccaagcatgactgaatcaccgaccgccgtcacggataattgcttggcggcttgaacttgatggtagctgagtccgtcagctgcaaaatctttatagactggatcagctgctttctgggaagcttcaaccgcctgactggctttagcagccgaacgtgactgggcaaccgaacgcactttggaacgcgacacggatgaagcttcttgtgcttttgcctgcgcctgccggttaaggccaaaccacaagccgcccgccactaaaatgaccgctaaaatcacaatcgtccaaatcaatcccgcttttgaacttgttttctgtctatgcatactgcaccccttcaaccaatcacttaccgtacgatcatagcatacaagcgcttaaaaaagggcgataagttgcttgggacagggatttcggagaagattctaatttttcacttttcttgggcttccataagctcactctataaatgattgaactcctgtgatcctaaagatagaattaaatcatcgttaaagacgctgcgttatttcgttcgcgttgggtatggggcaattatgtaattggggatggcatcttgaaatcagattcacgctttattcgttactacaatgttgtgattgcgctactggctgtcatttctattgtcatggtcattttggactattcatcagtcattagtctggtagcttttccttacgatgtggtggacaatgcgatactcgctatctttaccgtcgattacttcgcacgcctcttaaccgcagacaacaagtttaaattctttaaaactcacttgctagatctgttggcgatcattccctttaacgccattttttcgtttttccggtttgcacgggcctttcgtatcgtccgactcagccgcgcatttcgtatcacccgacttgcaggcatcatcagcattttacaaggacgaaccaggaaatttctccacaaaggcggtctcatttattatctgtggttatcagtcatcctagtcatcattgcggccgccatctattcgttagccgagggtgcctcatacagcgattcaatctggtgggcaatcgtcaccgccaccaccgttggctacggcgacatttcaccgaacaccctcttaggaagagttgcggcagttctactcatgttcaatggcattggcctcatcggcgctctcacaagctctattactgcttatttagcagacagcaacaacactgtttcaacacaaatcgacgatctggtgaaacttaaaaagctgctcgactccggaggtctaagccaagaggagtacgcgcagctaaagcatcatattttggcaaacgtgagccaacatgacacggatgactaaaatcgatgttctcatatttcatctacccgaatttccaagcggcttggccatggtaacatcagcaccgccctcaacgtcttaacgagctaggtgaacaacaaaataagaaggctctcggtgcacttgatggtctcacggcgccaaagaggccaaacgccaacaaggagttgatgtaaatgtgcaccaaagtttcgaaagcttgggaaattcgggaaaacaaaaaatgcagaagccttataatatcaaggtttctgcatttcaagaaaactaggaaagcttatttctgccggctgcaggacttgaacctgtgaccctcggtttacgataccgatgctctaccaactgagctaagccggcatactgacccgtacgggatttgaacccatgttaccgccgtgaaagggcggtgtcttaaccacttgaccaacgggccattgctgaacaacaagtaagattatacaggagcaatatagcactgtaaagccttttttctcacacaatttggattccgaaaagtacgttgaaaagacagcggaagatttaattttgggccaatttaattgtctatctacttttagtaagtgtatcataaaccttgaaccgactcgttatgaaaggatgttgttatagatgaagattgcaattattggtgcgactggcaatgcaggatcggcgatctacaaagaggcgcttaagcgaggccacgaagttaccggttacgttcgtcatccagacaaaggtatcggcgttcttccgcctgatgccgaattagtgcaacaagacgccttcaccctcacccacgatcagctgctaggctacgatgcggttgttgatgccttcgcgacaaccgttgaacaagcctatctccatattgatttagccgatcacctgattcacgagttacgggagaccacctccccgcggctagtctttattctaggcgcaggcagcctggaaactgacggcaagctcctgtatgatttacttaaaaatgacccgcatgcaccggcatttatcaatacgcctaagaaccagctcagagagtatcaactgttacagtggaccgacaatgtcaactggatcggtatttcgccaagcatgaactttgaacacggtccggcaactgaatacgttcgcggcgacaacacactgctaaaagacgacaaaggtaaatccgtgctcaacagcggcacattagcggttgccttgctggatgagctggaaaaaccaaccattaagcaagcacgcttcaccgcccgtaacgcctagttcttttttaaatcatcgaaaaggatgtgaaattatttggcacaagtcactttaaccattcattatgtcgatgaagacggcaagacattaggccctgacaatcacttaatgaatacgccagaacatcattttcgactcactgctccgaccttaatcggttatgactttcaaaaagccgttctccccgacggccagcatgtcggtgatccaactgtcaccggtaccatgacgggtgatgacccgcagctaacctttatttacacaacggcgtcatcactggttcatcacccagttccggcaacattggttattcagtactttgataatcacaaacggccattgcgtgacgcccaggtgctgcataccaaaaccggtcaccaatatgaactaacggcaccggatttccctaattttcggtatcaccacgctatgttacccggcggcatgatcatgtccgacaaaaccgtttctggtcgccttatccagccacataatgaactgacatttatgtatgaacctaagtaaattgttgtttcaatcaaaaacagcttccgttatggcttcattgccatgcgggagctgttttgtttttactgaccggtcaataaattctgtaacgtactagtgttaccttgttgttgcaacgatttgacatcctgatacgctcgataatagtcacctgaagcgattgcttggcgaaccggagtgatcgatttctcttggaacaacaatgctgcagctagcttagcttgcgcctgattggcaccagttgccttttgcagtagaaccgctgcctgatcctgatcttgcgcggctttcatgatcgtactcattttagtctctttcaatgtatcagctgcgcgttggagtgccgcatcagtcgctgcattgcccgtcttctgtgccgtaatccccgacactaagcgagatttaaccgccgcatcggccggcgtatcattgcccgtcacattgcgaatcgtattattgatttgcggaaaaaagaaaacgcaagcgacaagcaacaaaaccaagatgcctgcgacaaccgcaaaaattttaagtccccgatgacgaggctttttctgctggcgaagttgaatccgattattcatcacgatacctctttcattttcactgacaaaactctgtatcaacattatgcggatattgccaagcctggtcaagtttgaccgacacgtcgcccttggcaatgattttgctaaatccaacttactatgcccttaagcatatcttctggcgtatttaaattacgcgtcattctcattgggaggtgacacagtgtcaccgccagttttgtctcattgctaactttatgttgcatcaaatctttgtagaaaaaaacacccgtcaacgacgagtgtttcatgagctccggttgtcaggctcgaactgacgacaacctgattaacagtcaggtgctctaccaactgagctaaaccggaataaacagcgtggcagcttcctaccctcgcaggcagtttcccaccaactactctcggcgtgaagaagcttaacttctgtgttcggcatgggaacaggtgtatccttcttgctatcgccaccacacttatgagaactttgcgctctcaaaactggctatcattgttgctggtttgctttgctgagaatcggcgtatttcatcgaaacgcgttcaccggcgcagaagcctgcgtgtaaggaccttggccgccatggcaaagaccgccataacgtccaagcccgcttacactccggcttctaaccgcgccgcttcacgctctacttggttaagtcctcgaccgattagtactggtccgctccatgcatcgctgcacttccacttccagcctatctacctgatc

SEQ ID NO: 317 - DNA, 30703 bp, Lactobacillus casei
ctcgataccggagtatcaaggaccctgcacatttaaacgaaactttgttcagttttcaaaggacgaccttgtcaaaagacaactttgatagattatcatgaccagcaaatcatgtcaacaactttttgaataaacatgcatttgttgaatgtcctgatgtgctaccaatttgacaacgaagaatatgatagcaactttgttgaacgccgtcaatactttttaaatgaggttttactaagaaattgaaggccgaacattcaatcaaaaatgcagcgaattattaacaattcgctgcataaacatgcactttttcaattagtcttcttgtttgatgacagtttggccatgcatgtaaggaactaagacatctggaatcttaacggtgccgtcttcttgttggtaattttcaagaatggctgctaccgttcggccaactgccaatcctgaaccgttgagtgtgtggacaaactgcaacttgccttcgtcgtcgcgataacggatctgcgcacgacgcgcttgaaagtctgtgcaattgctgcagctcgaaatttctcggtatcggtcttgcgctggcaaccagacttcaaggtcatttgtctttgcactggtaaagctggcgtcgttgctggctaacgtgatgacatggtaaggcaatccaagcttacgcaacagatcctcagcgtcatgaatcagattggttaactctttccatgaatcctctggtttacagaacttcaccatttcaaccttattaaattggtgcatgcggatcaaaccacgagtatcacgaccggcgcttccggcttcggaacgaaacgctggcgttaaagccgtaaaattaattggcagtttatccgcatcgataatgtcaccacgataatagtttaccaatggcacttcggctgtcggaatcatagttaatggctcgccgtcatttgtaatggtgtaagtagcatcggtaaacttagggaactggccagtcccaaacatggaatcgttgttaaccaagtaagggggaatgatttcctcgtagccttccttttgatgttcatctaaaaagaaattgtaaacggcacgttctaaacgggctcctgcccctttatagtaaacaaaacggctgcccgaaacttttgcggctcgttcaaagtccaaaatacccagactctccccgatgtcccagtgatgcttcggcttaaagtcaaaacttgggatcttaccccatttgtattcttcccgggagtcatcttcattaagtgacattggtacgtcatctgccggaaaattcggtaaccgcacaagaatataagtcactttgtcattaagtgccgccaattctttgtctaaagcactgatcttctggccgacttcacgcatcgctgcaatttggtcatccgcattttctttgttgcgcttcatgacggcaatcttcccggaaacttcattacgttgggcttttagttcctcggtttgcactgtcacttttctgcgcttttcatctagagccagtagctcgtcgatttcttcacccttaatcgcccgggcggctaatttcttcttcgcccattcaggcttttgccgaatcaatttcagatctaacatacttttcctccctcatcattttgatgtatctgacacgtcaaagtttgccttgccgcgtttgccggcgaagcgccggttcacgctcaacacaaaaagcccttcatctccaatgggacgaaaggcttctttccgcggtaccacccaagtttggcgtagaacgccaccctcttagccgataacggtcggcttccgtgcagctcatcactgcccactcatgcgctggaataaggatgattgtcagcttgcaccaaccgctggctctctaaaacatccacttaggcgcttcagacgtgttaactatacattgctaaaataccgcatctcgacataggatacaagaaattttcggatttttaggatgaagattttcggatttttaggatgaagacgtaccctactccagtcaattgaacggattgcatcgcgttctagtagataaaccgggcttctttgagcatcttttcatcccaaagttcacgtagcaaactataaagctggccgtagtggtcattggtgacattgatgtgccacgggaaaatctgcgtcttaccgacattgtcttgaatgagccctaccgaagtcgtgatgaccagatcaacatccttgagattagcatcaggcgacgctaactcaacgaacgggactgcatgcaaaaacgccaagagatcgatatatccagtcattgtttgttcgataatcggagcaaccaacacttttttgcgtggctgaaattgaactacaagttgatgcaggctgcgataaaatgcctctgtcaaaacttctcggcaatttcgaaacgatgacagcttcttgcgcccaatcacttcgtcaagcgtgaccttaacctgttggtaaaatgccggatcatccttggtttgctgaatgtttgaactgaactcggctaacaaactggtcgtaaaatccttattaaacgccagcacactcaccgtcacacttagcatattgacgaatagcaaacggtaagtatcatcgggtaggtgaatatcacgcttgaagctgtatggaaaatgctcgaaaaatccactgatcagttgataaatctcgggattatagttgttatagcgctcgatcatccgcttttcaacttgctcatccgtgataatatatagcggtgcaaaattaaatagaaaataaagcgcgtcactttcgctctgttgctgctgggtggtcaaatgctcaaattgttttgatttatccagtagtcgcgaggccgcgtcgctgaataaattgggaaccgggtaatgcagcacctccgattgcgaatcgtgcaccaaaatgtggccgcttaaaatgcgctgatgggaaatcgccacataatacattagtaactcacgcgtgatggtgttgaccttgccgctatcgaagacgaccagtaagccatctagaatctggccagcttgctggtgcgttaaattttcaaaaggccacgccacgccattggttgccaaccaataagcaattgtcataaacagccggatatttaattccgggccggtaaatgatagtgtttcatacgagaactgcactccgctttgccgcgcataaccccgaagcgcctttaaatggcgcaaaaccgtggctttagagctatcgcaggctttcaaaaaatcatcaaggttctcataccgttgatataagacagcgtctaaaaatttgtatggatgtgattgggcaacaagatgatagcgaaattcgtcaggtggcaccgcaaatagtgttttcaccgaactatggtgccggccaagcattgcctgtaatgaactaatcaggccgttataagtattatagacgctgccataattgcggttcgtaagtgccgctatctgtttgagattaacctcacttaccaagggccgatgaccacgataagccgctaattttgccgtaactggtgtctgcgcttcccgtacctcgataatggtacgaaacaaccccagtttctcagcgtcagacattgacaaaaaaatatcatgattgtctttcataaaatctccctacttcagataatttaccccatttcccatgattatacttcatcgaacatacagcgtcaggtttcaagctcggcacaaagcttgtctataccatttttatagcagtttcttatcttaacagatggttttacgcatgtttaaagttcaatagttcactaataaaacgtcatactcgtcattctttgttataattgatattgaagcgaacaaaattgtcttcagattgggggatcacgatgctttacgaacaaacttttcttgaccgtgctgatttccaaaaataccaaatgttttcagctatcaaggatagtaatgtccaaacttacaccattaataccctcagtcggcacctagacctttcttatcagcagggctacaacatcttacaggaactctttcgtgatttaaccgaattaacggcgcatccggaaaaccttaaacgtaaacaaatcaaccttttaatggaaatcgacgtaacggttgatgattatcacctttatttgctaaaacatgcgattgcgtttcaatttgttgactacattgttcaggctaatcatccctctaccgagcagttttgccgggcccatttcatcagccgctcgacgttggtgcggaaaaccgtcgccttgcgcgcactgctcgaacggttccaaatcaagttgtcctttagtgatttgtgctttatcggtgaagaaagccgaatcaggctgtttctgtttgatttttactggctaggttaccatggtgttgactggccatttaaagtcttggatgaaaagcaaatcgtcaaagaatacatggccttacccaacgccaaaaccaatccggtcgatattcttgaagagatcctcttttgggcaatttgtcgggtgcggatcagtggcaaccattttgttaccggcaacgaaccgtttgaccggatcttcaaggattacccaccatttcagcattccgtttatacgcaagaaatgttcccggcgttcaataaacaattcatgaaagctgaaaatgatttcttctattttcagcaacatcgaacgatcaccttcttacctgacacaccagccgacaaagactttattcattatgttcttaagcaaaaaacgattacggcggatttcgtgaaacgacttttggccttcttaggtgatcatattcggcatcacaccgtctttgaccttcagcatgaacaaggcttaatcctcaatttaacccgaatcgccttgaacaacgaaatcttgggcggcgacttcatgcatttagtcgactttttcaatccccgcgcgctgaattacaccaaaaccaatctttatcaaggactcgaggaatttattgccaccctgcctgatacgcctgcatatcggcattttcttggtcagcagcatctattcttacggacactttactatttgttgacaccttatctgcgctacttcgccgaaacgcctaccgtacgggtcagattggcctatcttgatcataatttgctgaaccggcgcctcgtcaatttcctatccgatctgccaatggtccacttattgccagaacgtgccgttttcaaaacagcggacctcgtcattaccagcgtcgataatgagcaggccatcaaagccgctgcgcctgccggttttcacgggcacatcattttggacagccgaagacagcgatgacgccatcttccaactgtatttgttgattcgccgcttgtacctaaagaaaaccgacgcctcgttatcagcccaaaatgtcgatcccccttcgtaggctcccgtcgttcgaataaattttgacagttaaccatcaaaaaacggctctaaaacgcagcaatttgcgttttagagccgttttagtttagcgagaattcataactatggcgagaaaagctgcagtcagaaagccaatcaggtaacccgttaattacgctcacttggtcgcctgatgctcgcggtgaggtgaaagatcgactttttctagcggaatcagtttggtcttatgcttcaccttgtaccaaacaaataaaacgataaaaagtggaatcgacatgtaggaaatcagtaggcgtccccatgcaaaatgttgcaccgcttgcaaatcctgacccacaatcacaattaagctcatgataatcgccaaaatcgggccaaccgggaaccattttgcatgatattttaactcatgaacatcatgcccttgcttcacaaacgcacggcggaagcgaaaatgcgacaccgcaatcccaagccacgctaggaatccggtcagaccggatgcggcgaccaacagttggtaaacatggggtcccatgatgctggttaaaaatgtcaaaccaccgaccagcgtcgtcagtagtaaggctgcaatcggaataccgcgcgtattcgttttttgaaaaacgcgtggcgcaaatccggatccgcccatggcccacaacattcgggttgaagcatacatgccggaattggcagacgataaaaccgatgtcagaatcacggcgttcatcacgctggccgctccggcgaggccaattcgatcaaaaaccagcgtaaacggagaaattgccacttgatcaacactggcgcctaacaggttcggactggtataaggaatgatggcggcaatgacagcgatagacaaaatatagaacaataagatccgccaaaacacctgcttaatcgccttgggaatgctggtttccggggtggcactttcgcccgccgtaattccgattagctcggtaccttgaaaagaaaaccctgcaaccacgaaaaccgctaatgttgccggtaacccaccaacaaacggcgccgccccggtcgtataatttttaaagccgatgggaccgtgtccgcccatgatccccagaatggtcaacaaacctacgaccagaaagaccaggacagtgatcactttgattaatgacagccaatattcggtttcgccaaacgacttaacggaaataatgttaatcgtaaaaatgagcgccaaaaagcccagcgaaaacagccagcccggcacatccggcaaccagaagtgcatcacaatggccgttgttgaaacatcgacggcaacggtgatcgcccagttaaaccagtagttccaacctaaggcaaagccaaacgccggatcaacaaaccggctggcgtactctgaaaaggaaccggataccggcacataggtggccatttcgcctaaactggtcatcagaaagaacaccattaacccgataccaatatatgccgcgatagcgccgcccgggccggcagttgcaatcgcgctgccgctggcgacaaaaagtccggtgccaatactgccgccgagagcaatcattgaaagatgccgggttttgagttctcgctttacctgattcgttgctgactttgccacaaatgtactcctttgctgaatgggtgagatgttaaacgttgggtttgttacggttacagggcgtttaagcaccaaaaaaaccggtgggtgtcagtaactaacccatcggcttattctacttctcgtcatgaataaacgtgatccgatttgttagcgccccgcgatagtcgcgacagtccagcagatgttatccactgacccaacaccgccttactgaactaagccggcatttcggcacctttccctttaacaactgcgcatctggcgttcaggccattgcagttgcgactgatgagcggtgcgacctctaatcttgattatggttcacgttatcatgtcttgtttctaacggcaaccggctctcacccggttttaactcaattttcagctttgcggatgtcatcgactaaactagccgtgtcaaagtgctgctttaagaacggttcgtcatcggttggcaagtgtaactgaaagtcgctaaacttttgtaaaaataattcgccactgtcgagctcaaatccgagaatgtgcccgcccatgtgatgatcagccgacaaaaagtgcaaatggaaacccggcgataccgcaccggcataaagatccggtgaaaagtacccgatcagcgtgcctttgacgttatcggcatggaattctttttggcccgaagccgtctctgtcaacgtcgggtaaggaggttgttgcggcaacacagcgcgcgtgtgcatttgcgtgaaggtcccttcgaccctaactgccgcaaaaagattgctcgtttgtaaccgatcaagaaccgctttctgaaacccggtcagatccaacccctgaagcttcccggccgaaacatcgtcttgataatgaacattcgcaaacggcactttctcatccgctgcaacttcacgaacagtcccctgtgcattcacctgataaactttgccggcttgaataatcaactcgccatcaaggccggtcaacgtgccaataccagtgtcaccgtgttgcaacaacgcttcaattgtctgcgttccggcaaacaaaccaggcactaacattgccagtgtcccatgttgatacaatcgatccgtttccaaaaagaagtccctccttttgcgcagggttgggcctgcagccgcccagaatcaacctgccgccaacgattaataaatctggtcaggcagcattgccgcgccgagttccgcattgtcggaataatcgaccggaatgtcaaccagcactggccctttagtcgcaaacgcttcatcaagcaccttgccaagttcactcggtttattgacccgcagacccttggcaccaaaagcttctgcatacttcacaaaatcaaccggaccaaagtcgacacctgctgcccgaccatatttcatctcttcttggaattttaccatatcataatggccatcgttccaaataatatgaaccaaatcagccttcaaacgaacggctgtttctagctcttgccccgagaaaaggaagccgccatcgcctgacactgaaactgcttttttgcccggacgtaccaaagtcgccgcaatcgcccaaggtaaagcaacccctagcgtctgcatcccattggaaaacagcaagtggcgcggttcgtaactccgaaaatggcgggccatccagatatagtgactgccgacgtccacagcaactgtcatatcgtcagtcacgcgtttttgcaatgcggccacaatactgagcgggtgtaagactttttgatctgagagggctggcggaacatcactttcctgtaatttggcctgtaactctgtgagatactgcttgctttcaggcgcaacctgataaccccgcagtaacgggactaaaatatcgagtgtctgggaaatatcaccaatcagctctgtttctggctggaagttatgatcgatttccgctggcacatcgtcaatgacgatgatgcgcgacttgccatccgcgttccagttacgtggttcgtattcaaccggatcatagccgatcgcaatgacaagatcgctgtgttgcaataacatatcccccggttggttgcggaacaaacccacccggccaaagaaattgtcgatttggcggtgagagataatacctgcaccttggaaggtttcaacaaccggcaactcggtgactgacaacaactcgcgaatctcttcggttacgtcgcttgatgacgcgcgcattcccaaaagtaagacaggcagcgatgcctctttaatggcatgcgccaggtaagtcatatcactaggactcgccggccctaactttggcgccaccagcggcttaatcggttccgagttcaccggtgaatcagtgacgtcttgaggaatcgacacgaagcttgccccttgcttgccggattccgcggcttgataagcattggcaatgatttcactaacattgtccggatcctgcacttcagcggcatatttggtaatcggcgcaaaaagatcggcgttacgcatgctttggtgggaactacgcaacagatccgcccgctttacctgaccagacaaagccaaaaccggatcaccttcagcggttgcggtcaccaggccagttgccaggtttgaagcacctggtccggaagttgtcaggacaacgccgggtttgccagtcaaacgcccgatcccggcagccatgaacgcagcgttctgttcatgccgtgccacgattaattgcggactcttttccgatttgggatgctccaaggtttcaaaaacccggtcgattttggcgccggggataccaaaaacataatcaatcccgtgatttgccaaactttcgacaattaaatctgcgccatagcgcttctcttctgccatttcgccacttcctaaattattgatgtgtttcataatacgctttttgtgttccgtttcaagcctagtttttttgaaaaacactgactaaacagaaatgttctgttacatatttttcatcaatctgtatcaattataaaattggtcgagtcggtcgggagtcacttagctgatgttttttagcatcatcttgattttaaacgaaacggcataaactttgcttaaaaactgctcacaaagtgccgtggggacgggtcagattatttgtttgcttacaggtgttctattttagggcaattaacggccaaactccggtttctataacgcgctcaacggcgcagaagcctgcacataaggacctcgagccaaaatggccaaagaccagccattttggctcgaggccacttatgctccgacttcttaccgcgccggttcacgctcatcaaaaaagcaccgccacaataggcgatgccaactcaatcatacaacttccaaataacgactgctttcaagactgcatggaacgactgattttgccgatgccggtcttggggtctgtcattttcatattaaaaccgaatttcgtgaaaatgtggcgtaacttggctaagttaactttatcaaacgaactgatcgtgccgtcgactaaaccgatatcggctttcatcgccaagttaagaaatgcttttaacgccagctgtgctaggcccagattctcaaaatcgtaaaaagccagccgactttcagaacccagtgtttccaagacggtgatgtgcatcacattatcccagcgattggtttcaaacaggagctgtgcttgataatccgctttcgaatggccatacttgtcaacattttcaaatggtgtgtagacgtaaatcgagttcgttttttgcttttgttcgtcggatttaaagtcagtgaacacaatatattggctcactttcttttgcgccggatcctgcggctgattcatgcttgacaacacggtgaactgcggatcggcttcgattgctgcaagccgcttcttataggcctgctggtactctgtttgcacagtcattttgaaacctccagactattactcgtttttcattatagcatttttcaatccgatgcctacacaaaagaaaaaaaccgcgttgaattcacccggctttcaaaaactgattaaagaaaatcctcatttttcaaactgtttcggcaaaagtcgaaagtactgttcatcgcgcggctggtgctcggttaaccctcgtggcaacggcacctcaaactgaaaaataaagcctaatctttttaataaatgaatggacgcatgattgccaggaaaaacgcctgcccagatggccttgatgccatgagcaaattgatcagcgatgacaagctgcaggccctcgcgcataagtccttgatgccaaaaatcaggattaaggatatacccgatctcacgcgtcatgtcatcacctgtttccggcgacaaggcacggggatagacgccaatattgccaatcacatgcatttggtaaaccaacgccagatcctgctgctcgcgggcgaagcgttgaacatgattggccgccgcctcccgcgtcagtaaaggtgtcatccccgcggccatggtcacctgtttcagtctggcataagcaaaataatcatccgtatctgccagtacaaaagggcgaactgtcacccgtggtccttgtaacatggttcctccccctgacgcttgtctcatttagtggaaaattttttccatttattgagatgaacgtccttcccatttgaattaaagcctgcattttcttcggcggcaaactatttatcttttcatattatcgagtattcgtgacgcgaagacaagccccgcccattgtgactcatgcggtcgcgcaaccatgcacaagcattttatgctggatgaacgttgcttatcagtaaaataaagttgttatctgaaaataattcaatataacaatcagacaaggcgatgctcgatttactagcaaacctcacccgcgtctgacatgcagcgataaatgtgatcgcactcggtggcacctgttgccacctacatattacagacaaaaggtgaggacacatgaaaaagcttgtacgtaacattttgttactttttatattcatggcttttatctggccactccgcatcgtcaacgccgcagttgcgccaaaattcaccgtcacgccgattttaccggctaatcaacgtcagacagttactggctattttgacttggaggttcaacccggtcagcaagaagacttacaattgcggatcgccaatcaaactgatgaaacccaaacgtatacgcttgccgcaaatcctgcttacaccaccaatagtggcatgatcgccttcgatcagagccggccgtcgttggatcaaaatgccattcgcctgaatacgttgattaagggaccgacctcggctacgattgccgcgggaagcaaccaggtggtcacctaccatttgcagtccccaactacgcattttattggcattatttctggtggcttttatgttttgcaaaaaggcggcacagcggcgacgtcatcaactggcggcgtccgattcacagatcagtttgcaattggcatcccaattatcttacggcaggatctgaaaacccctaatccgccactgttggaactcacaaaagccagtattgggactgccaaccattatccggtggtgaacgccaacatttataatccttcaagcaatcagtttggcgaaatcgcgactgattatacgttattcccaacaggcgggaacaaggccgtattgaccggacattttgccggcttggcggttgcgccgcattcccgcttcacgcaaagcattccactaaacggcaagcaattgcaggctggatcttataccttaaagtggacagcgaaatccggttcgtatacttggagcaagcaggttaattttcggtacaacggccacctgccaagcaatgccatcgtctcccgaccgcagacccctgctgcgtcgcaaaacagtttaacccttccttggattatcgccggtatcgcaacaggattgctcatcattatcctgggtatttggcgctggacggtcgttcgacacaagcaaaatcagtagaaaagcgtgccgttactgcttctttggcttatgataaaggtagcgcacaaacaccggcctcaaggcatcatggttttagcgattgcttaagaccggttgtattgactgccgcataattgaaacatggtagcgccaagaacgcgtccgcagtgctgtttattgccggagatttagcaaaactgtccgggttttggttacgcgcttggtaaccgggctggctcgcgctcaccataacgcgctccccggcgcagaagcttgcgtgtaaggaccttgaagcctaaatggccaaagcccagccatttaggcttcaaggccacttacactccagcttctaaccgcgccggctcgcgctcaccatgtttgaaggaggagtttcccatgtcaaataaccgcatgcttggtaatgaatttcaaaccgcttatgaagatgccggcgggacggatattttaaagtttttggcggatgtcaaacaggcttaccgctgcattagcgatctgaccgcgcggattacggcgatgccggattcggtcaaaaccgagtcggttccgcagctcttggttcagcaattggatcagaccacgtttgccgaaagttccgttcgcaaatgggaagatgatttgcggcgatttgctgcttatttaacgccgctggaaccgccaattgcgattcttgacagctgggacacactcactgattttctcgaagccaaccaggcattgctaagttcattgcaaaatgtaccgttattgcaccaagacacacaggatgtcaaaacggccactcagctgctggtttatccggccgaaccgcttttccaagttgtgcaagccgataccggtgaaagtgacgctattgatttacctgggttaacggctgctgatcccgatggtgtggctgaaattgctaaaacccatggcgtgacgccacttgccgcctttacggttcagccttgattttgccctgtcaatcctgtatgcttgacaggttaaatcatgaaaaagcgaggtgctgaaagatgcggaacaacatcatcttaggtaacaatgaaaccggcgaacgtatctatttaacttctaagaacaagcggaacacgcctgatcgtctgcaactcaagaagtattcaccaaagctgcgcaaacgtgtggtctttaccgaagttaagtaggctataagccgtcaaatgtcaaaaaagtaccttcttaccgagattgtcggcaaggaggtactttttttgaaccccaaatggtatggctagcatttggcaatttgtttagcatcatttttcgttcaatagtgtctcaaacaaagacggaatgggcagcgctgcgtgaatttgcttttttgaaaatggatcgacaaagcttaaacgcgtggcctgtaacgcctgatggtcaatcaaagtgcttggttgaccataaagccgatcgccaatgagcgggtgaccgagactggcaaaatggacgcgtatttgatgagtgcggccggttaacaattgcacatcaacaagggtgttggttgccattttcaggactttatacctggtttgagccggttgaccagcatcggcaatgattcggtgaatcccatccgcccccaagccgataggagcatcaatctcgccttctgatttcgtgagctgaccactaacaacggcgacatactgtttttccaacgttgcgtgttgcgcctgatcaaaacggccttgcgcgtaagggtgcttggctgccaggacaagtccaacagtatcgcgatccagccgagtgatgatagctggctgcggttcagtgatgccctgttgctgcaaataccacacgatccgatttaacaagctatgattaggtgcatgcgggccgggaacactggtcacgttggctggcttggctacgattagccagttgtcgtcttcgtatagcacatgaagcggcaccttttccggcgtgaccgttttggtggttggaatcgcaaagcgcacgacctgcccagcgttaatcgcaatattgccgaccgcctgaccatccacccacagaagccgatcactcagcatctttttgaataagcgatggctgacgccttgcttggccaacagacgtttaaccgtggtggtggctgtcgcttttgaatcaaatgtatatcgcatggttttcccttcgtcataatcagcattctgcgccttaaagccgaacgaattttttggaaagtttgcattcaaacggcttttgggactatggttagagtataactaatgtacaagaataaggaggaacaggcaaatatgcaagtagaaaaagatgtgatttacgatgaggcccataatttacccgctgatatttatgtgccagaggatgccaatggtgcggccatcgtgtatgcccagggcggcggctggttccgtggagataagaaaaatgaagatgatttaggtgaatattttgccaatgccggttatctcgtggcgattcccaattttcgcctagcaccgaagtttttgtatccgacagcgcaaaacgatttcgatcattttgtcgactggctgcttgcttccccttatgacttcgatcgcaaacgtctgggcctgttaggtgccagttcaggcggtaccatggttttgcaaaacagcctatcttccggctatcccgtggttgcgtggtcaccggttgtcgactttgccaattgggttcagaaaaatcaaatggtgaaagcatcggttgatgccaaaagtgaatttggtctcactgagattcatgaaatccacgatgctttttataagtactttattcaaacatatttaggcggcctggatccgcggctgttaacagcggtcaatccaacgaatcatttgaccgaccaactcgggccaacgttgctctttaactccgcagatgagctaatgcctctgccaagtgccttacatttcgtgcaacaggcagctatgtttggccgcgacatttcattgcatgtggtgccaggtaccggtcatgcacgcgactacaccagtttcgcattacctgaaaccaagggcttccttgatgatcatctctttaccagcgttgaagataaaacgctcaacaaggcgacagattaagtttttatttgtaaaatcggcgagttgccaaattaaaaaatcgtctccgacgtcacacagacgctagagccgatttttttatgtctttatgtttaagcgttatggccgaagtatcagtggggtggtcgctcccggtgcaacccactggagtccaccgtttactggcactaaataaatgggatctgcggcaacatcggtcggcgttaaaatcacgccgtttccctgttgtgctgccgtgtaaccagaagtcgtgtttacccctgcttgggtaatggtcatctggtcgccggtaatcgtcagtgtcacgtgctcattgtgccatgtgccaatataaaacggcgctttaaccgtgggctgactggttgctgaaaacgctattgcactagatgaattgacagcatcagttgaagtgctggcagtcgtagtggccacatccgttttaactgaagtcgtcacactcgtctcacttttactttctgatgtactggcttgcgcgctagtctgactggtcagtgattgatgcgtcgctgtttttgttgacgcagttccggcatctgccgttcttacctcacttttagcactgacttgatgctgataaaacgcggcgccggaaagtccgccaagtgttaccaaggctgctgctatcatcatccatttcttcatgtcaaccactcccactcaaacctgatcagcattttgtttctttcaacatttttagtctagcatgcagatcattcttaatgttacaaaaagatgtcaaagcaaacaaatcttaatatttacaaggctttggcatgtcatctttttgtaacttagtaaaaatagtacgaatagcttgcaaaagcaaacatatgttcgtaagattgttctgaggtgatttgaatgacgtatgaagataaaatcggcgagcaaaagtttgcggcgttggtcgacgatttttttgccaatcgatatatcgaccgtggcatgcgcaagtggcaaggctattacctctctgaccataccgcagcgttaaaaaagcaggcaaaagccgaaagcatcacctatccgccgctttctttacaagagcagccttatattcgcatgattttgttgcgcgcttatgctgaaggccaatccgtcacccttcagcttgatttgcaaacaccaaatggccagatgttgccgccaatcaccggcaaagtggccggattaagcgatagcgatgtggtcaatgttgacggtcaaaacatcagtatcgacatgattcggcatatcgatttgattccttttccggtttgaatcaaaaacggcacccgctattaccacgagtgccatgctttagcttcttattttggaaactgaatgatctggtcaagctggcttggttcccaggagcgtcaatgcgtcaaaaaagtatgccagactcagataatcggccgtaccacccggactcagattcagggtgatcatttcggcgttcaaggtgcgcaaggcattgggtaactgcgtatcggaaacatgcagcaacgtcttcgccgcatcctgaacaaatcgcaaaccggccggaccgccgcgatgcaaaagattggcatcttcaacttgcgccatcaaatgcaccattaagcgcagataacgcaaatcgccctgtgtcgtcgtctgtcgcagatatggcaacatgtgctcacgaatggttggataaccggccaaagcctcaccacggactcctgtgacgccgtgtttcacatataaagcttcgccgtggcttagctgcgctttgtcacctaaatggcgaaaatcgccggcgacaccttgtgcaacttgcgcaactgccggaaaaagcggcgcaaattccgccgccgccaaatcatgcaaggaattctgctgcaacaaccaaccaagtgcccctagtaaaaagccaaaagaaaagttggcaccacgatgcgtattgacgccgtgcgttgccgtcagcatggcactttctgcgtccatgccaatcgtacgtaactcctgataaagttgcggcactgttttagctgccagaccagcatgcaagtattgcgtgaaataaggtgccaacgcgtcaatgctggcctcaaatgtggtgacatccatatcccggtgggccccgttagactcgggatcgactaagcctggcttgggtgcaagcagcacttccgcatgtaaactgttcaccgctgcttgagcgatacgttgttcattcaatgtgtttggccttcatgacttttagaatatattgcaatgaatgttcgagatgttcccgagtgatgagcttgatctgatcatcatcccgatttaacatgccgcgataaagcagccaatgttcctgaatcgctaaattccgccgatcatcaccattaatactgatatcacgaaaataaatcaaataattttgcagctgattgacaatcattttcaaccgcagcatatgactcgcatcataaataaagttgttaaattcggtaaacttagccataacttccgaaacccgtccagcatcgtttaagcgatccgtctcctccaaaagcgcccgcatctgcttaaattgatcaggcgtcatcaggcgcatcgccttacgtatcgccagaacatccaattccttgcgaatatcaaaaatctcgtaagcatcattaatcgaaatacccttcacaacaaccccaataccggtcttgcgttcgaccaggtcctcttcatccagacgttcaagcgcataacgaataggtgtgcgactaatgttgagattttcggatagattcttctcgttaatccgttcaccgctgggtatttcacccagcaagatggttttgcgcaacgcttcgtaaaccgcttctttaatcggccggttctgtgaaagatccaaatttttcttaacggctggcaccacttcattcatcgttcgttccccctcgtcctgagggccattataccaaaaaaagccattaactagtcggttaacggcttgacccatgtttcttccagcgaaaatcgatttatccgcaaaatggcacaggtcatgaaactcagttatgggtaggatcaaacgtcaaatcaactgtttgaaccggaacatcgtagaatggatcttcacgccgacctaagaagtccttggcttgatcagggaataaagcatagctcaaaacgtcttcttctgaatgagcgtattgggcaattgctttacggaatcccggcatctgcggctcgattaaatcagccggacgcgtcgtcacgatcgatgcatcaccgatgattttcttggttatttccggagaaatcggtacaggcgggcgaccatagagaccgcgaacataatctttgatttcttttggaatcaacttataacgctcaccgctcatgacattcatcaagctctgggtgccgaccatttgtgataatggcgttaccagcggtgggtaccctaagtcggcgcggacgcgaggcacttcttttaaaacatccccgtataaggattcctgcccttgatccttgagttgagccagcaagttagacaacatcccgcctggcacttgataaatcaatgacttcggttcaacatccttgacccgcgggtttagttgtccggcatcgcggaatcgatcacgaatcggggcaaaataactggcgatatcactcactgtatccagcttgacgtcggtcggataaccgagatcctgcaaggcaaccaacattgattcagtcgctggctgactggtaccgccggcaaatggggaaacggcggtatcaatgatgtcagctcctgcgcgcacggattcgagatacgtcatttcggccattcccgcggttgcatgcgtatgcacttcaagcggcacggtaatctcctgcttaatgccggtcacgagatcaaaagctttctgtggcgtcaaaatgcctgccatatctttgatcgcaatcgaatcggcacccatgtctgccattttcttggctaacttgatgaagtaatcaaccgtgtgaaactcactggttgtataactaatcgccagttgtgcgtgaccgccagcatttttggtggcttcaagtgcagtctttaagttacgtgtgtcatttaaggcatcaaagatccgaataatatcaatgccgttttcgaccgactttgtgacaaagtcggtgacaacatcatcggcgtaatttttatagccaagtaaattttggccgcgcagcagcatctggagcttggtatgcttcacaacttgacgaatcttgcgcagacgttcccacggatcttcgtttaagtaacggaggcaggcatcaaaggtggccccaccccacatttctaacgaatgatagccggcagcatccattttgcctaaaattggcagaatgtcgcttaacggcatccgcgtggcaatcagactctgctgaccgtcacgcaagacggtttccataaattggactttttgtttagccatgtgtggtccaaccctcctttatgattgcttcaaccacttgctgaacttcaggcagcccgtgacgacgtgatcgagcacaggccttggcatccccgccgcaaaccaggcaggcgcgcggcggcaagtcaagatcagcgcgcgaaatctggtggagctgcccgttttttaacgtcaccacgtccagatccagtaagtcgcaaaaacgctgttgctgctcaaaaccgaccatcagtcgcttcaaggtaatcggtgacagctgaactgctaaataagcttcggggccagttgccaaggtttcgatttggctttcctgcactgcttcacccagttgatcctctagcgcttgcatcgctgccgaaaagactgcgaccactcgctggccagtcttaaccggacctggaattcgcaaagtcacatgcaacaaaacggtttcgggatgagcggtcaaccattcacgttccttgacgatcctggcatctttagctgcgagcatttgtccgagatcaacttgtggaccgtctaaaactgacaacttaaacattgtggaccacatcgatcaaggtaccatcccgatattcgatcaacgcaacgaccttgtcaccatacttaatcggttcaggcgttccggtaatcttgtatgccatttctttaagcgcttcaatcgaaaattgtggcactttcaagtgtttgaacatctcgatcaagtccgtccgcgccgggttaatcgccacaccgacttcggtaaccacgacatcaacgctggcgcctggcgtcaccaccgtattgacactttcgacgatcgttggaatccggccccgaaccaatggcgcaatgaccatactcattttgcaggcagcacttgtatcactatgaccgcctgatgctccgcgaataatgccgtcagaaccggtaatgacattgacattaaagtcggtatcgatttccaatgctgataagatcgcaatatcaagctggttaatcaccgcgcctttgctcagtggcgatgcatacatattggcatcgatttcgtaatgatcggcgttttctccaagcgaaaccgctgaaggatggtcaaagtcttggacatcgatgatcttttcaacgagtccttctttcaggagttcaaccatggaattggtaatcccacctagtgcaaagcttgctttaatgtcttgcttcagcatcgcttcccgcaagaaacgggcaacggcaagtgatgagccgcctgtgccggtttggaaggagaaaccatttttaaagtaagccgacttggtaattacttctgcggcatattccgcaatttttaattctttaggattcttagtgaagcgggtcgcccctttggcaatgccggttgggtcaccaatagaatcaacctgaaccacatagtcaacgtcggtttgtggaatgctgatcggtgtattcgggtaaggaaccagactatcggtaatggcaacgacttgatcggcatacttggcatcaatcatggcataacctaaggaaccacaagttgcttttcctttagtgccattgatgttaccgtattcatcactgcttggtgcaccgaggaaagccacgtcaatgtgaatatcaccgcgtgcaattgcccgcgcccgaccaccatgggaccggatcacaaccggattttccatgataccgctggaaatcgcggcaccgactttgtcacgcaagccagaactggtgatgttggtgaccacgccattcttaatgtgttcgataagcggttcgtgcacgttggcaattgaacttggggcaatcgagagattcttaattcccattttggcaatttctgccatgaccatgttcatcacataatcgccttcgcgaaaatggtgatgaaatgaaatagtcatgccgtcttttaagccagtggccacaatggcatcgtgaatcgaagcaaccaatttactatgatcgggcttcaccggcttgatgtggcgcgcgtgttcatcgtaaggctgaatattggcaaactcgccaccataaaccccatactgatcggcgtatggcgccgggatctcacgattaagcttattcttgaccatcagtctacctccattcctgatgccttagcgagcgcaatcgtatattgagcccgttcgaccactggcttatcaaccatttgaccattgacagagacaacgccggcccctttagcttcggcttctttcaagccggcaacaatttcgcgggctttttgtacttcagccaacgccggagcaaagacactgttgatcactggaatttgccgcggattgatgactgatttaccgtcaaatccaagttgtttgattaactcggtttcatggcgcaaaccctcttcgttatcgacttgcgtgtaaaccgtatcaatagcagaaatgccggcttctctagctgcatgcagaatatagttacgggcaaaagacaattctgccccatcagcagaacggtgcgtgtgctggctggttagatagtcctcagcgccaagcgcaataccaatcattcgcgaagaagcctgcgcaatttcacgggcattcaaaacgccttctgcggattcaatcgcagccatcatatgcgtggtgccgacttcaatgccgtatttttcttcaactgccgtgatcacggcatcgacatcgcgaatatcttgcgcggtttccgtctttggtaaccggatcacattaatgccgccaagtaccatcgcttcgatatcctgatcgccaccagcatcgagtgcattgacccggacaactgtttcaacactgctatagtcaaaagttttcaaagctgagtacaccaacatccgggccgtatctttttcttttaatgaaacggcatcttcaagatcaaacatgatggcatccgcaccgtaaatgggggcatcgcgtaacattcccgggttagcccctgggacaaacatcatggttcttcttaatttatccatgcgttgatctcctcccagtcaaatgtcttgttatccgctgcacggtaggctgccgcaatggtccgtgctttgatggtacaatccaaagcacctttgtcgtttgcttctaccgcaaccccttcgatacccaattttgtcaaagttgctgcgatcacggcacggatctgctcgccaaactgcttttcaacactgctttgcagttggatcgtggtgccgctatcggcaggggccaacgtgatttggatatcacttgactctaatgtcccagccgttgcgggatgattaattttcatgagttgatcgctcctttatttctgtataaacctccggataaaccagttgttcgaccgtggcccagtcatggtgcttgatcgcggcacgaacacgggtggcgctgaccaccgaaccgccaatcgtcaaacgcggcaccacaattaattcaatgtcatcagcaaaagtcgctgccaattgctgattgtaaatcgccgtgaccggcgaaagcggttcttcgccaacatatcgccgggtgatgccaagaatcggggcaatgcgttgtttaaaaagtgccgcgtctagtccggcttgcgcggtcgcaatcgccgcatctgcccgatccttgagaaaataacttggaaacgtggtactggagaccatgtagtcctgtgtcggcaaaaccaccacgttggaccagcgtgccgccacctttttgactaaggccagacgctctgttgccgtgaacatcgatcgttcggctgataagacaaaaacgtaaacaactgcattattctttgctgcttgttcgattaaataggcgtggccgcgggtgaccggattcgcattcatcacaatggctgcaacaggctttcccgattggcgagattcttccagcagcttggtatagtcggcaaagttaggatagccccgttccaataaaaccactgaatcggtggccgccagctgtttaaatcccagtgactggaaaaacttcagcgtgctcggtttggtataaacaaagctatgcgtgatggcttcatcatccagccgatcgagcaaggcctgaataatttgcgccaacagattctcatgttgagctgtcggtgaaattgccacttctttgataatattgcccgacaatgaccccgtcgccagcaagtcgtctccttcaaaaatgccaactgtataatcgacttggcgatccggagtcaagccagcatcaaccagcaacgtctgccaggcttcagcggcctgcgggttcaaatcgaaccaaatgcgctttaacctcgccattttattttgccgcttttttggctggtgcaaatttaagcaatagtttggcgacaatgtagatgatgaataaaacaataaacacgccgcccatacctaccagcatcaattcaccagcctgttcaacagcagtcggatcaaatttcataacgcaaaacctcccaagggtgttcagacttctcaactgacaggtgcattgatgttaagcaccaaagaatgacagcaagagaccgccagcaataaccgaaccgatttgaccggaaacattggccccaacggcatacatcaatacaaagttctgcggatcttcatccgtcgccatcttctgaatgacccggcttgacatcggaaaggccgagatgcctgccgcaccgatcatcgggttaatcttttctttgcggaacagattcaatagcttagcgaaaagaacaccgccgacagaatccatgatgaaggcgaaaagcccaaacgcaatgatcatcaatgtttgaatattcaggaactgatctgcttgtaatttaaccgaaatcgtcaaccctaacaggatcgagacaatgttgaccagctcgttttgtgcggtgttggacaatcgatccaacacgccacattccctgagcaggttgccgaacatcaggaaacctactaatggcagggaaatcggagcaataaatccagcgatgatggtgatgataatcgggaacagaattttggttgtcttggaaaccccttctgcgcgataggtcatccggatgcgccgttcatgcttcgtcgtgactgctttgattgccatcggttgaatgattggcaccaacgccatgtacgaatacgccgcgaccgtaatggcccccagtaaattcggtgccagctggttagagacgaaaatggatgttgggccgtctgctgcaccaatgatcccgattgacgccgcctctttaatgttgaagccgaagaaaacggcaacgaagacggtggcgaaaataccgaactgagcggctgcgccgaaaagtaacataaatggattttgtaacaacgggccaaagtcaatcatggcgccgatcccaatgaaaatcagtaatgggaaaagttcggtgttgatgccggctttgaacaggacatccaacaccccttccgtcttagtgccgccaacaacctgggttaaaaccccggttccggggaagttcaccaaaatggcgcccaatcccatcggaaccaataatgttggttcgtattctttcttaatacccagatacatcaagagcgcaccgatcagcatcattgcaatttggcctagcgtaatggttgtgattccgtgaatgagcgcttccataccttcacttccctcctttttatttgttaaataatgctgatcagtccatcacccgagtttacattttgattcagcgttgcgatgatctcgccaacagtaccggctttgggtgccacaatttcgttttccattttcatggcttcgagaatcatcagtggttggttttcggtgacagcatcaccggttttaaccagaatcttggtaacggtgccaggcattggtgccgttacaacttcaccttcaccactcggggcagccggagcagcaggcgccggcgctggttcaggcgttggtgctgctggtgtcggggcacttgacgcagccggggcagcaggtgctgctggtgcggccggtgctgctggcgtaccgccgatttcttccatttcgaccagataggttttaccatcgatcgtgatcttgaattttctcaacatctttttcagtccacctttttcttaattgatttgaccacataatgcccatgaccatcacccgccgcaatcgcgctggcaatcaagccaacccgtttggcctcgggattttcaacatacaaatgtttaagcacgagtttggcatcaggcgcagcgtccgcagtaacggcagcagcgatcaaactggcagttaattcgttagttggatcaacttccagataattgggtacttcttcccattcatgcacctgagctgcttcatcagcattcaccgatttaaccggcgccgattcaactggcgtttgcggttgttttcgccgatgcaaccatttaaacattttcacaccccctaagcgtgagccggtgcgggtaaaagccgggagtaagtggcctttgacgtgttacgacggggtcccttacaggtaagcttctgcaccagcaaacgcgttaatgtaagcatgagccggcgttgttaaatgccgaatcaagcgttatcgtcatgcattttctggttctcatcaaccttataatacggggaaaagccaatcgcgattggcttttcggtgtctttttaaattggtgcttatttttgtggtagatagaatggcacatgaccgaagagcataacagttaccacgaagatggcgaaaacgcctaatgcatattttccagcttcgcgttgccacttacccatgtccaaaccggtgagccggagcaatagataaatgaaagcaactaacggtgaaagcaagtggaatgcttgccccattaatgaagctaaagccatctgcatattggtaaagccgtatgcgcgtcccgcagttgccagcaccggcataacaccgaagtagaagccgtcgttactcaagaagaaggtccctggtgcggaaatcaacgcaataaccaatccccagaagccagccatggaacttgggataatcgcggtgaaactcttggcaagtgcttcggccatcccggttccctggaataagcccatgaagaccccggcagcaaaaaccagaataacaacttgcacggcatcgccgccgttagcaccgattcgcttgctttggtcgcctaacttaggatagttagccatcaatgcaatacaggtaccaaccaagaagagcaacagcggcggcatcgcaatcgccttgataaaggaacttgccaccagccaagcaatcagcacaatggtcaaaatgccgttaaaggcaaacatattcggacggcgaatttcggaaacttcaggatcaaccactgacgtcatctcatcgatttcttcatcggttaattcccgaacacccaagcgtttccgttctgcgcgacccatgtgcggtgcaacgtagaaaacaacataagccaaggccagaatcatacctggcaataaatacgtcaaaatgtcggcatcaaccttcaaaacggccatggcccgggcagttggcccgccccaaggcaacaggttcatgatggtattttgcaaaataattaaaacaccgagattcatcatattcatgttgagcttcttatagattggaataaatgccgagcagcagatcaaagtcgtcgtggtgccatccccgttaagtgaaactgccatcgcaacaatcgcggttgccatcagcactttcatcgggtcgcctttcgcgatcttgatcatccgggctgtaatcggatcgaacagaccggcgtcgagcataatggaaaaatacagaatagcgaataagagcatgatccctgtgttagcggtcgttgtcagacccttcaacacaaaatcgccgatcgtccctttcttcgccacgcctgccaccatcgcaataattgcaaacagcagcgggatcatcactaaagaagtgaatggtgaaagcttcttggtcatgatgacgtacatgaaaacaataatcatggcgtaagcaatgacggtgagtaacatagtcccaacctcttttcataagtttttgtcgctatccacatgatacgtgatttctgtcacgaaaaggccgattttgcgtctttagaacaccaaaagaacaattgtacggttaagggaaaactaaaattttcaagaaacagaaaacgccttcattggcttaaaattcggttttaagtcaacggaggcatttttaaatgatacgattgtaacgattgaaaaagaacacttttcaattgatacttatttcacaatagactaacacagagacgtttttctgtgttagtctaccaatcctgaaagcgttcgtcttccaactttttcaacagttggtgaaagttttcccgtgacggagcgtggtccaatgtttcttgctgcaactcattaaaccgctctgctaagtaataagcagtgagataaagcgttagttttcgtttgacaatggcttccggatctttgtcgtccggtacttggtgtgaccccacaacaagattggcgaactgtttcggatttaaccgtaaatcatcaggtgcatcagccttcatgatagaacctccttttttaagtatgcctaatactaacataaaaaaacgaacgtttccgaccaaaagcgggcgttcgtcacgatgttggggatgttgttcgggttaaaaatgccgggggaactgcatgcaccaaccaaacctgacttcctgtcggataaaaaatttcaccggcagctgctgccgattgcgcggccacgcgataaataaccggatgagggtcatgccgcacgccaacttgccaagccattttcggattctcggaaagatggacaaaatcgcggtccattggcttgagtccttcaatgtcaatcaatgcggctgcttgatgggatgtgccatgatataaccagattggcggacgccgcgccggcattaacggcaagaccgggacgctatggccgtacaccgctctgatggtgcttccctcaatcgcaaaccgctgcttatcgctttgtgtcataatgtcatcaagcacctggcgatcaaggtgcatctgataatgcgcattgaatcgccgaatcaacgtttccagattcgtgcggccatagcgatccaatatgataccgattttttccggatggtgccgcaagatcaggcttaatgttttactgattctgacgagtcgcttacccattaatgaccacctcgtttttcaaattgacaaagcaaagaaggcatgacattgaaattgcatttttctacagcgaacttaaccgatcttgacgccattatgcgaatcgaacaggcgggcttcacaccccaggaggctgccagtcgttccagcatggcggctcgcatcattcattatcctgacacgtttattgtagcgcggactgatcaaaaaattgcgggctatattgttggaccagccatttcacagtcaaccattaccgatgatttatttgtcaccagccagccaaattcgccagctgcaccgtatattgcgattctgagtcttgcggttgcgcctgctctgcaacatcacggcattggccgccaactcttagccaaaatgagcgatgtcgcgcgcaagcaaaaccgcatcgccattaccttaacctgccttcagcgccttatccccttctacgagcacgccggcttccacaatgatggacaggcagcctccactcacgcaggcgaagtttggtttaacatgacaaaagttgtaacaccagtaagtgactcataagataagagtgatgtcttatgttccattaaaattaagaatatttattttctttcaaattaaaatatgggaaccttggccggcgatcttcgtcggctattttgctttacacactagtcgtttcggtttaaactactagtgtgcaaaacatattaggcgaaaggatgatactgatggcgagagacgacaacagccagatgctaaaaggcattttacaagggtgcctgctcatcttgctcgcccgcaaagaacaatacggctatgccatcagcgaatcgcttaatcttttcggcttcgaaaatgttcctaaagggacgatctatcccctgctaatgacaatggaaaagaagggcctcttgaccagtcatatgcgcccatccccggacggaccaagtcgcaagtattatgcgatcacggcagatggcgaaaaagccaggcaaacattcatcttgcagtggcatgatctcaaaagtcacgttgatcaaatcattgcgaaccaacccagacttgtggtctgaagtcaagggagtgattcaaattatctagacttgtttcatttttcagagggtatacttcccccagcccagggattt

SEQ ID NO: 318 - DNA, 90170 bp, Lactobacillus casei
aatccaatgaacaactagagaatatcacgcaacatccaagtacggagctatccaagaacttggttgtaatttaaatatacgaggagggattagccatgaacaagcgcacggaagctgtcaataaaatagcagctgagaacaatcaattacgtaaacaactgacaaaagccaaccgcgactactacgaagatttgctggtttacatgcggggcaaaaacttgttccgggacgactatcaacttgaagaaagtttgctaggtattctccaagacctcattgacgcgcaaaatgatggaacggatgcaatgacttattttggtcatgaccccaaacagacggcaactgaattactaaagacaatccccctgcgtatcggcaattttatctggtttaacttaaaattggcagcaatgatgatgtttattttgtggctgccgcgtctgacctatccaaacgtaaccttcgatgccggaagtttgttgctggcttccggcatcgcgattgtcagtgcgtggggtgcgctttggtacgtcggcagccacgcttttgccaagccatcccgtcttcaactaaccgcaattattattctcggtgcgatactgtttggcatcatggtcagtgtcttgctatttctcaaaaccagctggcaaatccgcctttctgctcatacttcgttcaccgtcattatttcagggttgatcattgcggcagttttgccgtttatccatcacctcactgaacttgagcgcccgatttactacttcagcttgtttatactcattctcggtttgcttgtctatttgcgagccacacgttcctttttcagaaccaagatcgactttggaaagtggcaatggttgttttatgtcttcataatcctcttgggagtcggcatcggcgtgttaatctggtggctgggagaacgacggcatcgtcattaaaaagcctgtcgtcaccacaaagtccttaacggtaagttatcttttccaactaaaagtacatctccaccacaatattcagctacaatagatggcatacgcattgattgaaggagtgaccttcttgacccaaaacgaaaccattcgtcgtcagctccatcaccgctctatccggcaatttaaacctgagcacctcagccatcagacgattcagacgctgctggatgttgcccagcacaccgcaagttccatgtatttacagcttttttcggtcatccatattcttgatccgaaaatccgggccaaaattgcggcgatgagtacgcaaacttacctgaacggcccgggtgaactgtttattttcattgccgacttgcaccgcgtcgccgacttaaccaaggcggcacagcaaccccttgaccgcctcggccggatggataagttcttgcaggcaagtgccgatgccaccttggcgctgcagaacatggttgtggcagctgaaagtctcggcttgggcacggtcacattaggcagtattcaaaacgacgcgcaagccttgatcgatttgctgcatttgcctaagtatacgttcccgttattagggctcgcaatcgggttcccggatgagcatcctgatgaaaagccacgtatgcccgaatcactggttgcgttcacgaatcactacggcgaaccggcaccggctgccgatgcaatggctgcttataatcgaacggtccacgattattatgcgacccgtcacggcaatccacgtgaagaaacttacactgatctggcggtcagcgcagccacgcacacgccagccaaacgtgatgacctattcaaggtgatgcggcgtcagggcttcttcccggaaagttgaaaattgctttttgcataaaagttttaaaatgcgcacaaattaccgacacgtcggctgcttgatgaaatgatcaggcggtcgacttttttgccgcgactttaaaagacgtcggttccataatttgatggcttccacccttcatagttggttcagcatgacgctttagactgcgcctatcgaagttcattgaccaatcagtcaatttcctattgacccgtcagtcaatcacaactatacttcaggcgaaaaggaaaatacgacggaaatatgagccgcaattccacctttcacgcagaatgccagcatcttttaaaaagatcgcattcataggaggctaccatggcaaccaatgtcatcgaattagatcacgttcaaaaaaagttcggcaagtttgaggcgttgaagaatgtcagcttcacgttgagctcaggacaggtactcggcttcttagggcctaatggtgcaggcaaatcgacgacaattcgcatcattttaggcatgttaaagaaaaccgccggcagcgtcaccgtatttggtcacgatgcctggcgtgatgatgccgtcattcatccccggatcgcttacattcccggcgatgtttatttatggccgaatctatccggcggcgaaattatcgatttgctgcttaggttaaacggccgcgaccataaccagaaaaccgatgacttaatgcagcgattcaaatttgatccaaccaaaaaagcccgcacctactccaaaggtaatcgccaaaaagtcgtgctgattgccgctttgtcgcaagatgcggacctgtatatttttgacgaaccgacttccggccttgacccacttaatgagcagacttttcaacaggaagtccttaaacttaagcaggcaggtaaaagtgttttgctatcgagtcatattttgtcagaagtggagcggatgtgcgattcgatcgtgattatccgtgacggcagtgtgattgaaagcggcaatttagaccagatgcagcacttggcgcggctaaaagtcgaagtcacgacaacaacagccaatgatgatttagctcgggttgctggtgttcacgacctgacatttgcagcggccgaccacaccaaagcggtcttcaccgccgatcgcgatgagttgagtcgcattatgcagaccttagcgaccacctcgatcctagacttgcgggtctcaccgccaacgttagaggatctgtttatgcgctattacggaaagccaggtgagccccatgcggcggaataatcggcatgctggctatcttttaaaagccaacctcaaacaaaatctcaaattttcggttgtctggctagtcattctcatcatgatgattctcagcggtgccgtgaaattagaagcagccttcgtcaacggggcctccggttcaaaagacattgtcaaaatgctgcaggcaccggggatggccgcgatgtttggcgcaacgcctaaggttatcacttacaacgctgccatcatttttgccagtgtaatggtcgtttccatgatcattttgcaagccttgtgggtcatgccgctgatgattcgcgacacccgtggacaggaagaaagcggcttgttggaaatggtccgggcgcgcgatgtcgggcgcccggcggatgtcgtcgctgccatttgggagctgctactggtcagctttgtgctggcggccgcctacttcgcctcgctgctcgctgtcaacatggacgggactgacatgaccggcgatttgttgttcgccattgccatgctgatcgccaatttggttttcggcagcatggctttgctgttcgcgcagttagccaacaatacccgcaccgccagcatgttaagttatatggtcttagccgccgcctatctcattcggctcgtcaccgatcttaaccaccaacaactcacctggctttccccaatcggctggtttgaaaaggtcgacttttatacgaaaaatcaactcatgccgctgtatctcggccttgcttgcagcatcctgctttgtggtgccgccattgctattgcccaaaatcgtgatctcggcgccggtgtactggcggaaggaaaaggtcgcgccaccgcagcgccgtggttacgatcgatgccggctttgatctggcgtaccgaacgcggtctgctgtccgggtggctgattggtgcggttattttcggcggcgtcatgggcagtgttctgggcggcgttggcgatattcttaaaaccaacccgatttatcgccagctcttagacgtcaagcaaattcacgccgccaatcaaaccatggtactttcgtttctggcgatgtatatggccatttttgtcgctttggccgtcaccgcggggggtcagattgcctttcgccttaagcacgacgaccggctgggctatcttggcatcattcacgcggaaaagccaacgcgaaccacgatcagtaccagttacaactgctgggccttactcgtgggcatttcggtgttttctgtcgggttgctcgccttatttttgacgggcaatgcggtcctagaccaaccgctaccggtaaagtatctcgggcgactcttcatcggtggtctgcctgcagtcctggcatttatcacgttaggcattgcgctagccggtttgtggccaaaactaagcagtctcttctggctttatatgggcgccgggctgatcgtacaggtctttcatgggttgttttcactgcctaagcacgctggcgattttactccttttggctggattgctgatgttccgatcaaggctttgggccaatcgtggcttgccatcatgcttgtcagtgccgtgatcctcttcatcatcggcgttgtcggatatcgtcgacaggatctgagcgtatgaaaaaagtcgtcaccgacccgcaaaaagtaacccgaattttacaagcagcaactgacgccttcggacaattaggctttgcaaaaaccaaaaccgaccaaattgctgcaactgccggcgtctcaaagggcttgatttttcattattttggcaataaacaagccttatacctcgacacctttaaaaccgcttatcagcggatctatgcccatatggatccgcaccactggcaagacgctccgggtttagccgccatgatgtcagcagcagtgaaatatgagatgaaactccaattggccttcccagctgagtaccgcctcatgatgcaggcctacgcagatttaccgcattttccccaacccttgcagcaacaaatccaacaggaaacccaagccatttccgtggaagccaatcgaatatttcgcgaaaaaatcgaacaattacctcgccgacaagggatttccgttgatgacattttcagtgtggtttctgcactcattgcccaacaaactgcggtcacaacacagctaatcgccactggcaagtaccgcaactttgaagacctgcaggcggtggtggatcagatgaatcgccagttgaagatcgtcgagcatggctttttgccagactaactgcttgtttaatgaaaaaaactcagacaacgcctcgcaatagattttggggtcagttgtctgagtctttttaacctgtcatcaagcttttgctttcgtcagtttaaacaaacgcacgtaaaagccgaagttgaccaagccgatcaagagtagtagtgcaaaagctaattgactgccaatgccgacgttctgggcatgggtcagaccgggcaccgtgaccgcggtcatcatcccggccaagacggtggtgccgatcgatccggtgacttgttggccggtgctgtataaagcgttggcgtcgctttgatactggtgggccatgaccttcaagccgtaagccgtgctgttgccaaatgccatcgaccgaccaatggcgaagatcaaatacaggatcgtcacgcctaatacaccgatatggcgaccccaaatcgtaaagcccagcatcccgaccgtaaacaggctgttacccagcaaaagcggcaaccgcccaccaaaatgatccagcatccagccataaaccggctgaccaaggccattaaagacactgcctggtagcaaaatcaacccgccgacaaacgcactggcaccatctacagtctgtacataattcggcagcaaaaaattaatccccacattggaaaactgcatcaaaatatacggcaaaaagctgtacaaaaagccgccatcatggaaaacatccagcttaaacaatgctttggcatgatgcttggacaaccataaaaaagcgcccatcgccacaagcacgacagcaccggccacacctgcgataagccaggtatgctcgctgataccgtttaaagcgagcgtcaaactaatcaaagcaacacccagtgtcgcaaaccgcagccagtcaaatgcaaacgcagaagtcggcgtatattgcttaatacgcccttgccccaatacgagcagcaaagtcgcaaacggcaaggtgctccaaaaaatcatccgccaatcaaaaaagttggcgatggccccgccaaaagtcggtcccaaggctggtccgatgagaatgatgagattcgcgatgcccatatatgtacccagtttgctagtgggcaccgtgtccaaaataatgttgaccatcaatggcccacacaagccaacacagcctgcctgaaccagccgcccaagcaacaacacccagaacaccggggctaaggcacacatcagatcgccgatgatgaaaagtagcgccgccgtaataaaaagctggcgattggtaaagcgccgtttcatgtatgcagagctaagcatcacgagtgctgccgccaaaagataccctgacgtcacccactgcacagttgtcaaagaaacatgaaagtcatgcattaacgtcggaaacgtgacattcatggatgtttccgttaaaaccccgaaaaacgacataagcgccacaatggtgatgacaaacaaggcatgacgcgcgttcttttccttttgctcgatggttgtttttgccatgatcggcctccctttatcttccatgataagccgggccattttcagtaacaatattgaaatttaaataattccgtgaaaaccagaattttggctagcactttttctgaaagtcagcgcaaaagtgcgctaatatggaatcaattaataaaaattattttatcaagcatgcttagcgaaacatgctgtgcggatacccggcaatcaccgggcatcccacttggaggaaatttcatgacaatcgttttgattctcctcggctttttggtcggggcttttattatgacaatgggcggcggcggtggcgctttctacctcggcattatgaccggtgtcgcacatttgtcgccaagtacggctgccgcaacctcactttttaccgccattccggcactggcggtaggctgttacagtcactatcgcaccggcaatatgcgatttcacgccggcaataagattctactcaccgctgttcccgccacaattgtcggcagtttggcagcgccttacattcctgaactgatttattcatgggccatcgccatcatttttgtcgtgctcggcgtgcagatgctgcgccagtcctttgcccgtcacgccaaaaagaccggccagcccacctggttcgcctatgtgctaggcatcattagcggcttaatggtgggcattgccggcttaagcggcggtggaccgattatggccgggttgatgctaatgggtttggatatgccccacgcggcagccacctcctcttatgcgttggttgcattgtctatcattggctgccttctgcacgcgacccaaggcacaattgcctggacggtgggcggcttgctaatgctcggatcgctggtaggcgccgccattactccacgcatcctcaaccgtttcgatccgcggttactcaccgccatcttgcgcccggttctcggtgttttactgatcgtaatggctgtcaatcaggtgtggtaaccacattgcggcaacttaaccagcagttaaaaattttgccacgaacttgaaagcgcctccattgtttttgctgacgcctctctgcataatgaacctaaagatcattaaaaaatgaggggtgaacatcatgcaactgagccaaataatccgtaataagcggctagccgccgggttaacgcaagaagaactcgcgcaaaaagtaggtgtctccgcgcctgctgtcagcaaatgggaaaaaggcacatcttatcctgacattaccttgttacctgtgttggcgcgtaacctcggcacggacatcaacacattgttggacttttcttctgacttagatccagtggctctccaggactttaacgccaagctaaccatgacagcacaaaaagatggttggcaagccgccgttgcgctgattgatcaagagttgcgcgactatccatcagtttcacaattacagatgatggcggcaccttttcttgacatgctgaagccccagattcccaaagacgactggcctcctgtacaacaacggattattaagttgtacaaggcggctgagcaaagctccgatttgcaacaggcacaacttgctgcactgggtcttttcaatttttatctcagtgaagagcaattcgacgcggcggaaaagcaacttgctgcgttacctaccgaaacagtgactgcttgggctttaaaacctaaactgcagttaaagcgtggtcaattggctgaagcctatgttgagggcgagaaactgttggctaacgattatggtgctctggggcaagtactcagcttgttaagtcaggtggctatcgctgaccaccagctggcaacagctgaggaatatgtgacgcttgcaaaggcgttggaccaagcgattcacgtgaacagtccgttcgtttttggtgacgaattgcaactcgccaaggcgactaaggatatcaaacgcgcagtggcagttatccggcaatatgctgacaatttgggtcaacccttcccaaaggtttttcagcatctgccccaaccaaaaccgcgagaatcgctagctgcggcacgcaagcaattcgttcaggacattgcgcttgatccggacctagcatttttacaagatacccctgaatataacgaattgcttaagcagtacgtcgattaacgccttttgtttgaatgttttagcatgcgattcacgtgccacctaaaaagcatcgtccgcaatcttgtgtggacgatgcttttctacgttttacgaattaatgaaccggaccattcaaaaacaatatcgatctgcccagctttaaaaagtcgaaagatgacactaatccaactgcatatataaaagtggatatgggttaccttgttcgtcataatcggttcggttataaacttgaaacccaagatgttcataaaatccttttgcttggggattctgctcgttgaccgccaatctcttgatgccatcgttttctattccgaattgtacaagccgctttcccagaccttctcctctttttgcagacgccacaaataacatttcgagcatttcattctctgtacccataaatgctactggaacaccatcttcctctgcgatgatgagatgcgcaacctgacgcaatgcttgtggaacatattcttcaatgcttttcaattcttcatcagataagaatgaatgtgtcgccctgacggattgtctccatactgctaaaagttgctgaattaacacaggttgcctgtctttgacttcaattatcttcatgtaccaccaattccttctcaacaaataccgaccagaatcgcttatggatcggtaatcttacccgtgctcaaaaactcatacagataccggttgaccaacggattgtgctcatgcaacttgctgtgttgcgccttgctgttggtaatttcccgctcggagtagcttttggcccggcctgccacaatataccgcagtgagcgagcggaattgacggggacgcggccatcggatcctttgcccagattgccaaatagattcaaaactgccgctgtcttgggaaaattgcgccgattttcatacatcggcttataacggtcagacatcacgctagggcggccatcgctcgccaacttgatgtcttgtccgctgttcatccccggcataccgggaaaaccgttgaacggaccggcaatggtgatgagccgttgcaacgttggttcgccttttttgtctttggtgactgcccaatcggcccaagccgcggaaccggcagaatggccaacagcattaaagtcttgaatgccgtaacgttttttcaactgcttaagaatcttggtcagcgtggccgcatctggccgcccgctactgaacacaacggcaatcagcggatgacgaacgctcggcgaccacgaaccgctcacactaagctggccggtattcgtcacggtgtaacgcaaaacctgacgataaccgggatgcttgctaaggtcattgatcatatctttttccgagccataaccgccaccaaaaccgtgaacaaacaatgtcggtgtttgatatgtcccggcaacgcgtttggtcgaaggcgcttcgccgcggttcacccaccaccacgcgccgccactcacaaccagaaagatgccgatgatgagcatcactttgccccattttttcgtcatccctcgcctcactttctcgtgctggttcttgccttgcattgtaccacgcagcggcgattttggaacttagaagccactctcgccgttaaaatactggctattgatacttggcaaacaagaggattattgatacactgtgttagatagctaatacactaataaggaggcacaccgtggaatttgacgataaagttccgatctacttgcaaatcaagcagtacctttaccaagccattatcacggatcggctcaagtccggtgcgcaattgccggctgttcggcaactggctgccgagctaacagtgaatgtcaacacggttcaacgcgcattaagtgaactgattcaagaaggcgtgctcgtcacccgccgcggccgcggtaattttgtgaccgacgacattaaggtcttgattgagttgaaaaatcgcgtcatcgccaccgaactcggcaccttgtatcgccaactggctgacctgaatcttagcgccgcggaaatgaaagacgcttttgcccaatatgttgatgaacaggaggctcaccatgaccacgaataagatttccgcagaacacctaacctataaacgcaatcgtcaactcattctggatgatctcaatcttgaggtccagcaaggtcatttcatcgggttactgggcgcaaacggtgctggaaaaaccacgttgatgcgacttttaaacggcgtcgcaaccaattttaccggcaccatccaaatcggcgcctcggaaagcattgtcgaccgcaagcaactcagcagctttagcgaatcgcttaaaggcgtcaacgcccaccgcacgttgcaccaaatcgccaccgattacgccatcatgtatctcgacttttcggaaaaggcgtttgaaaatttcaccaataagtacgaattggactgtcaccaaaaattaagtgcactctccaaaggtaatcggaaaaaatttgcgaccgccctcaccttgtcccgccaaacccaactctatttacttgatgaaccatttgaaggcattgacagcatgacgcgcaaacgccttatcagtaacatgatcgcttggaagcctgctgcggccacggtgatgatctcggatcaccatgtcaacgatgtcgtgaacattctcgacgaaattgttgtgttaaaagacaagcacgttgtcgcgcatcggaatacggaacaactccgcgaagaaaccggcatgagtgtcgaggcttactatgaaagtctctatgaagggagcaccacaaatgactaatacttggaccatgacaaaagtcttgattcgacagcgaattcaaaccgtggtcaacacattggtcgtcacgatcgttgcaaccatcatcacggcgattttaatgtattttggcggtagtgcccgcttctccatcgaacttttctactatgcgtttcaaccatacttaattattggcggactttacttatttattcgactcgccatcaggcaggaacatacctgggtcgataattattaccggtctgtgccgattaccaacctaaaactctatttggccaaccttttcagcaccatctgcaactttgttatttactgtctggcccagagtctaattttcaccatcctgcaagtggccagtcatggcattcactggccagagacgtctgtctggatggatgtcgcggaaggcgtgatcattcttggcttaacctgcctattcatttggacatttgtcagtctggtccacctgctctccgtcaccatcatggccttcttacccgaaacccagattcgtctcgcacagtgggccatttatctagtcgtgatcatcacggcctcttacttgttcaaccagctatggcagctattcttaatgccttttagcaactacaacataaccgccattctcggcgttttcctagtgatcttcgccctcatttccagccttaacgtctacctgttggacaaatgggttgagactaagtaggtcgggtattggcatatgccatcgttctgcgctaaaagcttttatgagtattcacataataaaaatggactttcaagcggcatcagctgtcacttggaagtccatttttgtgataacccgtaaaagatcttaagcctaaagcgccaacacccagtggtctggtgccgcctcggttaaggccgcaccagccggaatcggtgtgcgatcaaaatgaacacgtggcttttgctgctcaaacagcggatctgcttgtggcaccgaagcgagtagcgtctgcgtatacggatgcaacggatgacggtaaacggcttcggtagcaccggtttccacaatttgcccttgatacataacgacgatctggtcgctgatgtagtgcaccatggacaggtcatgggcaatgaaaagatacgttagatgctgggcttgctgaatctgccgcaacaggttcacaatttgcgcttggattgacacatccaaggcagaaatgggttcatccaataccagaaattttggttcaaccgccaatgcccgggcaatgccgatacgctgccgctgaccaccggaaaattcatgcggaaaccgattaatcgcatccggcggcaaaccgacttgctccagcaactgcaaaacccgatcaagccgctcctgtgttgatgatgccaaatgaaaattatcaatgccttccgcgataatatcggccactttttggcgcggattcaacgatgcaaatggatcctgaaacaccatctgaacctggcgccgaaattgcttgcgttcagcatgcgaaaaatgttgaatcgactcacctgaaaacagtacatccccgcctgaaatcggtccgatgccggcaatcgcacggccagtggtcgtttttcccgaacctgactcgcccaccaagccaacggtggtgccggaagcaattgtaaaattgatgtgattcactgctttgatgagccgctgatctttccggaagttgacgcttagatcttgaatggcaaataacggttctgtcaaaaataaccatctccatttgtaaaaggctttgaattaggcctgattcaccgcgaccgccaacgacggctccttggtgagttcggcaaaccgcgcccaccgtttttgaatcgtgaccggcggctgataactcggcgttcgcggatcaagcagccaggaacggacaaaatgggtaggtgacacctgaaacagcggtggcatttccttgaaatcaattgccagcgcatagggattgcggggtgcaaatgggtcgcctttgattggcttccgtaaatccggcggtgtccccggtaaggtaaatagctccttacgctgatcgtccgaacttggcaccgcatccagcaagccccaagtatacgggtgctgcggattataaaaaatttcatttgccgtgccagtttcgacaattttaccggcgtacataatggctacccgatcggcaatatttgccaccacacctaaatcgtgggtgatgaagatcacgcttaaatcgcgcttggccttctgtcgcttgatcaagtccagcacttgcgcctgcagggtcacgtccaaagcagtggttggttcatcggcaatcagaaccttgggctgcatgatcatcgccatggcaatcatggcacgttgtcgctgaccgcccgacagttcatgcgggtacttgcgcgctatcaaggccggatcaggcaagccgacatcttgaatcgccgcgttgaccgcctgttttaaaacggccccgtgcaggtgtcggtgcgccttaaccccttcgccaatttgccggccgatacgcatggttgggttcagcccactcagcgaatcctgaaaaatcaacccaagctcctgtccgcgcaatcgcgtataagccttcttactggcgtgcagcagatcggtttcaccatattgcatggcatcagccttgacctctgcatctttgccaagtaaacccagtagcgcatgcgtggtcactgatttacccgaaccggactcgccaaccaatgcgagcgtctcgccttgatgcagcgttaaatccaccccattgacggcatagacattttcgttggcctcatgaaacgtcacggttaagtttttaattgaaacaatatcagtcatgctgcgcccctttcaaaattcatttttaatacagaagtaaatcaatcacggtgccgccaataagattcacggcgacccaaatgcctaattgcaagttgccaggcaacgcccggagcatcttgctggttaagttagcatgcgggcggcgggtgtgcagcagcaatttaatccccacggcaaggatcgccaaacccaccagcagccaaaacgtctggtgtagcccccacaatatggccagggtcaggccttcgcgcgttaacgacagaccagtggtgacgaccagcaagccaatgaaaagcgcagcgccgacctgccaaggatgtttttggatcattttgacacttccttaaaaaggttgtgctgactaccaatgcagcggcttttgggtgaagcctgcaaacaagcttctcgctgctggcagtcagttgagttaaccttgaaattttggatcaagggcatcgcgcaagccgtcacctacgatattaaacgcaaagacgatcgcgactaaaaccatgatcggaatgtaaagttgcaggggatgttgaagcatctgatcctgaccactggcaatcaggatgccaaggctcgtgttcggagcctgaatccccagtcccagaaaactaaggctggcttcaccaaagatgttgccggggatgctttggccaatatccagaatcagaatactcatcatattcggtaccagatgccgcgtcataatccgccacaccggcgtatccagcatcacggcagccgtcacataatcgagttgccgcaattgcatcaccagtccccgcgcctgccgcgccgcatctgaccaactggtgagcgcaagtgcaaacaacatcgtccacataccattgcctaaaacgaccatgatcagcatggtgatcaacagccccggaagcgaattaaacacttcaataatccgcatcatgatttcatcgacccagccaccaaaaaacgccatgaccatgccataaattgtcccaaaaccaattgccagaacggtactgagaatcgccaccaagagcgaaacctgaatgccgatgcaggtgcgcgtaaataaatcccgccccaagcgatcagtgccaaaccaatgagccgcactcggccccacatttcgcgcattgactcgaatcaaattggggtcatagtgctgaagttgcgggccaattaaggccactaacacgatgagaatcaaaataataccccacgcgactgctaagtggtcttttaacaatttctgccgcgctgatgcccagaaactgatacttttgggtgcattcgcctcatccaccgagatggttggttgtttcgtcagcacagttggcataccggcgttgtcggttccttgaacaaaatgaaaatccgtatcactgacagccattcgcctgactcccttcagttgtcatataacttaatccgcggatcaaccacggtatacagcagatcggtgatgaacatcgtgacaatgtacaaaatcgccagcaacaccgtttcgcccataataatcggcacatcacgattcgtcagcgccgtcacaaaatactgcccgatgccgggaatcacaaaaatgctttcaatgaaaattgatccggtgatgccaaaagccaacgtcactggcaacgaggtaataatcggaatgaacgcatttcgcacaatatggtgcaacacgatttgcggttccgataatcccttggcgcgcgccgtcatgacatactcgcttgaggccacatccaccattgaatttttcaacaatcgcgcgtaaccggcaatgtagccgaccccgccggcaatcgtcggcaaaatggtgtaaatccagccgccccaccagagttgatcgccactgggccacccgataatcgggaaccagccgagtttgccgccaaaataactttgcagtaacagtcccagcaccagactcggaaacgacatcaaaaacagtgccagaattgtcaccacccgatcaatccaggtgtttttatacacagccgccagaatccccagcagtagccccagcggaatgcctagtagcatttgctggatacctagacgcgccgatgccggcagacgatcgcggatcaagttcgacatggtcacagacggatcggcaattgactcgccaaactgtccatgcaacatgttgttcatggtaatcacataccgttccatcacaggtttattgaggcctgtgttcttgtaaacctgggcgcgggtcgccgctggtaatttatcggtttgggcactcagcgcatcaccaggcaccgccgaaatcaggaaaaaagttgccgtggcaattaggaacgtcgatattaacagttcgataaaacgtcgaacgatcagcttgatcacggttgcagccaccttcttcttgaatcaaaatgagtcattttgccatctcctattgaccttatgtacattggccgtgtttatggccaatgtggctagctagctattcttttgacgcataagtgtagttgaacgtggcgccaaagacggttgattgaaggtttttaactgacttgttgatataaatacgtgattccgaattggttaacggcacgacgccgaaatccttggcaaccagttgtgtctccagttgcttataaagggccagccgttctttcgtacttaaattggcatttaacttggcgtcgagatcgtcaaacgtcttgctgttatacccgccgaagaattgctggaagccgttatttgaatcccacaggctcaaatacgaattcggatcggcgcttcctgaccagccattgtcaagcaaatcatactgattatcatttctggacttcacaaagctaggtacatcgggggcagttttgatcgtgactttgacgcctaactgttgatcaagctcttgtttcagccaagtaccggtgtcatcatcatcgacagtcaggtaaacaaaattcagtttactgagatccgttgacttacccagttccttcaagccctctttcaacaaggcctgacgcttagccttggtgttgtactgtgcctgtaaatctttcagtggattaccgacatactcaccgtagtttgttgatccaacgttcaccgattgcggcaccatggtataggttggctggtctttgccgtcattgaccgccttgttgtaactttggcgattaatcgaaagtgagactgcttcacgcaccttcgtatttttgaaaagtccctgcgtcccaccattgtgttgattcatgattaaaacggtcgtcccagaaccatcttgttttcgcgagaccagtttgttacttttagccaatttgttgaagtcactgatctgttttccggaagcagacaaggcgtccaactggccactttgcattaacgaaagcacagtcgacggcttgtttgtcgtggtgtaggtgatggtttgcagcttcacctttttggcattccaataagtgttgttcttcttcagcgtgatcttgtcattctttttccaagatgtcagcttgaatgggccgttaaagacctgatccttcacatccgttttccactttttattgccaaccttattaattttgtcgaggcggacagggtaataagtgacagatgcaaagtcggacaaaagagacgggtaagcataagcgagctgaacctggagcgtcttggcattcaaggctttcacacctaagtcctcagcactgcctttaccagtgttgtatgcttcagcacccttgatgaaataagcattcgtcgcctgcgaaaaggcattctcctttttcaaaagccggcggaatgaatccacatattgttgggcggtgactttcttgccgtctgaccatttggcatcgcgcagcttgaatgtatacgttaagccatcagctgacttggtgtaggatttggccccagttaaaacgactttatctttgccgtttttcgattcaatcgtggtcaagccttcttgaacttctgaaagaatatcgttctcgttagtattgcgcatatcattcacatctaacgtcgtcggatcaagctcttcggttaaattcaacgtctgagcgctgcttgatgatgcagaacctttactgccgcaaccgacaagtaaggtcgccagcgcaacgccggtaataagagctgtgagccaatgggacttcttcatacatgccatctcctaaagtaaaataaaaactggcggtgcatctaggattctagatacaccgccagttttgtccttcgttcaagtcacgtttgtccgtcacccaagccgatatccagccatgtaaatagaaccgctatattgttcatagcagcagcacatggacatgaacatgacttggttgaactgggtcatcacattgactcctctcgaagaaattagcattagcatacttttaaaaatattattcgtcaacgggtaatttcttaaaacctgattggcacttggtgatttcatggcgtgatgccgcgtggctacggggttttagcttactcacagaattttaattttggttaactgccgttgtgattgagtggttgttaagaaaataatggcaatggcttcgggaatggcttgaccgtggcagcaaagtgaagaagaaaaagaaacgccataatatagtttcaattaaaacagtcgtctctaaactagatcgatatccggctttcattcaagtttgctgcgtaactcatatctgcatttcctggtattaaccatttgtttacggttaaatgggcaaaacatactgcgcgcatatgattcatttgaaactattttaaattttgcaatcacaaaaacagccaaccgggacgacttactttcccagccgactgttttcagtttaaccagacacgcacgttatgcttctgcgcggtgatgcatcaatacccacagaagtgcagcgccggcgccgataaacagcaacgccgataccccgttggctgcggacaacatggcaaatgccatcgttgcaaagaggccgccaatcgaaaggccaatcccccatttttgaatcggtgtcaggctggcaaatgaagcgcggaaccccagtgctaacaagagcgatccgacaaatgagatcaggccaaagataatgtgccctaaaatcaaccagttaaacatcttattccccctttctgataagcaattcgctacgttcagaaattggtgtcaatggcctcaagttcggcgaccgttcatccagtcacagtgcccgaaaccaacacccaagtctttgcgcagggaatcgcgtcaatacgcttttactatacgtgagatagtagcggttgccaactattttggcttagcgagactttcttcgtttaagcggccattttctaggcgcaaggcccgatcccaaaaccgcgtgatatccagtcgatgggaaataaccatcatggcaattggtaatgactttaagccttgactcagtgcttttgccgacgcggcatctaagttggcaaacggttcgtctagcaataacatcgcccgttttgcgacaagcgcccgcgccaagccgatcttttgcaattcacctgccgacacattggctttcgcctggccgtgcagctgcgtggtgagtccttgcggcagacggtcaacgaatgcctgcaaatcggtttgggcgagcaccgcttcaattgctgcctgggtaaccgggcgaccgagcgtgatattttgtaacaaggtatcatcaaacagcgccacgacttgcggaacaaaaccaatcttgtcggctagtcgctccgaagctacgcctgccggttgcccttgaatcatgccggcttgtggaatcagcaagcctaaaataatctgaatcaacgtcgacttcccgccgccacttgggcccgtgaccaaaatcttttcatgggccgcaacatcaatcgttaaattaagttgctgcaacactggctggtgcgcagatggataggtgtagcttagatcctgtaaaaccagttgctctccagaaaaggaggaggcagaggtgtactgtccggatactttttgcgttagatctgaatgtttttgttccggcaatgtcactaatgcgagcaagcgtttggcggcgaccacctgccgtgaaagttgggcatactggcctggcatgctgtagaacaaccacgtaaagctcggtgttaacatggcaaacgccgcaaattgaccgaccgtgatcattttgaaaccgacaaaccacaattcaacgcctaaaattgcaatgtcaacgaacaaccccagcgcaaagccaagtacaatggttcccgtttgctgaatgcccatgtgatattgggagtctgcaaaagtttggtaagccttccgaaaaagttgtaaaccaaactgttcactttgatagtctcttaatagtgttcgtcctgcaagtacttccaataaagctgattgcatgcggccattttcgacttgttgggtgtcctgtgcctgagttaagcgaccagccatgaagcgtgggatcaataaggcagtcaggcacaatcctacgatcacgaccatcagcagccatgagctcaaccaaccgaataagctggcggcaaggaacgaaaaggtcccaacagcaagtgcagttaccgactgaataaacaagggggcggccaaggacgcttcggttgtcataccattgagtcgttcactaccggtttgatcgtccgttgcaaccgggccagtcatgagtgcggccatttgttgcgtttgaagtcgctggaccagccgatactgtgcttgcgtctgccaccgcccaatcaaccagcgtccgagccctatcattagcgccgcaccaagcgcaacgacaaataatctgatcgttaacatgctttgttgggtcacattttgaatgatacgcgctaacgcaaactcgaagccggcgcagattaaggcaatcaaccataaaagcggcgcgatccgcgtcccgaccagttgccagatttgttttagcttagtcatgctgctcacccactttaatgatgtgatcggcggccgtgacaaaatcgaaagtatgcgtgatcacgataatcccgcgtcgtcgtgcttcttgccgcagaatctgcatgaccatcgcctgattcaccgtatcaatatcggaaaaaggttcatccaaaaccagccaaggccgccccgaaagcagcgcacgcgcgatcccgaaccgccgctgctcgcctggtgagagttgcgcgggatgtaatatttgatcgacatcatccgcatatttttcaagcccaagttggtgtagtagtggcatgacccgttgtgacgagtgatcttcaaccaaaagcaagttggctgcgacagacgccgtgaacatcacgctgcgctgcgggacgaatgccactaactcggacggcgaggtggcagttggacggccgcgaatgtcgatgtgtccggaagtaggcagtaactcacctaaaatcagcttcattagcgttgtttttccagcaccgtttgcgccaatgataaaagtgatgccgtgattatcaatctgaaaattcagattgtgcaacagctgtcgtgagctgttcgggtaatgaaaagtcacccgctcgccgacaatcgtcatgggctgatcatgagtcaccgctattttggtgttagtcgtgatcggaacttcagacgcgacctgtagccgcggcaaaatgcgttgtagcgacgttttctgttgggcaagatacgcaattgtcggtgctaaccctaaaaacggccacaaaatcgagccgacaccggcattccacgcgcctaacacgctcgctaccgactgctgcgtcagtggcaacaaggtaaatcccagtaccagcgttaacacttccgccaaatagatcccgccgttaaaaataccggacaaggtaccggcagcacttgccaactgcataaggcttggcgttgcctcctggaaaaaaacctgatgccgctgctggatatacgaaaaaacatgaagattccgcaccatcgcaaaattcgccaagaaatcattgaagaagcctttatggcgatcatcaatgccaatcaaatttgtctgcgcccgattttggtagcgaaaaagttgccgagaaaccactgcgaaaccgagaccaatcaggataaaaacgactgctaattgccaggactgagtggcaacatacgcgatgcccaagatgacggtgatgccaaaatcaaccagcggcaagacgccggtatccaaaaactgcatgatattttgggtgtcagttaccattaagttcatcgctaaaccactatcaggtgcctcatcagccttcccagccaaaaagctactcactaaagcagtggcaatggctaggctcaagcgccgttttagccgttccacaaccactcctgataaccagtaaacacccgtataaacaaccgatgcaccgagcatcccaccaaaaatacccagcaacaagccaacctgaccggccagcgccgcagttaatcctagctgaatcaacatggaaatggcgacgttgaagccatcaaccgcgacccgcaagccaagcaaccctactaaccaccgttttttaattgaaccgatttgaaaaattgtttgcattgaaatcgtctcctcgtcgtgactggagaatccagtcaaaattttggggactacgttgtcacaaacatgaacgtatgcacaaaaagacggcctcctcagccgtccttttaatacatcctatttgatccgactagaagctcatccgcgacgcacaccaaagaaccctgcaccaatcgcagcccctgcattcaattttgatggggtaaatcggtctttgatccgcatgttaggatgcctccgttcgatttcggttttgatagcgttagcataacaggtggttcctgaaaaatcaatgaattatatctgtgtttttttaatttttcatcgagttaacaaaaaaggcactagcgccaaaaattgatccgctactagtgccgattattttaaaaattcagttaccaaacaaattataacttgctttgactcagcaagtcgcgccgctcatcaggatgccctttttgaatgccgctaacacatctgacccctttgcaatgcgaacgctgccgtctaaataagcatgcgcgtcatctttgatactgatggcgccgtttttaaagtccatggccaaaccgctggcaaagaaaatcatgtcatagtccgaagtgtacagcttcaaaccggcgtcattgtccaacttcacttgataatccggatccggctgatcgagcacaatcaaggtaaacttcgtgccgatgctgcaggcaccgccttgtaacgaataccgcccgccgccgtcatcggcaatcaacagcaaaaccttctgatcaaaatgcttcttcttcatcaagtcaacaaacgactgcgataacttaatcgatgccatcataccgtcacctttcctgttacttacttttagtgtgacacttatgcgggacaaaatcaattgtgcgcggttaattaccttgtattatcgttgagcacccgctgcattaatgagaactcctttggcacgctcagtcttcatcgcgataaagatcctcaaattcttgcaacgaatggagttcttgaatgggaacgtgttgtgtagcattgatcatccgcacattaacagtttctgtatcggcatctgtatgactgttaactgcattttcaattcttttctcgttatctgcctcggccatgttgcctatctcctttaacttcgcgatatgaagtgtctctttacttgacaactctcattatgcaacatcacgagatggcatggaactcttttgcaatcatgatgataagttaccaaccaactgcactcgatcccaaaaattttgaacatgttccggcgctttctccactgcaactaacatcccctttactagccacaactgaacagtcgccaaaaagatgtgctgatcctgctcctcgatccccgccaagtcgcaaaaacgatccttgtacaccttgactgcattcttttctcgcggcatgaagctatcaaagagtgcggcaaagtccagaaaccgagggccgcgacgtgcctcgccaaaatcgataatcgcaactttttcgttggccagcgaaagtaaattccaacgaccgagatcgccatgcacccacgttccctgctggcggtcaattgtttcgagttgcgtgatcatcggtgtcagttgttcataaatgccgggccaattttgggctaagctagctcgctgactctcccaaagtcgatccaacgactgggaatcgtcagtcgaccaagcatattcaaaccgatccagtgcaactcgaatctttcggtaacatgctaacgttgcagctaatgacggttttgtcgcggcttgttgccaataattctggacgcgatagacctggtgatctaccatcacaaacgggtgtccctctgtggtcgacaaaattgctggcgttacatcgcggtcttcttcctgaatcgcctgtgtcaaggcaaattcgagagaagcgcgggcggtatcggcaaccgtcttcaccaaaacagtggacgcatcagtctctacacgccacgcacgaccactttttccattggtcatcggcgccactcttttgatttgtccaaggtcataagcatttacaatccgatccaaatcactcatgattctcctccatacatttctgctaatggccgtggcggagcttttcccatgacgaataagccgttatcaggtatgatcgtcccaccacttgccaatcgaaatgtctttcaaacatcagcctaaagcttcacgacaagtcttccaaattagcatagaataacagtagatcttcggcaaacttcttttagaaacgaggccatccatgaaacaccgcaaccgcttattctgggtgatcgtgcttgtggcgggagtcttcttaatttatagcacagagagtccgctgccaattgcgacgcgcgaaactgtcaaaaacggcatcgcccaagtctggaacaccgccacacgcacggtctctggatggttgaatgacaataatcaagctaaccaggccagccaagcctcatctggtagcctgatagccagcaacaccagccaatcagccacttcgaccagtacctcagccgacaccacccctgccttaaatatcgttcaaggccgtcacctcagaaaaacttatttctatcactttgacgccaacttgccgcagtcagaacacaacgttttcaacgaagctgtccgcgcctataacgcaaccggcatcgtcaaactcatccctggcaagggtcaaaagaatgataaccaaattaccttttcaagttaccaaaaaggcatgagcgaacaagacctcggtgccaccgaacttggcgaaggcggcccgaccatcattgttgaaaccatgggtacgcaggtcacggtcatcaaccatgcccgcgccagtctcaatctcacctatccggcccaatccatcaacgaagccgttgccatgcacgaattgggccacgcgctcggcttagatcacagcaagtccctcgactcggtaatgtacccgatcacgcgcggggtcacgcaactctcaagcggtgatattgctgggttgaaggcgatatatgggccatgaaaaagaatgggtcaaaaaaggcaacgtcaccggcttttccagctggcggcattgcctttttataatttcagggatgctaagacagaagcctttcatcagagcatcttttaaaaacaaacatctctacaacaatccattaacccctgtagacactgtcatcacctgtcgcaacagtagacgaagcagcgtagtagaaaccgttgtcggtcacatagatcccaatgacgatgttcttgtagttagaattaatgatgttttgatagtgaccacctgtctgcccattattgttttcaggacgttcatcaatgatgtactgcttgaacatggcgttggcaatcaacgtactcagcttatcggcattcccatcgacgtctgacttaagaatagaagaagtcgaaatattttcggtgttcagttgcatataaccttcaccatcagcatagctaacagcctgagtacctgatggcgcaggattggttggacgaacatgcgcaaacttgtacatgacctcgactgcccgctgtgccacagtttcataggctttttgataggtggtcagggttgtttgtacgtggcctgttcgtgcctgttcaccgtttaccaaaacgttgaatttctttgccacggccattgttaagtcattgtccgtatactcttgtccctgctcaacagatactcgctcatccttgactttgacttgatcttgaatgagggttgtcactgcatcgttgacactcttgattttgccaataatagtcccggcagccgcaacatttcgccaaacattggttgtggtaatcgttgtcaccgtatccccattgttaggatcagtggtagtgaccgaggttggcgttgaggaaacctttgtataaccagtggtattggttaacgtataaccgccttcatccacgtcaacttctttattaacggtcttggctcgcggcttgtggtaaacataagttacagtaaccatcttcctggtccaattaccgagagtaagcgtgctcgtacttgttgatgagccgatgagacgataaccgtcagttgaggttaatacatttccctcgtcgtctttattgacgaagctgttggtaatcgtcattcccgggtctgtgctcttttcccaaacaatggtgattgtgtatgtggtcgtcacatttccagattttggatcggtatcctctgaaacctgaactgaccgactaacttgttcgtaattatcagtatttgtcaaaaccttgccagtctcatcaacatttaccatgacattacggataaaatgcgttggtgttgtttcattcttcttccaaacaaccgttgtcgtaatggtggtggtaacatttcctgttgttggatcggttgtatcagacgagctcttagaactggagacttgtgtatagcccgttgtatccgttaagacattacccttttcgtccacattcacggtcttgttgacggtctgatgagtcggggccgtattcgtctttctccaaacaatcgtggtggtaacggtggtggtgacctcaccggtatttggatcagtgtcatcagcaacctgccttgaaatggacacttgcgtataacccgttgtatccgttaagacattacccttttcgtccacgttcacggttttgttaactgtttgatgagttggagtggcattcgtctttctccaaacagtcgtaacggtaacggtcgtagtgacgtcgccagtttttggatcagtgtcatcagcaacctgcttcgaaatggaaacttgtgtatagccatcgacattggtcaaagtatgaccagcctcatcgacgttcaccgtcttattaacggtcgtgtgaacaaccttgtgataagtattcattgtcgtataagtggtgatcgtatcaccattagcaagtgtttggacagatttaaccggtgtccctgtcttcactaatttataaccatctaaattagtgattgtttggccactttcatcttggttaatcgtgacattcttttcagtgtcatgtggtacatgaatagttggcactgtcttttgaacttcagccactgtcttctggccttctgccaaagtgccattatgatcggtggcatcgactttagccgtttgatctttcgtcttcgcgatattggcatttgccgtatcaacattggtttgcgccgttgctaactgttgctgccaagctgcgatcttctcgttcaaaccggcaattgtttgattcagttgatctaatttagtattcaaatcagctaaatgctgtttaacagtgttggccgcctgactatcggcacttgtgactgaggttggcaaactttgtaatgttgtctgcgcttgattaaactcattttgagcggcctttgcttcattgtcgacagctgtcagattctgattagccgtcgtcagattttggttggcttgactcgctgcctgttgcgcttgcgttaatgcactctttgcatcagctaactggccttcatagaccgtgatcttttcttgagcaactgcgagtttagccttaacatcgacaacttgggcttgtgacgttggatcgtttttgacctgacccgccaatgtattcagctgtgtttggagactcgtgatctggtcggttagatccttgacagctgaatttgcctgatcaacctcgttctgcttcgcggtcacggcagcattagcctgatcaaaagcagcttgggcttgcttggccgcagcttgggcgtttttcaacttgttttgggttgcatcgactttagccttcgcagcatcaaccgcggtttgtgctgccgtgcgcttggactgtagcgacgttagcgtctgattgttctcttcattgagcagagcggttaatttagcttctgcttctgccttggctttttctgcagccgccttttcagcttcggcttttgctttggctgccgctgcctcttctagtgcctttttggctgcagcgtcatctgttggcgtttctccattgccagtcgaattaggcgtcgttgtcgtgttccctgattgtccagaatcagctaagttcgtggttccagtcggggatgagccgttcgatccgccaacaacagtgtatcttgtttccgactgttgtgcgccacttgcgatcgccggtttcgctggatttaagttaaaggtctgattcgttcctgccgcattttgtgtggtgacggttgcgtttgcgccattaccttgtaaagctaacttagcgccagcataaatcaggtcaacatttgcaattcggttaatcgctgccagtcgctcaactgaggtcgtgtaaccactgttgttcatggcctcgctgatggttgaaagggtatcgccccactgaatatcataaaccgtgttgcctgaagccttgagttgcgcctcgatttcactaacaggccgcaacttccaaacccggacattatttgtttgcgtttgttgcgcggaaggctgttgctcactggcatgtacgacttgcccttgattcgataagccaacaccagtaacccccaatgcaaaagccgtcaagccaactgctaaccagccatgatgtttgctgtgaaccaaggtgactttatgtgcgcgatcccccactgctgccaaaaaccgttgctgtcttcccatttcttgctcctccatatcttaatgttttatgaaacatatacggtcacgttaaccaacccctgtgaccaagaacatgatagcatttacaaaacaaaatttatgaaaattatttgtaaatttgtcaaaaaggctaatgctactttttctacctagtgtatccggtcatgcttgtgcaaacttcttttaatttagcaatgcaaaataaaaaggcttgagacaacgagtccaagcctcttgatgatgattgacgaggtatcttttataagtaaaaacacatagccctgtcaaacatcttgatgttggccaacactcagcctaatgatgcataaggctctttttaagaatgactaatcagtattcgcaaaaatagtggccaacataaatggttaaagagaccgatccgaccttaagcgatttaacttgattatgtcagctaaaatgacctgacggattacctctattaaccccccttttttataaattatttgatgagcgcctcataaacggtaggcaacattcgccccaagcgatgttattttccagtaaatgagattttatttatgtttagtgaccaaaagcaacgcaacaatcgtcaaccccctgttgactaaaatcgttgccattaaccaccaccaaatggaagtacccactactatcccagcagcatgttaacctgccccacgcatgattaacatgcaaaatacagcttcaaagtatgattttttggttaaatattgtatccataaccaggtcaaacgcttcgtgatggtttctcatcacaatcgttattatacgtctttatggtctaataagtctatttattttttaaatatgtgccaaccagcactaatccttcaatccggagtcaggtagcgttgatgtaatgagcgagccaaatagggggttaaaggttgccactacaagaaagagttgcaaaacggatccacgaattaagactcagcaaagcgatgacccaagagcagttagccgaaaaagccaacatggatgtttccatgctggccagaattgaacgcggcagtcgcggtgatattcgaatgggtaccttagaccggattattaacggcctgggtgtcacttaccaagagttcttcacgtttggcgatgacgaaaatcaggcaacccgacttgcttcttcaattgctttaatccaagatccggatatcctcactgctttgcagaaaattgttgattcgattattaacccgtcaggcaaacattcatgatgacggtttttaaaacatttgaaaatattcatattttccagataccaatccattcaaaaaagcgctaagtcatcgcagcaacaacaaccgttgctagcgtcatgacttagcgctccttttttggcagaaagcattcatgtcacagaactgttcgggcgccacgtgaatcccaccgcatcttaacttggttaataaagtaaaacgatcccactgcaatatagaccatctcgtcatcagcattcgcacttatatagtcaactgcggcacttgcgttgggtgcgttgtaaacctcatgatcctgacgcattttgtcattctcgtcaaaaatacgatacaactcatcagaagacattgcgcgctccgggttgtctggcgttgagaccacaaaagtcgcatgaggtaaatcaagcagcctgtccacacacaacgcaacttgtttgtcgcacaagaaaccaacgagaaccgtcaacttgcggttggggacggctgccagaagcgtcttaaccaacgcatcaatcccgttaacattatgcgcgccatcaatgacgagcgtgggcttgctggaaagctcctccattctgcctggaaatgccactgagttgatcatcgctacaatcgagtcgtccttaattttgcacggttcacttgcattaaaggcgctgcaccatttaagcaccgtcgcaagattgttgatttgatattttcccgccaacgagaactttaaggcgcgatgccagtgatcattgaggcgaacatcaattaaattagacgttagatcactggaaactaggttgatttcgaaattctgatccacccacaactttgcgtgctgttcttctgcacgctttgcgatgatatcatgagcaacagatgcctgcgcaggataatcgatcacgatcatcgaatccgacttaataattttggacttggcagtcgcaattgcttcaattgtgttgccgagaattttcatgtggtcgagcgcaattttggtgaagacagcgaatttgacattgctcgttgcattcgtcgcatcaagttcgccacccaacccgcattcgataacggcatagtcaacgcgcttctgcgcaaaaaagataatcgccaccaaataccacgtttcaaaaaaagagatgtcagcctgcgtcagattcatcccagccattccctgaatcaaaacttcgtacgcagcgagaaactcatcttcagcaatcatccgccgattgtattgaatatcctcacgctcatcaagaagcgatggactcgtaaacaggccgacccgatacccctcattctgcagtatctgggcaatcatggttgacgttgaacctttgccattcgtaccgcagatatgaatagtaggaaacgtcatatccgggcttcccaactgcttcaaaatccttctaagcaaatcaacccggttcaaggaatcatcatacagcatcacgcggggaatacgcgctaaaaacttacgatagctatcatgctcagtcatgaggtcacctcattgatttttgatttcctgcaagaattccattcggttgtccttatttttaaacgcgccagagaagaaggacgtgagcgtgtgactgttcgccttcttgatgccacgcatttcggtgcacatatgccgggccttcacgaccaccgctacgccttgtggatcgactaatttttgcagctccaagccaatttgactggtcaggttttcctgcacgttaggctttttggcaacatagtcgacgagtctgggaattttgctaagtccaataatccggccattcttcggcatgtagccaaccgagacactgccgaaaaaaggaagtaaatggtgttcacacatcgaataaaacggaatatcagcgacaaccaccaattccccatcattcgccagggaactgttgaagactttgctttcggtgaaagctttctgatgcagcgacgaaaacatttcttcataggcgctcgcaactcgtgcaggtgtttcctttaagccctccctatcagggtcatccccaatcgcaattaaaatattgcgtacgctcgtttcaattaacgcccgatcaaacggcttcatgtgagcacctctttaattctctatttttctaatctgctgtgtcccctgaatcttcgtgatggcatcatgtatgcgacgggccgtttcagcgttcccatcgtaaacttcttcaagtggctctagaacaaacaaccgattaaacatttcatggtgaggaatctcgaggcgcgaagttcggatcgtctcctcatcataaagttcaatgtccaaatccaatgtccgtggcccccaatggatcgtgcgctcgcgtttgaatcttttttcaatttgatttaaggcatccagtagctcgagcggtgtgtaactggtctcaattttgatgacaccattaacaaaattcgcttgcgcttcataaccaacggggctggtatcataccacgaagagcggccggtaacttcaatttgcggatccgcgtcaatcacatccaccgccgccccgaccgtttgcagggaatcgccgaggttgctgccaaggccaataaaagccgtatgcttcaaaccagcgctcatatggtgatgcacacctccgcattatcaacgatgccgttaattggaagggcgattttcttaatcgacagtgtcagcgaactgaatttatccgcaaatcgggcctgcagcgcttcaacgattctgacgcccaacgtctccagcaacttgtcctgcgacaaagaaacctcatgcgcgataattttataaacctcgccatagctgatggtattggctaactcgtcagcttttaaaatcgcaagatccgttaacttcagcgtgatttccgccgatatcgcgatatcttggccgatagtgcgttcttccggataaacgccaatgtgcgcatggaattttgccgaattgagcctgatcacaactgtcatcctaagccctccaaatctgattcagcatggtcaaaagctgcttggcctctgccacttcatgcacccgcacaaagtccacgccttgagacgccaagtgcgccgtgatagcctgcgtacccgccaatcgcccgggagcgatattttcggttaaatcgccgataaactgtttttgggaatagccatagagcattggaaaatcatcacttaacgtcttggattcgttgatgactttcaaattcccggccaaatccagtccataggcatagccaagtgccggatcaaacaaaacccgctcggccccaatgccatatccttgcaaaagctgttgttgcgcattgaaaaagtctttcaactgctcaagcgctcggtcaggatccaacattctcgggaatgaactgtgagcaagcaccaaccccatcgaagtatccgcaagcatgtcaaggatgaccttttcggatgcctcatcctgaaaaatcaagttgatcacatcgacgccagccttgatcacaccctcgaccacttgcggcttataagtgtccacggaaatcggaacgtccagcttcccttttaacgccgaaatcaccggtaaaatacgcgccaattcggtttctgcgctaatcggctggcttccgggcttcgttgtctgcccgccaatgtcgatcatgtcagcgccttgcgccaccaaagataaggcatgttcaaccgccaactcagtgctttcatacttcccgccatcataaaaagaatccggcgtgacattaacaattcccataaccttcgtcgtgccatcaagcggcagtttgaagctgttcgcagtaaaataatctggtttcatcgtaaactcctttgagacccatatggattgatcaggacgtgtgccataattctggaacgaaattgcaatggtgatcggtgtaacaggacttgtgaagcatttgttgccaattgtggtgaattgaaaagcatccctcttcatccaaaagtgacaggaagcgaactatcagcctaaacagcaaatatcagccatttttataatcaattgtccacaatggaaacaagaattaatgtaccatgcaaaaagagttaccgcaattttttgattatttttttaatcataaatggcggaacctcgatcctgtataatgatctataagggtaataactttggaggaatatcatgaaaaaatcaatgatcggcgttgccacgctccttttcgcattgggcttatcagggtgtggcagtcagcaaaagacaagccaaaagacaagcacaccgagcaagacacaggtctccagcagcaaggcttccgcttcatcggcatcgaagcaaccatctgcatcaagtcaaaaagcagcaaagtccagtcagagtgtcagctcaagcagcgaacaacccgtgtggtcaagcgccaagggtcagcaacttgccgcgttcataagcgagtgggaaaagacaatgggccagcaatacgaaagttactggcagggaaatagtgctgatatgtacggtctgaaaattcctgacgaattatcccaaccagatggcacaaacggtaagatggcgatggcagtcggcgacaaagccgtcacttgggcactaagcgcaaacggccaaagtaatgccgaatataccattgtcgccatctattcaaacgcagcgcatgcacgttacggcggtaaatacgtctacctatttacgttgcacaatggccagcctgaggtacttgttaccgggcaaaatcaaggaaacgagaataactggatatactttggtgaaacgcggaatgaggcgttgcgtgagggttttgctaagattgtaaagggtgattaaagccgtacacgtttcgttttggaccattaatgtacaaatggctcggagaacttgttgcccggtctcctaaatctgccctgctttttcttaaatcaaacaaacacttgtaaaaatttttaagagaacgcaaaagaggatccgcaacgattcctctttttgtgtcatttcattaatttttctcgcatttaaacaaaagagccagtctcgagagttccgaaaaatgacgctcacaaacagtgggacatctctatgccttaagtgaattcaactttgagtttcttgccaagtgcaaaggcaattttgctcacaagccactgactttagtcagtggtgattgacagattgactccttggatgccattcgtataggtccaagccaatatttcggccatgtccccgctgcgataatattggctgatgagattattccagtccggccacttatcaagcggtacgttgattagtcctacgccatggtcaatcatcaacttattaaccgttagcatagcggtgcgcttgtttccatcccagaaaagttgcccacgcatgttgtgataaagcaatcttaacgcccgctcagtgtcactcatggcggcatcattgagcaagtccgccaaccacttttcttcagcggcaacgtcaacatccggtggcacaaagtcttctttgctactgatttggaccgtgctattacctgtgcgaaaatgaccgggatccagtgagtcatgtaacgcgacgattttgttgatatggcgttccacctcaagcgtgagcgggtgatcgtccgtggtgatatattgccacccccgtttgagttgcacaatcacgttgatgtcatcaattggcacaccattgacacccaatccgtccatgatcgtctgcgtttgggacagcgtggtggtgacgccttcaaatcgagcgtcagtgtgcacaagcttaacaaagttagctctggcaaatcgtctattttggtctggcgcgatttgaaatttgtcccggatcattggtacactcccaaagaattttcttgaacatagttgaattataccgcatatcaccggcagtcgatgattacggcatccttgcagtttttcaccagatactacttattcatctaaattaaatcttaaagatggtcaaagtgatatctgataactgaaaagttcttgtcgctatcaataatcttatacttacgagtaacagtttgacgtttggaggaactattcttaatttcttcaaacaagtaaaagtcttttgaatgtgaaaattttccttttgccaaaaagaagtttacactgctgacggatttatgatttatactaataaagttagcttctagttcctctgaagtgttatatcggaaagtgtttgtcccttcagaaagaaaaagcgcacgcaaacaataccaggccaaaacacaaacattcccccaaaagaaaaatgtgtcacctgtaagaaaattgttgaaggcaaatgctcctacactcgtttcggattgcataagtaatttaatactaaactttatgatccacaatgatccggcaatccatataacaaaacgagttaatcttttaattgcagcaatagcactgtaggctcgccattctccatacgctgtctcagttgactttaattcgtatgcccacttactgctagcaaaatttattaaaccgagagaaaagacaaagaaggaaaagaacacccatggattaccacatatttgatagaaagaatctattaaactaatgaatgcattgcagatattctttgggaaatatttctgaatcttcaatgagttcaaaaacgatgtttgagttgatatgacaagtaaaattaaaaaccaagcataaatgacgggaatatgaattcttttgggaatctgtttaaccattttactatctgccatgctgtttattagcgatattagtgtgctcacgtttattttctctccttacttagtggctgatgaactagcctgccaattttgcctcagatcccatcatttggtacaaaacattgattgtttggcgtccatcacgcacgcaaattaaaaatgggtcgccaagaagatccaacaagagatcaagattggcgtcgactagggcaaaatcgatggtaacggcaatgctttcaatgcgttttgccctcaccaaactaagcccgtcttgaaacttcaaatgcgagatacgccgctcgatggcgccgcagcgattctcagcttcaatcatggctttctttttggcgggatcaaggtgtttcggcggacgccccggcttcgaccctggcatttcaatatcgcgttccttgcaataagcgcgattagccatcgtgcgatagattttgtccaccaagacgcgttccgggaaggtgccgtagatatcccagtgatggtcaatggcggcttctaagtcttggctttcctcgtttaatcggccgaataaatgtctggttgagactgataattcggtcttcgacacggtgggtctggttttcaaacatgtagcgttgttgggcgtaaactttttgaatcgtttcgaggcgctctgcttgccaatcggtcaacttaccgccttgtgcgcggagttcctcgacatggcgcagatcgcgtttgacgtaccgtggttggtgctggatgatggtccggcgatgcttgcgctgctgcttgagatgacgcgagtagttgttccattctttctgcgaaatccgcttgtaggtgcatggtggcgcgactttcaactgtttccgcatatcgtcgatcagggcttcaagattgaggcggatttgattgagcaagtgggtgtcctgaggaaacttgatgttaaccggaactgcggtcgcatcaatgattaactcactgacatcaacaccgtgggcaaccagccgttcccgaatataatccgttgagatttgccgaaacagctccgggcgcgatccgcttgcggaacttggctaacgtagacggttcgaacggccgcttggcttggtaagtatcaatcccgacaaagtcctggagtgccggcatatcacgaatcacttcaaccagttgcacatctgaccaaccgctcttttgtttgatcaattgcgcaccgtataaaagccgaaatggtttagccgcgcgacccaatttagaagggaagagcgactggtacacctcttccagttcagcccacggaatggtttccgccaaaaggacccagcggttattggggctgagaggcgttcctagtgccgctcacagcgattcaaatgaagtgttgaacggtctttttgcgataaaccatgtgacttctcctatcattgttggctaaactgcaagcatccttcccggcgttatgcggtttccagacatttccacctgtatttattttaccatgataacggcgaaaagtctttagtaacaagcattctagaattattcaacagccactttttagctagtttatgcatcataatcgctgaaaacatcaaatatttcagtagaaatttctggcttaagcgcctggatcttcgtttcatcaataattgatggtaaattcaccttagttcgaataaatgatgaatcccatatcgaatagtcatggtctcttacggcattacacatttttcccgaaagcgttggttctgagcctgaaagtaaagacagtcgttgcaaccatacatccaaatactctagatttggagtattttcaagcttttttgttattttagatactatatcagcagatttactgagttctgtgtgcccttttaagagtaatttacttagcacccctactccagatgcaatagatttcgggtttttgcttattatttctgctataatacttaccagtggcataatagacttatcaatagatttttgctggtctaatcttttggcaaacgatgttaacgctttactgacgctccctgaatttggaaatttcttagataaccagagaatttccaacaaatgtttttgtaatgtcaactgataattaattcggcaatacttcccatcccaaacttttggcattatgattggcactcttgaattccagtagaccttatcaggtttaatagccgattctatgatatctgtgaccaatcctgtcttcttaatattaaaatgcatattcagaccagaaagtatatcagcaattgtttttacaattttttcagcaacttccttgctgtttgagaatattctgtaatcatcacgatatctaactactagccaatccaagtcgttgatatctttcaattcttccgacagaagaaggtcagaataccctagaactatctcagcaatgaaattaaaaagttctccgccttgtggaattccatttgtctgattacattgaagcttttccactgtccaatccagcatatgtgcaaacgacctgtctttgcgttttgtagttgctttctttgcaacgtctttcccccgtatagcccaatcaatcgtatgtgtgtaaatcgacccataacagtttgtaatgtccgttctgatgcaatacgtgtactcaagtgactttacaattgaagtctgttctaactcttcccaccaattcaaaatagtctctgcggtatcgccttttttcccagttgatttaactggtagactgatacatttgattttagggttcgattcgaacagatcaaatctggcaagtaattccttccagtgctcctcctccgttatttgttcaactaaatcagcatataagaatggatgtacaattttaacttctcgccaatcgtatcctgcatccttgttcaatataatggagtagttatagcgttttcagacgttttaagaatctggagatcaatcattgatttcagcctgctgcctgaaacttttgaaaaagcaaagtcaagcaccggctgaaagtcaaagtattcaggcaatactatatttacatagctgcttgatttaaggaaaaaagcacgtgcttctgcagccgtcatttcaagtacactttttctttcagaggacatcttagtcatcaccgccatcaattcgttttcatttattttaccacgaattaaaatcataaaatttgttaaaaaaatccccgccagctcaaccttcaatcggcccaaccttggcgggaattttggcagggaatgcaacacattccctgccaatcatatccatcatattttccgaaaaactgttaaaccagcatttcggttccactttacttgtttttactcccactcaatcgttgccggcggcttagacgtaatatcatacacaactcgattaacgtgcttcacctcattgacaatccgacttgagatctcctgtaatacatcccaatcgattcgggcgaagtcggcggtcatcccgtcgatggaggtgatggcgcggatgccgatggtgtagtcgtaggttcggccgtcgcccatgacgccgacggaacggaaacctggcaacaccgtgaagtattgccaaatatccttatccaagccgtgcttagcaatttcttcccgcaagatataatcggaatcgcggacgatttccagcttatcttcagtaacctcgccgataacgcggatgccgaggcccgggcctgggaatggttggcgccatactagtgcgtgtggcatgccaagcttttcgccgagttcgcggacttcatctttgaagagtttgttgagtggttcgatgagtttgaacttgaggtcttttggtaggccgccgacgttgtgatgggacttgatcgtttgagcggtgtcggtgccggattccacgacgtcggtgtagagcgtgccttgggcgaggaattcgatgccgttgagtttggcagcttcttcattgaagacttcgataaagtcgcggccgatgattttgcgtttcttttcgggatcggtgacgccttttagatcattgaggaaacgatccttggcatcaactttgatgatgttgaggccaaacttgcctttgaggctgtccatgacctgttctgcttcgcctttacgaagtagaccgtgatccacgaaaatgctggtcaattgcttgccgattgctttgtgcagcagaacgccaacaactgacgaatcaaccccgccggagaggccgagcagaacgcgtttgtcgccgacttcggcccggattttggcgatttgcttggtgatgaaatcgtccatgctccagttggcttcggcgtggcagacgtcgaaggcaaaatgatgcagaatctcgtggccgtactgggtgttttgcacttcggcgtggaactggataccgtaaaatttgcgttcgtcgtcatccatggcgctgatcgggcaattaacgctagtggccgtgctacggaagccatctggcacacgggttaccaagtcgccgtggctcatccagacggtttgatcttttggcaggtcacggaataacttggctctatcgtcagtcacttcaatgtcggctttgccgtattcacggttatcggccggctcaacatccccgccgagccgctgagccatcagctgcatgccataacagacgcccagaatcgggatgccgagtttaaagatgtcttcgtcaacgccaagcgcgcctttgtcatacacactgttggggccgcctgagaagataatcccttttggcgcgatttctttaacttctgccgccgtgatggtatgaggctttaattcagagtagataccaaattcccggattcgccgggtgattaactgattatattgactgccataatcgaggacgatgatcttgtcgtaatccttgttctggtcatttgccacagtccgccacactcccttgtttgaatgcactaattttacagagttttcataagctggtcaatcgtgagtgagaagcctctcatctaagaaattgcgaagccgccgcgtgattggccaagttagtgccagattgtctggcaagttgtcccctatttttgaaaaaagcatgcgcccaccgtcaccattttcgtaatgcgacctgatcgattttgtggccggtcgttttatgcaaaatgatgtccgcccgatttttagtgggcaggatgtattccttcagattcttaaggttgacatcccgccagaccttccgtgccatgtcaaaagcgtccttgcgattcccgatggcatattgatagtaataattgctcggatccgtgaaggccgtgtccagcaaaatgccgaagcgctccagataccactgttcaatcaaggttggatcggcgtcgacatagatggaaaagtcaaagtaatcactgacataaatcggttgcttgctaggcagctgcaagacattgataccttccacaatgagaatatctggccggtcgatgacctcgtactcattaggcacaatatcgtatatctggtgactgtacttcggggcccgcaccacgccgctagcatttttgacgttgttcatgaagtgaattagcaactgcatatcgtagctttcggggaacccttttcgatccaaaatgccgcgtcgttctagttcggcattggggtagagaaaaccgtctgtggtgatttgttggacgcgcttgtccggatatgctcggctcagcagcaactgcagcaggcgcgcggtcgtgcttttgccgactgccaccgaaccggcgataccgatgataaacggcgtgtgcggattgcgctgcatccccaaaaagcggctcaaggtaaacatgtcgccttggtaatcctcatagcgaatgtgaatcaggtggcgcagtggtgaataaatggttttgacatcatcaagactgatttcatcattcaatgaacgtaactgcgccagctcggcatcggttacgctggtaaaattttgcgagtgaaactgggaccattctgcccgatcaaacttataaaaattcatttcggattgcataacttaccgtgtccttgcgtttaatgctttcattttagcatagaaacgaccggttatttcggccaatcggttttgcttgacagtcgggaaaaggttgtgcacaatgagagcaattagttcatgccgcttaccatcgtgtgctcaccaccatcggagggttgctatgtttgaatctcttttgtcgcttattccagaagttgttctcgagtcgattttcataccgatttttaggcctgaatttaaccttgaagcgtcgactaagtttaactggtttcgttttttactaacgcttgcagtcagtggactttttgctggtgctggcatttggcttttgcttcaattactgacggattcacttaatccagtgtccctgtttggcggattgctgctcttagcatcaggcagtatcccggctggccgtgccgtcatcgattttatggactatcgacgccagcgcctcgctaaaatcgaagcagaaaagccttatcaagaactttgatacatctccaagtttgctaatcattcaatctccaaacaaaaagcgcccgaacccgagcgctttttgtttgctaccaatcattaatcgtgcaaggtaaactgcaacttcatcttcggtgccgcagctgcgaccatctgtcccagtagctcgttgctgttggccatggccaagtcagccatctgttcgttcgctgtggtcagatgttcgcgaatgtttttggcatcctgaaccgccttgtcggtttgcagttgcagatggcggcaagccgcaacggtcttttgttcaaagacgtcttcctgatccttgaacaaagagaagtcgtaatcgccaaacgttgccagcaggttgctcagccagtacattttggaaacatcaaaatgatcccctgagtcgcgataagccgccggtgtgtcattcacgttggcataaaacggcacaacggcattgaatgtgttggggccaaatgcgagccagtgaatgccggcgactgcagctggcacgtcattgcgaatctgcaaaatgtggagttcctgattgcggttaataccgatcggccgatacagctttttctgcgccggcgtgccggtcgtgccgtaaacatcgtaaggcgtgttttcgtaatgtgagctttcgacaaacttcacgtcctcgatgctgatctttttggaggtgcggcagatgaacggcaggtcctgatcgatcggggtggtatcaaattccggattgaaatacttttggccgtaccatgcccgcggattgttgtagcgggtgtctttgatggtggctgagccgaaaatgtggcgcaggttgtagccttccgtgtccggattgaggtgatacgtctcgatcaagtcacgcaagtccgcgctgctcatcgtgtcatcgctggtaaaatcaaaatcggtgatgttgaagcggttcggagcgatcacgtaggcgtcgtccggaatccgaattgctgcccagtgatgaccgccgatgctttcgaagtaccagacttcatctttgtcagcaaacgcgatgccattgctttcataggtgccatattgctgaaggagactgcccaagcgttgaacgccttcgcgtgcgctatgaatgtacggcaatacgatggtcggcatgtcttcttcgccaattccagccggtaccaacggatcaacgcccagaatccggctgttggtcgtgatcgtctcagttgacgtcatcgccacattgtcgctattaatcccggctgcggcccaaataccatggccatcttcggcttccggcgtggacgtgtagcccaatggatcagcaggcaggtcaatcgaaaacttgctaagcacggaatgatactgacgcggctgatcttcaggtttgacatagacaaacttttgcggatgcaacggcgattcgccgtcttcgttacgcgcaataatcgtcgagccgtcaatcgaagcctttttacctactaacaccgtggtacacgagccgacataacgttttgccaaaataatcgtccttctttcaaaatagtctcgcctgcacaacgcccacaagcttgatttaaagttaactttaccgcgcaaaaacgggtttgccaatagttggcaggaaacctaggtaaacaaaatcgcctgtttgagatgattgctctcagaacaggcgattaatattttaattagaaatttgttttcaggcggattaggagtttggcacggcgtctgtcaaactaatccaaaggcacctcaccaaaactggcattaatcttgcgataatccgcacgccgctcatcgtaaccagctaacaaccgcttttcgaaatccgattctgcttcaagcgctggcagcgggccgtcttctttgtggcgcgccacgaacgttgcaaaagccgtaccgacctgaaaccgttcgccggtcgccagatgttcgccaattaaatgaataaacacttccagggaccggtgacccacgccgctgaccatacacttaattatcaacgcatcccctaaagtgaccggtgcattcaaccgcaccatgtcaagcgagccggtcgccaacccgcgacggcctaatcgttgtgccgcaatcgaactgacatcatcgatccaggtaaaaatctggccgccaaacagtgtcttgtgggcatttaacatgccgggaaagacccgataactcgaaaccgccaaagtgtcgcgcattttaaccatcaactttacccccgctcatacagatctgccggaaccttatccaacaacggtgtgacatccgggctggcaagcatcgtcagccggtgcatcgcccgagacgcgaccgtatatagtaattcccgctcgtcttcttcgtggtagttcgccgcgttgacctgccaaaggaccacggcatcgaattcaagtcccttagccaggaaactcggtaccacaatcacgccggctgctaaccgctgattttcggacttgatgagcgtcaccttaatccccgccgctttcatctggtcgtaaatcgcctcggcatcctcgagcgtcttggcaatgaccgcggttgtctgcttggcttcattgttcacttttagctgtgccccaagtgccgtcatcaatgctgcttcatcaggccgcacgaccaacttaggcagcggtccttggcggttgaaggccacgattttctgccccgaggtcaaaatggctttggtgaagtctgtcacctgcttggttgaccgataactttgcgtcaattgcacgacccgggtcttctccggatcaaacaacttgctggtttcgttgatcagcgtccgtgagtcatccttggtgaaaatggcctgattcagatcgcctaacaacgtaaacttagcccgcgggaaactgtccttgaggtaagccaactgatacggcgtataatcctgaatttcatcgacaaacacataccgcatctcgcgctcgccatgtcggccggtgatcaagtcgtaaagatgcaggtacggcgttgcatcggccattggcaactgccgctgcttgaacacgtcgatgaaatgatcgacttccgcctgccattcgtcttcagaaatgccttctgccgctaaatcataaatcgccggcacttcccgcaaaaagctgacgtactggccgcgaatgttaatgaaccgattccggacaatatcctgctgaatctcgtcaaagcccttcatcaccaactgccgggcaaagaagcgatattcatcatcgctatttttaaattctttcgggccatcttgttgcatcgagcgaatcgtttcgtcgcttaaattctgcaccgcttcttgaacccactgtgctttggtttcggattcaattttccgattcagcattttgatcaaccgctctttggtggcgttcaggcgattgcccatatgataattttcgttgtaactataaaaaatctcacggatacgcttgcgggaaaagaacacttcgccacggaaacgaatatcgcggaaacgcaagccggaacgttccaggctggtggcatatgttttggctgcgttgaagaaatccaggctacccttgacgcgggcgattttcttttgcaccggcgtcagttgctgctcgaactgggaaaagagattttggacgtcaatgtgcggcaaccggcgcgtgacatattgatagtacgtgaactgaaccatgttctgctcgcctaattccggcaaaacgttgctgatgtagtcggagaaaagctggttcgggctgaacatgattacctggctgctagtcagattgccgcggtagcgataaagcaggtacgcaacccgctgcaaaacggcgctggttttaccggaacccgcagcaccttgcacaaacagcaaatcggctttggtgtcgcggataatctggttttgttcgcgctgaatggttgtgacgatggtcttcatctgcgtatcggacttctcgcccaagacttccagcaacatttgatcgccgatggtctcggtggtgtcaaacatggtctgaatccgcccgtttttgatcacaaattgccgtttcaaagagacgttgacctgctgcggcccgtccggcgtttgataagtgactttgcctaagccgccatcataatagatggaactgatcggcgcccgccagtcgtaaataagaaacttgccggcctcattagtaaacgaaccgaggccgatgtaaatcgtttccggcttctcctggccttcctgaaaatcaattcgggcaaagtacgggttgcccgccaatcgttttacagtcgcaagttgctgggcgctttgcttccatgcattggttcgctcatcaagcacgcgttgctgttgttggatcgaagcggcggtttcaatggtttccgcatcattactgaagttgagggaaaaatcattgaagaagttgtcgctaatgcttttctcttcggttttggtcttggccatctcttttgaaagacgaacctcggcactggagagctccttcatgatgccatctaaatgttgctgctctttagcctgctcaatctcgaccacgccatcatctccttaacggttatcaaataatcgttataacatcttatcacttatgagcctgcgccgcaaaagcgactataactactttaactgagcgactcccgatacgccgagctggctccgcggcgattgggatggaacgtggtgggcacgactttgagcctcagcaaaaccggctgagtctcaaagttcggccttgtactacgctgggaaaaccgcccagctagtacaatctcaccactgatcccatcgccgctccgcccgctcggattctatcatccaaaaaccatttcaacttttgatttattgtttcttctctatttcagctttctccgcaacaacggtgtccacgcttcgagtacataccccactgccaggccgatggcgacgcctagtaaaatgcgtttgaacggcaggctgatgagtagaccgactaagacgcaagtaccaacaatgacggccctacgattgaagaaagattttccttgacgtggcggcttttgattttgtatcatacgcattcctttcatttattcatacttttcgttacgattgactcatccattatcgctgatcggaggtcattatggaatctatttcacttttaattgtcctgacagctgccctggtaaccccgctgttcatggcgcattttcacattaatagtatcccgactgcggtagccgagattctagttggtattgtattaggcaaaagcctcttggggtgggtgcacaccggcggcaacgtgcaatcgttgagtgaactcggggtcaccatcctgattttcctatccgggatggaaatcgatttctccttgttcaagccgcagcctaagacgacaaaaggaccgcagccagccaatcccgtgatacttgctgcagtgggatttgcgacggtagtgctgctcagccttggctttagttacctgctgcaattgattcatttctttagctatccgatttttgcgaccatcctttttacaacgatcgcactcggcgttgtcattgcggcgttaaaagaaaaagaactgctgcaccaaccgcttggccaaacgattttgttgattgcagctttaggcgaagtgattcctcttattagcttgacgatatactccgctgtgaatggcagtagcgacagcaatctttggctgctgctgttactgttactggcagctttggtgttgttggcgcgattcaaacgggtctacagcttttttgcagcgatcgataaaagcaccacgcaattagacattcgcctagccttcttcttagtcttcaccttagtcacaattgcttcacaagtcggggctgagtccattttgggggctttccttgccgggatggtgatgaagctgctcggaccgcgacaggaaacccaagataagctgacatccattggctacgggttctttatcccgattttcttcatcgtcaccggcgccaatctgaatttaaaggccttaattgccgatcctaaaagcctctcattgattcccttagttctagtcggcttctttatcaccaaaattggcctctacccggtattgcgccgccgtttcaaggtatcaaatgcattggccggtactttcttatcaagtgctaccattacgttggtgatcccgacgttaaccgttggccgcaaccttggcattgtgacggaacagcaatcgggcgccttcacgctggcggctgtgattgcctgtgtcagtggtccgattctgttcaatcgccttttcaaaccggagccggaaacattcaaaaaaacgcgcgtcacttttatcggcggcaatctgttgactgtcccaattgctcaacatctaagttcggaccgatatgacgtccaactgtttaccgataaggcggaaaacttccgcacctataattctgaagtcgccatctctctagccgattatcaggaagatgcactgaaggcggctggcgcttttgactgtgacatcatcgtgctcggtgatttcgacgcagacaccaactacgcacttgccaaaatggcactcgcccaaaaggtgccgcgtatcattgcccggtttgctgccaaggatgctaccactgatcgctatgatcgcttgcgggacgaaggtgtcgaagtcttcaatgcgcttgacgccaacatcgcccttctccgcagcctgatcgaaacaccgtcaacgctgcagattctagacgatacgatcgccggaatttacgaagtgaccatccgcaactcgcgctttgccggtctcgaactcaagaacctgccattcatcgacgacatcaccgtcagccagatctaccgcaacaaaaagttcatcgcaccgcacggcgacacccagttatacctgggcgatcacctcatcttctctggcgacaaacacttgatccgcaacattcggacgcaggtggaaaagcttaattagctggttgaagtagggtcgtagtgcgcaggcataatataaaattgtccaagatatagtttgtttgttggtttctaaggacaattcgttgggcttattaggatatcagtgccaaagcggagcaatcgtaggccagctggggctcagtggtgagattgtactagccgggcgatcttcccggcgtagtacaaggccgagcttagagcctctgccggttttgcagaggctctaagtcgtgcccaccactctagcttcgcggtcgccatccctcagctggccggagattgcggagtttggcacggcacagaacttttagcctaagttttaacctcccctgcgatcattttcaatcaggctttcgcttcctgacgtggtacaatgagattattctaagaaaaaaaggtgatcaaatgaaacaaggaacaacgatcctgaccttagacaacggctaccacctgtggaccaacacgcaaggtgaaggcgatattcatctgctgtgcctgcatggcggccctggtggcactcacgaatactgggagaattttggcgaagagctcgctgatctcggtgttcaagtgcacatgtacgatcagctcggatcgttttattcggatcagcctgactattctgatccggaaattgccaaaaagtacctcaccacggattatttcttgggtgaagtcgaagaagtgcgcaagaagctgggcttggaccatttttacttaatcggtcaaagctggggcggcgcgttgacccaattgtatgcgctgaaatatggccaacatcttaaaggtgccatcatttcatccatggtggataacatcaatgagtacgtggagcacatcaacttggtccgcgaagaggcattgccaccttcagccgttaaatacatgaagaaaatcgaaaaagccggcaaatgggatgatccgcaatatcaaaaatatgtcgatgtcctcaaccgagggtacgttgatcgcaagcagccgcctgctatttcccatttaattagcaccatggcgacacccgtttataacgctttccaaggcgataacgaattcgttgtcaccggcaagctgaaagactgggacatcagcgaccaaatccacaacatcaaggtaccgacgctgctgacatttggcgaacacgaaaccatgccgctaaaagccgcgcaacgcatggccgaagtcattccgcatgcgcgtttggtcaccactcctaatggcggtcaccatcacatgatcgacaatgcgcctgtttactttaagcacctaaagcagttcatttccgatgttgaaaacggcactttcaatgactagttgtaaaaagcggtttgccatctgcggcaccgctttttatataaaggagctttctgatggcctataccgttgattttaaaaccgtcagtacgactggcctcgaaagttcgcctgtcgcccaatcgctggctggtttacgtgccaatgaagcgcgctacatttggaacaaattcaaagtgccttatgtgacgtatccgattgcagccaggccggacagtcttgcttggctgcaaacgattttagccgaacgggcgttgacttttgcggccaagccgctggaaatctgcgacttggcattgcccgacatgcgctgggtcgaagcctattatcaagacggacttgttgttaatgtcatgtattcgttaacggacccgaaaaaacgggcagtcggcttcaaactcagtgagggcatggctgttcccgatgagctcgccggtaagttcaagtttgcccgccaaaaatcaaaacttgccggcacgattcgcggttcctttttcgtgattaaaggcagttattgaatttatcgtcaattgcttcacaaccatttaatgcaaaaaacgcttgctgccagtagcttgaaaattcaagctgcttggacagcaagcgcttttaattgggtcacggcacaaagacggacacgatcagttgcagattgagcaacgtgatcaacccagtcagcaaatacccgacccagcggactcctggggaattgacgtgatcccccatcaaatcgctccgatcggttaaggcgactaagggaaaaagcgtaaacggcagcgcgatgcttaaggccacctgcgcatagacaatcacctgttcaaagttatgctcgctaaagcccatgatgaagccgatgatcatgattggaatcaaggtcactgcccgcgtcagcaagcgtcgttcccacagtggcatctgaatgttaaggtagccttccatcacaatttgtccggctaaggtgctggcgatcgaactgatcaatccggtaatcagtaaggcaaacgcgaacaaagtgctcataatcgggctggcaagaccgccgacaatggctggatttttcagcccgttatacacgccttgaaatgccgtcacgtggccaccaacgccataaaacagcgttgcacctaacaccagcaacaacgcattgatcaagaacgccgccacgagatgcacgttggagtcccacttgccaaaccgcagtgcctcggtcacctgcgccggaatatgttcatcgtacctgcgactttgcgctagcgaggaatgcaggtaaatattgtgcggcataatcgtcgcgcccataattcccaggctaagcaccagcatcccatgattcgttaaaatctccgtatgcggtacaaaaccaccaacgatcccgccgactgacggatgcgcccgcagcacctcgatgccgaaaataatgcctaccgtcaaaatcgaggccaacacgatcagctcaatgcgccgtatgccaaaacgcaaaaagaacaagacaaccagcacatcggcaatcgtcagcaacatcccccacatcaaaggcagcccgaacagcaacttcagcgcaatcgcagtgcccacaacgccggtcatatccgtcgccatcatcgccgcttcattaatcaaccacaggcaaatgcgcgcccattttggcacaaaggccgcaatcgcctgcgccagatccagccgcgcgacaaccccgagcttgatcgacagactctgcataaacatcgcaactaaaatcgtcatcaacaacactgacaacaacgcatcatggtatttactgccaccttccaacgctgtcagccagttccccggatccatgtagccaaccgctaccagcgcaccgggaccgctataagccagaaacttttggaaaaaagaagtttcgtaaacgcccggcacctgcacactgcgattaatgtcatctagactgcgcttggcctgttgcgcccgcagtcggtcatcttgtttcatcgtcttgggcctccgctgcaactttttcctttgcaagcgatgccagtaaatcacaaaacggtgcacacccattcatcggtcgcactgatttaaagactttgccgccattagcccgaaatgtctggtagttttgaacgtcattttcttctagggtctccagacaatctgccacaaagctcggcgtggtcaccagtacccgccgcttgcccaacgccgctaacgccatcaaacggttgcgcaaataaggttttaaccacgggaccgggccaaatttggactggtaacacatttcgaccttctcctgtggtactttctttaaatagcgtttaacgcctgcagtcgtggcttcacaggcttgctgataaggatcaccgtggcgcaccatggatgttggaatcccgtggtaactcaggatcacggtgtcatagtcatcttggctgtaggcgtcgtctagctgtttcgccagcaattgcaaataagccggctgatcatagaattgatcaatgaccagcgtcttaaccccggacgctgccactttgtctaaaatggtcttcgtcgtgctttgcgtatactcgggaaacaacggaatgaccacaatcggatgatccccgcgcgccgccatattctgcaacgtctcgccaatggggtattcaccgccataagtcatcgccatttgaacatcccaatccggcaacttctttcgcaaacgatcgcgtgtcacctgggtataagcaatcagcggtgacccggctttggtccattcatgctgataaaaggtcgctgatcgccaactgcgaaaaggcagaatgaaaccgcgtaaaatcggttgccacaacattttaggcatcgtgatgacattctgatcacttaagaattcctgcaaataccggcgcacatcccgcgtactcggcgaaaccggcgaacccagatttacaattaacaaccctgttgccattttactgcccccatcatgcgtcaaaatcataaattaagaataacacagtgcgcgttcttctgagggcgttttcttgcctataaccattcgttcaaagctaacctcctcgtgtttctatgctaaactatctttagaagtaaactttcgaggaggcagcaggatggctacgaagggtattaccgtttatctggtgcgtcacggccaaacatggttcaatcatttcaataaaatgcaaggttggtgcgattcaccactgaccgaaaacggggtcaaagacggcactaacactggtattattttgcgcaatgtcgcgttcacccatgcttattgcagtgacacgatgcgggcaacgcgaacagctgatttgattttaagcaagaatgtaaccggcaagattccgctgacagtcacgccatttttccgggagcagttttatggctattttgaaggcgaggattccggtcagacttggtacatggtcggctttccgcatggggcaaaaacgtatccggagattctggaacaatatggcgtcgatgcctcaaaggacttcatgcacgatgccgatccattccatgaagccgaagacgcgcggacttactggacccgacttatgaaaggcttccgccagttgcggtctgaaaacaaagaaggcgacaaggtgctcatggtcagccacggcaccaccatccgcagcattgtcgataagttcggcaaaaatgatggctttgtggtcaccgattcgccgcgtaatgggtcgattagcaagattctgctgaccgacacggggattaaaatcttgagttataacgagtttgaggcttgattgtttcttgccgtgccaaactccgcaatctccgtccagatcggggctggcgaccgcgaagctagagtggtgagcacgactttgagcctcagcaaacccggctgagtctcaaagctcggccttgttttaggcggggcaaaaaacgccccaccaacaacaatttcacagctgagccccatctggcctccgattgctccgccttggcactaggataaaaaaatcactaagtattataacggcacgaaattcatggttcctctttgccttttagtatcaaaaaagaccacgcaacgccaaaacttggttgcgtggtcttttactgttcaactggcaaacatactagttacgactagtgtaccaattccttttccttgattaatgaatcgccgtggatgaattccggattcggggttaagtcaaagcgctgtgccaactgttccagattttcatcggtaatttcgttgacgaacttgccaccttgcgcctgaatggcggtgtagatggtcgcggccttttcaacggtttcgatcaagccataggtttcatcaatggagtcgcctgcgccgaagatgccgtgaagtggccagagcacgatgcggtaggtgcccattttttcagcggttgcctgaccgatttcattcgtgcctggggtcatgtatggcaaaacgccgacaccttcagggaagacaacaattgattcagcctgcatcttccagaagatccggctgaagagtttctctttccatggcaacgtgaaggtcatggcaatcgtgttggttggatggcaatgcatgacaacgcgctggttaggatccttcttgagccgctggatgtgagtcatcaaatgtgccgggaactcactggttggctggccgccgtcagaaaagccccacagtaagtcaacactgtggccgtcttcggcgatgcgaacaagccctgtgtcacgttccgggaaatccttaagattcttgaaataacggccagtgccggttaccaagaagtattggccggccaattcgctggcatcgaatttgatcgggatgttgcgcttaacttcatgcacatcaccatactgactaacttcctgttcagtcaaccgatagctgacattgccgccgttacgctcgtcccagccatgttgataaaggttccaggtcaccttttgcatttgttgaacaaatggtgaatcaataaacgcctgcgtatattcgggattcaagaaatccttttttgaatctgccatgaaaacgttccttctttccttatggtcatcgccccgattgcttatgaaaacagtgacaaataaacagatgattcgcttcgacccttgtcagaaacggtcaactgcactgaatcagtagcgctctcggtttgatttgttctttatctttcttacaacccctattttacgaagcaatgtaagcgctcgaccagaccaaatgtacgcatcaaaatagccaaaacggaacagatatacatatcgggaggctatattgtgatgtcaacggaggctggttcggatgattataaaagatgaaaggcttaggcaataagttccatgccgtgccaaactccgcaatctccggccagctgtgggctggcgaccgcgaagctagagtggtgggcacgacttagagcctctgcaaaaccggcagaggctctaagctcggccttgtactacgccgggaagatcgcccggctagtacaatctcaccactgagccccatctggcctacgattgctccgctttggcactaagaacttaatatgcctaacaaaattctacgcagaaataaaagtaatcacaccatctttgaaaagtacgtttgtctttaatattaaattatgtcacaaccctgcttacgctttagccgccagatccttgttaatgacaatgctctgatagatccagacagttgccaaataataaagaccgtacaagacgatgaataagccaaacgggactaacaaattcgcgtaaggctgacttagcaaggtcttaaacatctggagaccgaataaaacgtgcacaatgccgaccagtcccggcagcaggaatagtgcgccgatttcctggcgaatggaacggcgtagtgcttgcggacgggcgccgattttttgcagcataagatagcgactttgatcataattggcgccagacaagattttgaacatgagcgtggacgccagcattgccaagaacgcaatgcctaggaagaagcccatgaacgcaagcccagaatacatgccattgataatgtcgtagaaggcaatcttttgatcggtgttactatcgccaagccgcggatattgatgctgctgcatcgtcacaattttttgaatcgtatcataattctggttaaaatctttgactttgatcgtcgtcaacgtctgtgcatttccaagcttggcaaacgttgcagcgtctgccacttttaattgcttgccgcgattattgccgatgaacacgccaaaagcagttgggtaacgctcgataacccgatcgaagttgcggctggtaattttgatggcaggcgcgttgagtcctttgtcattcgctttgatttccaacggatgggcatcaatcgccgctttgctgatgtaaaccgttttggcatccgacttgagcgtgtactgatgtttggcggtgacaccttgtaacttattgacctccgcgcgggttgcggcgttcggtgatgtcaccgtcacatcgtaaaccgtggtttgattgaccaacatcggaatgtcatgggtaaaaccaagtccgaccgtaatcgcgcctaacgccaacgcgaacaaaatcgacacgaccgatagaatccgggtataatcacgaattcgaaaactcagttgcgataacgtgaaggtatgcaactgcttagctgcgaatttcttgttgcgtttcatgagactaatcaacgccacaaacacggaattaaacaagaaataagtccccgccacgatcgttactagcgctatcggaatcgccattaactggaaaacggcaatgttagccatgctatagtaaccgatcgccagcagcaccaacccgagtacaatctggatgacaaagctagccttgcgctgcttaatccgattaggtgtctgggcttgatgtaacagtgccatcatcggcgttttcaacaattttccggcattgtagatggccgagaaaataaacagaataataaagaagcccagcgtccataaaattgccggcacccaaattgcggaaaaaccggtggccggggcatgtaacgttttgattaaccactggccgataaaggtcgtgccaaccatcccaatcgcaataccggcaactgtggcgagtaaaccgatcacaacggtttcaagaaaaacgagctgaccgatcttgcgcccctttgctcccagcatcataaacatggcgtaatcacgctgccgcatactgagcaagaagctattggcatacacgatataaaccagcgtaatgatcgccagtaaaatcgctccgaacccaaagataaatggcgtaaaggcgatcggagaatttttcgtcaaaaagctggtgttggtggctaatgccatgaacatataaaacacagcactggcaatcaccaagccagagaatagcaccgcataatcgcgaaaacggttctttaaaccgccaagcgcgagctttgttaacatcattttcgcctcctacttctggaatgttccgagtgtctcaagaatctcctgataaaaggcttcttgacttttgtccccatgtttcagttcagagccgatctgcccgtctttaataaacaaaatccgactggcataactagccgagaacggatcgtgcgtcaccagcaaaatcgacacgccttcatcctgattcaaatgggccatggtatccagcaattcgcgggccgcggtggaatcgagcgctccagtcggctcatcaccaaatagaatatcgggctgctgaaccaatgcccgcgctgccgcgacccgctgcttttgaccaccggaaagctcggtcgggtaatgatccaacaccggttcaatgcccaacgtctgcgcaattttatccaccgcttccccctgcttcttggcgctcacgttctgcaacgccaacggcaacgcgatgttttcccggccggtcagattctccagcaagttgaagtcctggaaaatgaagccgatgcgtttcgcgcgaaagtcagacagtgcgttccctttaagcttggtcacgtcatcccctttaatccgcacggaaccggatgtcggggtgtcgagcgtactcaaaatatttaatagggtggttttccccgagccggaagcgcccataataccgacaaattctcccggttcaacttcaaaactgaccccttttaacgcgggggtctgcttctccccgcgtttaccataagtcttggtcacattttcaacggtgacaattggttgttgtttagccatgatgaaccctccattcgccaagtcacggcgcttgcttgattaatttaataatagtagttattaatcaatttctcctgtccatgccctaacagttggcctttgaaaactaacgggtttgttagttccattagcttttctttactttttccaccaaaatgccccgaatccttgctataatcactattgattcatgaaaatacttatgaaagttggttcgtcgtgggaaaatttcgcaacaaagctccgggtctaggttcgcagttagttccgcactcaacctagtaaaggagtttgttttatatgaacgatttagaaaaaccgcagaaacaatatattccctggatggttgtcggcctcatggattttgtgaccgtgatcgggttcgacgacatcatctacaacttccagaatcaaggcttagtcgccttcacgagctggatcatcatgaccttcttttatgttatcccgtacaacctgatcgtggcgcacatgggatcgactttttccgaacacggcggcggaatcaccagctggatgcgcgagaccaatggcgatacggttggctactacgccgcgtggttctactggattaccggcctgccttacgtggtggacgtcgccaattccgtcgtcatctcatttggctggatcaccaatggcaacggcaatattcaagctaatctcggcaacgcatggttcggcatcctcaccgcagttatcttcgtgatctttatctggctccagcacttctttaaaaataaaagtcttgaaattatgtcgaccattggcggcggtgccatgtttatcatgaccattttgtttgtggtgatgacgtttatcggcctgtccaagggtgcgccgatcgccacccgcccgtttgacttcaaggccttcatccccaaagacttcttctcgctgagtttcctgtcgacttttggcctgttcgtgtttgccatgaacggttcggaactcgccgcgccttacaccaaggacatgcgccatcccgcgcgtgacttccccaaagcactgaaaatgattgccattatgaccatgtttctgaccttattcggcaccttctcactaggggtctacttcaacgcccatcatctgccgaatgatttgaaaatgaacggttcctactatgcgtttcaggcgatcggtcgtcaattcggcctcggcaacagtctcatgtatcttttcgccgtggttcaaggcatttatatgctcgcccaactggcggtgattctagatgcttctacgcgcgtcttcctatctgacgttgccaaacgcttcatgccgcggcagttgaccaaaatgaacgaagacggcttgccgatcaacggctattggatgacgacaattctctgcgcgttaatcatggcgttgggcgctttgctgccgaaaatcaacgatattttcaactggttattgaacctcaatggcattgtgagtcccttgtcgacgtgcttcctattctggtcctacacgatggttcgcctgcatcaggatcgcttcccgacgccggattatacgttcctcaaaaatcgtaaagtcggcttggttgtcggtatctggatgcttggcattacttttctgctcggcacactcggcttcttcccgaccgatgcgacggctgatacttttgccttgatgctggtgctgaacattgtggtgccaatcgggatggtggcgctcggcgtcttgatgccgtggattgccaagcgtcagcgtaatgccgtcagtggccttgccttcagtcgcaatacctggctcgtctttacggcgcttagtctggttgggctgattgccgccgcgacctatggcatgcatgtcaacttgcttaaccacttaacgccggtcattcagtgggccattattattgctgttgatctggccattgctgctgtggtgatcaaagtcaccgcaaacggacggcatcaactgttggcaacaccggacgacgaagcgtaaaactgcttgctgacctttttaagtgcaaacaactttaaaaaatcatgctccggagacaattccgtatcttcggagttttttaatctgattgcttgccggtcagacatttggggcagcaaggcttgctcgctgttatgatggtttccactgatttagctgtcaacacggtgatcactgtcgcggcgtgataagattaatagtaaagagcgatattgtttttaatttgtgatgatgccatttcttttaacaatcgtcacatgtcttgataagtaggaggctgctatgcttagctacacgatcatttataatcccgcttcaggtcacgcaaagggcccaacagcggcagaagtgctcaaagcaaaactcgaagatcgccagcggctggtcacgatgaagcccacaaaaaatgccgatgatgcgcgtgagtttgctgcccgggcacactcggatgttgttgttgcagttggcggcgatggcacgattaatcaagtcgtcgccggcctagcgccacgacaacaaccgccaatcctaggcattttgccagaaggaaccgtcaacaacctggccaaggtgctgcacatccccttactattacccctcgctatcaagaacatcctcgaagccaaaccccagccgcttgacatcgcgcaagtcaatgatcgctacatggtcagtacgctgacgcttggcgttttggccaatgccgcgctgtcagtcacgcaaaaagaaaaacgccacttcggtcccatcatctacttactaaaaggctttaaagttctggcgcagcaccagcactggcagttgcaactagacaccgcccatcaccaatggaaaaaggacacccaatttctgctggtgaccatgaccaattcagttggtggtttcaccaatgccgttccggatgcgacgcctgatgacggccatctacatgtcttcatcgcgcctaaactggcttggtggcgttcgctgctagcaatcccttacttcatcaccggcaactttcagaaactgccgggcatgacctattttaagactgaacagctcacgattcaggcacctaaaaccctgcaaagcagagtcgatggcgatccgagtgcgaagaccccgctgaagctggccgtaattgccgatcatattcaggtgctggcgccgccacttaaataaacgaacgacgcgtataactgcaaacaaaacttttcacaacgcaattcgctcgccagctaaaataccgcgtgttacactagtcttattcaaatgaaaggggtgaatcgccatgcggttacgcaaggttgcaccatgactgatgatccgttagcaccgatccgcggcgatgacgcccggatctatgaaaggaatttatgactgaacaaatatccaatgaagtaacatctgagaatgttttgatcgcaggcatttcccgccagcaagccgatttcgattacaccatgaccgaactcggtgaattggccaaggctgataactatacggttgtcggcgaggtccggcaaaaccttgatcgggccgttgccgctacctattttggctccggcaaagtcgaagaaatccgcgagctcgccaatgttcgtgacgccaccacagtggtcattaacgatgaactctcaccatcgcaactgcgcaaccttgagaagcaaaccaaattgcacgtcatcgaccgcacgcagctgattctcgatatttttgctgatcgggcgcgtagtaaagcagccaaaacgcaagtcgaaattgcgcaactgcaatacgccttgccacgactgcatcccagcgctaatcgtctcgatcagcaggtcggcggcggtgccggttttgcaactcgtggctccggcgaaacgcaacttgaactcgatcgccgagtgctcaataagcgcattagccacctgcgtcaggaactcaaagaagccagcgttggcgatcaggttcgccgcgcccggcgcgaagacaatgcaattccagtggtcgccttggttggctacaccaatgccggcaaaagcaccacgatgaacggactcctgcaactcttcgccgatcgtccggaagacaaacaggtctttgaaaaggacatgctatttgcaacgctggacaccagcgtgcggcaaatcaccttgccagacaatcgcaagttcctgctcagcgacactgtcggcttcgtctccaaactgccacacaacctgattgacagcttcaaagccaccttggcagaagccgccaacgccgacctgctcattcaggttgtcgactactccgacgagaactatccagaaatgatggccatcaccgagaaaaccctcaaggaagtgggcatccacaacatcccgatgatcgaagcttacaacaaagccgatctacgtgaaggcacgcggtatccggaagccaccggccaacgcctcatctactcggcccgtgacaagcgctcgcttcaggcactcacgcaacttatcaaagctgatttatttggccaagatgaagaacacacgtacctgatcccattcgatcaagggcaactcgtcaactatctgaatcaagaaactgtggttaaagccaccgactacacggaagacggcacccgcatcaccgcggtcgtcaatccggttcagaaaggtaagctggctaagtttgcggttaaggaagaagtttgaagcacctgagttaaatcgaatatgaaaagagcctcgctatcgctgcttgaatgtctcaagcggcttagcgaggttctttttagtcgatttgatgctttcgtacggatcatttgcagaatgccaaagattatgacaaaatgccaaactcatacccgttactgcggtaataatcaataatcctcggtaacgtcttcacagtcatatccttcccgatagcatcatgcatcaacacgacccgcacgttactggtcggataaaccgctaacgaccgcaaatggtattgcaacatcgcatcttccgttttcggctcctgcgccggactcaacgcatcgccgaccgccgcgttccaatcaacccaatcaagccccagttgcgtcaaaccagtatcagctgccgccagtcctttccagctaaaatggccaccaggataacgccacagatgcgtctcaaaatcagcgcctaacacctgcttcaccgctgcctgctccgttttggcctcattctcaataaccgaagcggcgccggttcgtcccggataaagcaaattgtaattgtgcgtcatgctgtgcaacccgatactattgccggcatcatattctgccttcaacaccggtgccgtctcaggcgaaagctgacgacctaccacaaagaatgtggcatgaacacctgcttgattaagaatattcagaacctgcggcgaattgaccgtgttcgggccatcatcgaaggttaaaaacaccactttcttcttgatgttgctggtataaggtgccgtcatttcttttttaacttcggcgacgggataggcgtaggcggtggcggcaggaatgtgggcttgaccgatgtttgacggcaattcagctgaagcttgttctcgttcagcttgttccgctgctcttcgctttctgcttgaagatgcccgccgagacgatgcttgcgctttagatgtgctgatgctgtcagccacagcacgttcatgactcgcctggcgtgcccgcgcctcagctgcatgccggtccaccaatgacttaacggaaagcgcccccgccaaaattaaagtcaaaccgagaacgaccaaccaccactgccatttgaagctgcttttcatgtttaccccgcctatcttttaaacgatatccggttttgagtttaccatgaaggttgggggtacggggtagcggaaggcttgattttaatagtgaggtcatcggattttcactttaaccgcgagtttagccaaaaatcacttgagctgcttctgattcatcatataattcgacttcatgtagtattgaatatcctcgaactttttaatagcctgtttctggcttttccctggcttagtagtcagcttgccattgatcatataatgattcttctgaccaaataccggaacctgtccctcaagattctgcaaaacctgcatgtactgcgaacccttccacccagcatgagtaaagatttcgggcaatacgtacattggactgatggttggaccagtgcccgaaaagtctttcgccattattttctttgcagcttcattggcccacatcacataaggcgtgttgtagtaattctcatagccctcttgggtggattgctttagattaatgccaagcattttgtaagtcgaattttggtcgccaccccacggattgtgatctccccaaaatgccagaaccacgggttgatttaaccgatcaagtttatttgtcagctttagaagtgcatccgatgtctctttaacgccggttagataattgttgatgatggcataatcgtctttgttgtaccctttcttccacggcaacaaaggatcaccatcgaactcagttgaatacgggccatgattttgcatggtcacagtttgattgaagaactgcttaccactcgcattcacctttttcagttgtttgaccagatcattgaaaaccttcgtgtcaggaacaacatcgacgtcagcaacatgttggtcatagtagttatccctgaacaatgtcttttgaaagcctagatagcggtcgatattctgccggttgtagaaccatgcgtcaccaggatgcataaatctagtgacatatttttgttcattaaaatactgaacaaaagaattggtcatgccattgattgggcttagttcagaaaaaccggtcaataccttacgttcagtatcaacagtgccaccaccaaagatggttgttgttaattgacctgccattccttcagaggccacctgatgaagtccagcataaacagagggatcaatttccaaatctgaccattttgaaaaatcttgaaaagcttccaactgaatcgtaatcacattgagccgtttatctgcagggatatcttggtactgataagcgctcaatgccttctttgcagtggcggcattataaccttctggcacaatcacccagtcatttttgaccgaatgaatgaacgagaacatataaccattgacgacataccgatcggcgtctggcccccaaggatcgttgttagctaaagtgtagtaatcatcgactagataataatgattcatcataaatacggagcttataaacaccaaccccagcgttagcaggcgaacccaccagcgaagcgttgttgttttcaaaaaacgacctacaatcactgccagaatcaacaaaacagctataaccaaaaagtatttgacgggtggaatatagctgtatcttgaacccatgttactagcctctgacgccaacgaaatatccgaatactcaaatggataatcgcgatattgcaacataaaatagttaacgagcgcaacgacgatcgctagaacctgccccacaagaattgcgattgttacgcgattaaatagcaaatatcctatcagcatgaaaacaaaaataggcagaatgtttaataaaattaaacgcaggctcttaaagacaacattagtgagatcgaggttataggcggctgaagccatataaatcgtgaccacagcagtgaaggttgccatagcaaacaaagccaccacgtttcttaaaaacagaacagtttgatagcggttgaagcctttaaagctggaaaagaaatgctgatttgcatagattcgggttatattttcaaacgaagtatgatgcacgaacgttttaaaaaaacgcggcgacaccactaacgattccggctgtaaaaaagctattttagcactgagcgttcgggcttttggtaagcgtaagcctttctcatcaatatccaaaccgacgatgcgtgaatctggtactagccaattcaacatgaataccggcacatcagcaacaataaaagtagtagctttgacacgacgtcgactgcggttgcttaaacgtcggccaaattgtcgccactttttttccggcaatggttcatttatgaaatagcgccagtatttgacctgataatccagttcgtctaaccgatgcaaccaaaaaagcaacctagtgattagtatgggaaagacaatccagaatcgccacggcttatagcgcaagtaaaaggtaagcatcgcagttttaacattcaatcgattgaaacgcgtatccagatcaatcacttaacagaacctcccataaaagacggccgtcccccaacggcctttataaataagtttataaaagaagcgtagacagtatatgaaaataatcatatcatgttcatcttgcaaaaggtactgcaactcttaaagctgtcacatgatgccgatatcttggcccacctgacttatccaaaaacgacaaaacgttcagacacacagaaaacctcgggcgctccgctatctaaaatattatttctgaaaacacaaaaaaacgattacctttcttaaaggcaaccgtttctgataagccactaaaacgccatctggtaaggaataaacgtcttataggccccactgattaagaaaatgaggacgaagatcacaccgcacacaccaaccatcgccaaagtccgcgtccgttttggcataatcgaaaacacaatcgttggcagcacaatcgtctcggtcgttgtaccaatagtcgacagacggcccccaatggttgataactgcgaaagtgacaacagcgtcagggtggcaaataagtatacaatcatcaagaatttaaacttagcgcttccgccaattaaggtatccgcaatcataccacgctttaagatatagaatcctgtgacgcagatcaatacctgcatgagcgtcaccggatcaaataaacccgacgagagataactcgcgtttgtcacataaggtgcatatctcggtaacgtgtggacaataatgacactcagaatcttaggtgcaacgaagcccacagctgcaccaagggctaagaatccgatcacccatttaaagttgattttacggaacagtaaccagaatgggtaaattaacaagaagaacaacgctgaaatatggatcgtagccgacaagccaacaatcagtacaaaaggaagcggcttctcgtcatatacaaactttaatgccagcatacaggtcacgcagacaagcgaagcccgaatctgtcccatatcccgcatgaagaaaaagcggctcatgtagtaagcaatcggaatgattgccggacggaaatattcccttgcaaagaaataaaacagcactaaggtcactgttgcccatgccagtaaaaaaagccaaaaaggggcatgcaatccgttaaaaatatttcgtaaaagcaaaaatccaggttcaacctgccctgccgaataatcacctgcataaatggtcttgtatggcaaaaaatcgttaccggtttcatagcgtaatccggcaaccagcgcgagcattataacacctagccatgcccagacagacgacattgtgacacgtccgagtagcatgaaaatgatcataattgcaaagagacctaaataaaaagccacaacatcattctcctattgcctttatgcacccagcgtctcatagtttcggcggtgaagccgtttctcttccaagtttcgacactaggcctgattcaacacagtcccgattaaggctgccggtagttgtcgaacctgtgcgatcgtttgcgcgacatcacgcttcgatggtccatcagccttcgcaacaactaccacgccattagcaagttccgcaataagtcctgcttcactcgcatctgccatcgccggcccatcaatcaagacgacatcaaatctatctttaacttgatcaaggaatgctttgaatgctgaaccagccaacaacgttgccggatcggcaagggattcgcctgcaggtgcaaccgttaacttttgaatcttggtttctataatcaaatcatcagctttaactgatgcggcgtctgcgcctaccaaggatgaaagacctttattaggctgaagatcaaaaaccgctgccaaaattgggcgatgcagattaccttcaaccagcaacgtccgcttcccttccactgcaaaactagcagcaagattcgccgcaacataggacttaccttcaccagcagtggcagaggtgatcagcaaaacagagacatcgtgacgactcgtctgtaatgacaggttgtttctaagcgtccgaaactcctgactagaaacggatgtatcactaacaaattgatgtgcaagttcgtttgtcatggaaaactccttcaaaattggatgtgctcaagtcaacatagcaatatcaacgactgcaaagcttacagtttcttagcagaaataaccccgagaacaggtgctttggcgacctgtacaagcgtttctttagtcttgatcgttgcctgtttgatttctctgagaacaatccaggctaacccaaccaaaaagccgattattgcgccaatcacaaccaaaacaaccggtttcgtaccggctgccacatcactcggcgtcgcctttgccaaaatggtcaccgtgtccgtgtggttggtgatcgtaccgactgtcttttgaaaagcagctgcaacttcatttgcgatcaaagcagcatccttggcatgtttagatgttgcatgaattgagaaggctctagaattgtcttcattgtcaactttaacctgcttttgaagatcaccacttgtgatattgagatggtctttttgtgctagctgcgttgaggcctcatcaaaaactgcagctgttttaaaaagggatttgccagtggccagcagctccgaatcatattgattctggttcagcatctggctaagggactcggtgttgtttttttgctgattgatgacggttagcgccgtcgacgaataggaaggcttcatcattccaaaagcaaaagcaccagctaacacagcacccaccaataaggtgcaaagtgccagccaccaattcttgcgaagcgaaaccattagttctttcatactcaataagttatccatgattcctccatcataaactcatttcttgatcaacagatatcggccatgtctgctgcgtttttatcataccgcagcgacaggaaaagtcatacgtttgaaccggatttaaagaaatttgcaaaggtttttccccacgcaatcgtacctcgtttgatggaggccaatagcgtactatcaatcatcttatagtaatatgttggccatcgccagttgttgtacagcccctgaaccagaatcgggaagaaaagcaagaagtaaatattcccgcctgtcagcttaagaccgagccacaacccaactaagttaacgccagccgagatgagaaacgcttttgtatacggaataatattagcattagcaatatatgacgcatgcactgagtgttgctggtaaagaaaatagtaaaggattaacggcaaaaacacctgtaacgtcggaactgattcaggctttatcaacttcagtagcgggaagatcactaacaaggttccaacagaggcaatgccaaaaagccaaacataagcagcgaccgctttcgatgttttctctcggatcgaatcaaaatcctgcttaacaaagtttgattgcaaaatcggattatatgccccgttgattgctgaagaagctgttccgatagccgaagcaaactggacgccgaccgaataaacacctgtcaccgacagcggcaagaacgcacctgccattagtgacataccttgggaggtgacataattcgacatgctgaccaagccgtcgcgccaagtgttcggccaaatgaacagaaagatttctttaatttcgtgccagttcattggcgatttaagctctttgcgatgagcccgcacctcatcatcctgccagtaaaaatgactgcagatcgttcgaaaaataatgccatacataaccaagccgatgaccggcgacaaaatcgacgggtagactaggaagccaccaagtgtcagcagaatctgtaatgaacgggaaaatacctgcgctttgttgactgagtcgattttgccggagccgcggagcaacgccgaaaagtagccaaaatacaaattaaggaaaagcgagaaacagaaaaccagccaagtccacttatattcggcggcaggtaatttactgaacacaaaagtgttcatgtagatcgtgccgaagatgccgactaagacaacagcaacaatcgcaagaatcatgtaaatagccctggcagcgtgaattgtcgaagccagcaagtggtagttcacaactgtgtgatcatgttccttatcaactccgcgcgattttaatgttttcgcaccagaccaaatatacgcaatgttgcgggcaaatgctgggtcaaatccaaaatcaaacaacgcgatgagaccgttgatacttaaaattaaataccaatagccaatctcttgaggattaaggaaatgaaagatgatcggcagtaggagaaaattgcttgccatcgaaaaaatggtccccgcataactccatacaatactttttctggtcacttcaaaccgatttggcaactcgtttcctcatttcacttagtttcaaaacttgcataaatgtggcgtaaccgctgttgcatcagcggccacgcaaactctttttgatagatattgcgcatcagattagcttctttggcccagtcctgacgcttatcgatcagttgctggaggccagcaccaatgctcttctcagaggttccacaaacagccccaaaaccatacttggttaaccaatttgacatgccggatttctcgaccattaacagcggcttgccaagttccatagcttcaaaaaatttattcggagaagcatataggtgattcttaagcaccggatcatagagcgcgaccaaaatatccgctgtcttctcgatgccattcaccttttcatagggcacaacgcctaaatagtcaattcgtgatgagcgttttgcggcgtcggcaaacatctcctgatattgaccctgaccggccacagtcaaggataatgccggatttgcctcaaccgcgcctaatagttctggcagacacctatatggactcagcccgccaatatagacgattttaaaattcttttgcgccggatcaaatttctcggcatctgctgcaataggactatctaacggtgaattatagatcactgccaaatttttcggcttggccggttcaatttggcggcggcgatcctccgaacaaattaacgtccaatcggctgtcgccatcgctacattttcccaatgaacgaccattttgcgataccatcccggatagtttcgcgtgtcaggcgcatagtcaaagatatcataaacaaatttagttttggtcttcgctacgaccttggccgtcacatatcccgtatgcacattacatgcctgaaccgcgtcatactcgcgtaaatgcttacgaagccaacgatacaaaaatgcctcaaaccgcataaatgcgtaaatcttaaaatatttaaaagaatatgacagcttgatgcccgtgaagattgccttcagacgctgaccatcgaattcaaaggtatctgtcgtcattcggccatgcgggtcttcgcgccagccaagaatcgtaacgtcatgcccagcggcttgcagcgccgcactctcctttagtaatcttgaatcgtcatcgacgtgtccggtcgacacaaacaatatcttcatggttcctcctgatccgttcactttattctcccagcaagcagtatctgtctaatagaagtattttaacaagaacgggaaaacatctaatattctgaatttatatagtaatattttgaccatcaattttttgtcgtgactgaatgatagcagttgtttccaagagtactgcttcatttttttgcgaatatgcttcttaacccatggatcctttgcttcggcaagattttgaaaataaatcgacagccgcctgcggagtatgtactcatcaacatcgttcttaggagctgtgccatttgaacgaagccgctgttcaaccaaatccataaccttagcataatctatcagtttgtctgccctgattttatgcacaatggaattggcatgctgatagtaatcatacaaagtttcacgtaatcggtaaatatgcttcgcacgaaacaaaatcgggacaaaaaaagccatatcttcggcagatttaaaatcggggaaacgatctgctccaattagactccttgcaaaaatcttgttatgcggaaagcctccaatcggatcatgcgctccagtcagcatttcatggagaacagcagctaaatcggtcttctgcgcagtcttgggcgtttgatcgtcagatgaagcggtatcctgttcagttaatgaacggtagtcaaaaatcagtaggtcaaaatcaatgtcattaataacttttagaattctattgatggcgtttggctgaagtgtatcatcagcgtctacaaaccagatatatttgccgtgagcgcgttcgagtccagcattacgcgcaaatgcaacacctgcgtgagcttcgtcgatcaataaactatttgtgtgcacctcatggaagtgctgaagcagttgggcactgttatcggtcgaaccattatcaaccaaaacgacttccaccgttggggggattgcgcctagactcttaaatagtcggggtaaatagttctggctattaaatactggaataatgatgctcagttgatcgttcatggtgccctccgtttaatgttatagcgccttacttgctttactaactttaaggcatagcagaccagaactgcgcctgacgccataaaaataaagccctgcaccccggtgacagaaacaccgctaaaacagctcgtgactttctcgagcattataccacagcttggtacctttcctgagacaatcttgcagatccttgcggcgtctgaatgaataaatccatatgtgctttcataaactcacctaatccaaaccatgcctatggtaaaatattttggtcatatgattgatagcttgctaaaactcgatcaccggggcgaaacacattggtcatttcccaaccgtgtttgtatgacacgatatcaattgaatgctagctctgtttctaggcacgatatacataataaggggtaaaaatcaaccatgaaaatcgacagtaaacgcttgatcaagagcgtgaccatcatattaatcctatctgtggttagcttattcaatgttcttcctgttctaaagcttaactttgcgactgcatatctaggcgatgatttctttttccacgttgagagggtcctagcgctgagcaacatcttccagagtccagtaaactttaacgtctttgggcaagcagcgacgatggccaatatcttttatccttgggaaacggtctatccgctttatcttatttatgccgccactggtgactttatcttcagttataagctcttctacttcctgttaacgttagtaactgcgctattagcttactggtgcatctacaaaatatcaaagaacacatttagcgcattgtgtttttccgctctttatattttctcattctacagaatctcaaacttcttcgttcgagcggcacttggcgaagttgtcagtatgaccttcttgccgctggtactattaggattatattatgttttgtttgcagactttaaaaaatggcgcgtactcacgatcggcatgacactagtgacgtactcgcacgcgttatcgctatttatgacaagtgttctcatcattgtggcaacaattgccacgattggctttacagacgacaaaatgaaacgtctgattaatcttgttaaagcgggtttctggacattcttactgtgttcgccttatttatttttggtcgccaacacatcgctaaaaaacgatctttatattaactggacccagccgctaaaaggcatgtcacttctgccgtggctggctaactcattgggcaatcaaatgtatccaaatccagacgttaaaagcagtcttggcgcctcagtcgtcattgcactagccgtcgcattagtcatcttcgcattttcaaagagcgttcgtacacccttcaacgcattttgtttatttggtggcgttggcattctcctgctgtcaacttccctcttcccctgggctttgacaaaccaaacactcttcagccgaattcagttcgtgtggcgattaaacgcctatacgtctctgctaattttagccagcttcagcatgctggttggcatgatgatgcctaagaaaatgccggcgctaaaaccaattttgctggtaggattagctgtttgcctaacgattagcagcggatctgcttttgcgacttttgccaaaaataaggcagaaaagacgccacgcgatccccaaattgccaaactagcgcgaaatatcttttatggtgattattcgcctaaacaagtgctcgacacgaaaaatctccaacaggtcttgcaaaaacaatattttcttaatcaccgaccaatccaacccactgccagctacacagacagtatctatacaataaaggtctctaatacaactggtaaagatgcaattttgaaagctcctgtgttctggtactcctaccaaactgttaccgtcaacggccaacccgcaacttcaaaaatgtctgctgcaggaacgaccatcgtcaaaattccaagcggtgaagtgaccgttaccatttcatatcattacccgaagcttcttttaggattcatcttagtcgcattattgagcttgtttcttctaacaatgtcgacggggcccgtcaaaaaagtcatgaccaatgcccctttcaccaaaatagtgcactaggttaaaaattgtaaactaattatttttgagaaatattcgtcaataagcatataaaaactgcctggaatgtcattaattctcccaggcagtttttgcgtatgttacttttgaacacttttattttttgaaaacctcatcttaattttcataccgcaataaaccagcagaaagataactgtaaatgcattaacccaaacggcaagccagaacagtttaaaaggttgatatcccactgtcacggtgttcttacctttgtgtgaggttacaatcaacgccccgatgttactgcgttggtattgcgaagaacgcaatactcgcccattcaatctaactgtagaatgtttataaacaatcaccggtacgagcgtttgtttccgactttttgcctgccatgtcatcacaagttggctctccgcattaatggcttttttgatattcaacgggttatttaaaatttgatttttgtaagcatcgtaggcaaaagtggtatttcctgccgttgccaccggtaaatagtccggcgtgtttttggtgacaacactgaaaacattggattgatcataagctcggttaaataaatcacgtatttctgcctgattttgcaccgaggagtccgcactaacagccaattgatcactttgccaagccgttgccttctcgttgacccatgtgtaaccgttgattagattcaatcctgcaacactgacaaaaagcgccgtcattagccgtaacttttgtgaaacgatgttggggacaaatctctgaacagatagagcggtccctaagataatcattgtgagcgcaatcacgttaaatcgttgtggaaattgaacggtctgaataaccggaaaatgggtggccaagaaattccatggaaagagtggcgaacttagccataaaaacaaaaggccatcaaggttgatgagcttctcagcgatggtcaattgcttccaactcagcccagcaaaaaccagttgcaaaacgatgatcgcagacaaaactaatcccagatccaaccgtgtcatattgccaagcgacaatcgtgaagcactaccgaggagatcttcaacccgatatggcatgacaaggcgttcactatgtaaatccatgatggccgcaagcgtgaccgcatttaaacctacagcaaccgcaacggcgcttcccgcagcaacgactgtttgccaacgattcttcgctaaatacagccccggaataaagaaaactgcagcgcttaaaacatagatcaacgctgtaaaattctgtactgccattaagattgctgcagataggccaaacaaaatcggatttataggtttttggtggtttgtcaccattcgaatcagcggaatagttgtgataggcaatagcgctgctccccagcccctcaatgcggcatctgttacatagaagattactaacggtgtccccatgtataagacgcccgcggcaaacgctatttgacgtttaattcgacaataccgtgccaaaaagtacatgccgctgcctgccgtaaacaaacataaaaaactagaaataagttcagctctaaaccaagttttaacgataaccaagataataccgtgcagataggcaaacgcactgccatagacggcattgacgattcggccagattgcttaaatgaataaatcgattggaagaaattaaatttgccggttttgatttgcatggcagcttcataaaaacgattccagtgaaattcccaatcatcaccgactgccaaggcatggtaattgatttgtggcgataaaacaatcagtgccaccaccatcatagcagcaatccatatcacgtcatgcttccatcctggcttacttgcttcttgcacgtttattcctccccaaaatcgccaacttatccaagtattaacttactcccaatagtttacacgtttcgacgtaagaagataaccctatcattttctaacagcgcctttttcttcatcaaaaaacgccccgcatcaactgtagaatgaatctactcgtctttgcaggacgttaaacctcatgtgagataatcaggtttttaactatttaactgtcaaaccgcccttgtcaatccaatattcatgaccatcagcaaacttcaccttgacataggttccgcgatcggtcttttgctcaaccgaggcgtgaaccttctgtccatcgtattgcttggcattatcgttgccgacaagcgtactgatgctggtgtgatatggtccatcactgtaaagaccatcaacacggtccttttgattgatcgtcgcatcgtaattaacattattcgttgaaagaatcggacttaatgacgaaaagcttgtaagcgcgagtttatccgtccaataagtctgaccgtttgctaaacgaatctgtacataggtcgaatgcgttgaacgagaagtcgttgcttcggtaagcacctgaaccaactgaccgtttaatgacttagcgttgtcattaccgattgcggttgtagctgaggtgtgataaggaccgtttgcatacaacccgtcggcacgatgactttgatcaacgatagcaagatagttcacggattttttgagaagaaccttgtcataccctgaattatcgccggtttgcaaaccacgtttatcaatccagaaggtctgcccatcagctaaacgtacctgggcataagtcgtgccgccagctctgctggtagtggcttcagcaataacctgaaccttttggccgtcatacttagttgcatcactgttaccaccagatgttgcggcagaggtatggtacgggccggcggtataaataccatcgccgcgaccttgttgttcaattgtggctgaatagtccactgtctgttgcgaaacaatgctgtcaaacgaaaactgtgcggtaccattcttatcaatccagaaaactttgccatcctgggctttaacttgcagataagtgccacgtgatgtaacggtttcagcttgaacgtggacattctgattgttgtaattgacaccattaaagttagaaatagcagtggaagcactggtatgatacggtgcatcaaaataaatgccgtctttacgggtatcctgattaacaatggtgacatcataatttacagatttggttgacagaattggatcatacgaaggtgctggcgcagcaactgtatttggttgcgtcaacaggcctgtataatcaactgagacgtcaactggcttggatgcaccaggcagataagccagtgaagaaaactgccatgcaccaaagtcttgattccacatcgaatttgcacttggcgtatacggatactgtgcaatccaggtccgattctggccaactgtatcagccgcagccttcatataagcaaagtttttaaaagtatacacgacgtgatgagtatagccgcgctgattaagagtttgccaaaatgcgttcaaattcgcactaacgtccccccctatatcagcggcctcgagatcagcaataacattagtttccttaccaacattcaatttgtcaagcacattagcaaagtaatttgcttcagagactgcttcagcgtttgaagcaaaatgaacatagtgataaaccgaaactgtcataccggcattacgtgcaaattgaatttgatctgaagcggaagagttttcataaaatgtgccttcagatgtcttaacaacggctcctttaaccccaagtgcgtgcagcgtattaaagctatcttgattcatccagctttgccagctggacacatctacgacatctgtccgtggtactgacttatccccaatggtaaagctcatcactgtcggcgtctgggccgcaaatgtctgtacatttgtctgtggtaatgctgcctgtaatgctgctccgccagcttgtgtgcttgagaatgatcgagcgcttgtcgccgcatttgcaccagatgcagtgccactatcaagattagaatgtccattcatagcaggaactgatacggtttggtcctgactcgtctgacttgtttgggcgtttgcacctgtgccttcatcagctgcagatactggtgtccctaaaacaagctgcgaaaacagaattgacgatgcaatcgccgcagatgcccaaaataacttattcttcatttttttctcctttttccccataagtaaactcctccccaaatttttcaaatttcataacaggctcattatacatggagatcaaccgcatttaaagaaacaatatgattacaaattaacagtttctttatattacagacgtttagaacgcgttgcttagcgtaattcttcagaaaaatcgcgcgtaaacatttttttctgtatctttgtgagccacccataaagcgctggtactgctaataaaaacaaaacatagtactgctcaaatcggtatcgtgcttgggtttccatgaagatataggcgaagaagaacatgccgaaaaccactgccggcaaaaggtaactgatccgactcgtcaaccatttttcggtgacaacgcgtttaaatgttgccagaatcgtacctgcgtaaatgaccataccggagaaatttagcgacgaaatcaataagggatgttgatcaagaaatggttgattgccgccaagattatactgattatccacattgccaataaagccggtgaagcgtttcatgatttcttgtatgtccaaaccatgggtaaagacataccggagtttttcagcagctgcttgtttgtaaagcgaataattaaaatgatattcctttaggtcatagtaaagttgtgattttcgggcgctagtcgtgtatttcccgctaacgcctttgcctgtcagcccaatcaagaacttgtagtatggattgccgcccttgatgccataaggcgctataccagaaagaataaatagctgattaatgagccagcctaagccccaaaaagctactagaaatgcaacggtctcaagcaaacgctggcggctcttttgctgaactgcctgaatggctagtgttacaacaatcgcaattgccactacgaccgctgttggccgtaaaacctgtgcaatcgtgatgcagacagcggctatcaacaaattaggccaggatcgacgctttaaaacaaaataaacagccaatgcttcaagcaacaatccctcatgctgattgttgatgattcctaccccaataaacgcaaatgggaaaaaggtaaacagcgctgcaccaaagatagctcgatggccatcacaaaacagtctgattgttttgtatagcactaaggttgttcccgtcatgacaagcatttcaacaattttaaaaaatagcagccgctcgccaaacacacgcattaacagcgaaaggtaataggcataaccaatctggaaattataatatctaaaataatcactcggtctagcggcttgagccttaaacgtaccgttgacgatatcatgtgcaccttcaagcaagacctgataatcgctaactggtactggccgaaagataaagttccaaaaactcagaaacacaatggcaagcaccgttaacaaaagcaacgcttgacgatcagaaagctccaactgactcagcttaaagattaagaaaacgccgaccagaatacccatgccacccaacacaaaagccggcgtatcccaagccgaaccctgtagtatttgtatcttaaaaagacacagtaaacaaaaggcaaaaacagcaacaagcagatatcgcccaagtttattgattaatgcattaatactctctagaagaacaattgtacgtcgtcccattctccacttcttccccttcttctcgcattttaaaacgcctcgtcatcgggttcatataccccatcttgaatatctatgtataaagactggcatccaaggacaatttatgcgtcgtcaagctttaataaccgcgtgacaactgcaattatagtttgagtagacacctgcctcccggataaatagcttcaaggccacgattaactcatgttatactggatttcgggcatcgatatgacatcggtttattaacggaggaacgtttactttggatcttattctattaccattcatcggctttttatttgctagcatacgtccaagtcagaaccttgaagaaggccacctgggaaaaagtgccactaacaacctaaaaggcatcagcatcatctttatcattctgcatcacatcaatcaagagctcaatggtgttagcggtactttctttgcttcgcgactaaccatggctggtcgactcggcgttgccattttcttttttgtctccggttacggtattatgcggcagtatcagatcaaggggccatcttacttaaagaacttcctaccccatcgtctgctgcccattattttactttatctactagcaatgctgcttatcttcccgatcaaacaccagctgatgggactgacttttagccaagctgccatttcgatgaccaatggcgcgccgttcgtgaatgacagttggtttgtcttagcaattatttttttctactttgcattttggctcggtatgcaaatctcgcgtggtcactcgctaccattatttgccattttgtttttgttgaccggtctttacacggtttatatttgggataaaggcatgggcgaatggttagtcaacgcagcctttgtctttccgaccggtgtcctctttgctttttatgaagaccgcttcatgccgcttatccgccgtttctatttgccgatcatgttagggacgctgacggcatttgcgcttttctttactctagatgaaatgcataatcagttaaggttccgattctttagcgaagtcttcttcgctttagctgtcatgatggtcagctatcgcgttgagttttcgagcaagctctttttaatcagcagcgcatggtcgttaaacctgtatctgtatcatcccttcatcgccagctggttacatacgattcccgcgattggtgcccatagcgtcgtctactcaatcatggtgatcttattaagctatttcgttgccggaatcattgcctatgtacaagttaccatcaaacaactgaggtccaaacgactggcatcaagaagtgcttgataagtaagcaagcagaaacaattcaggccgacttatggcctttttattttgctcgttttaaaaaacagtttatggtttccgctgcttttcaacatctttgtctgcttttggctgcttagatggttcatcatgccaagtctgatcactgataataaaccgcgggcgatgcttggtttccagatacgttttccccacgtattcaccgatcacgcctaaactgagcagctgaatgccacccaaaaatgaaacaatgcaaacaattgaagcccagccagcaacagtagcacccttaattgccatgatgacagcccagatcgtaccgatgaagcctaagatactgacgacggcacccagttcggcgataaatacgatcggcttgattgacagactcgtaacgccattaatcgctaaggcaatcatttttgacagagggtaatggctcttacctgccaaacgttcgtgcctttcataatagactgacgtacttttaaaaccaacaagggggaacatgccgcgcaggaagagattgacctccttaaaatcggctaaatgttgcaacaccttgctgctggccaaccgatagtcagcatgattgtaaacaacatctacccccatcacgcgcaagaaccgataaaaagcttgggcactgacacgtttgaaccatgaatcactttttcggttagaacggacgccgtaaacaacttcacaaccatctgcataagccgctagcatatcggccatcgcgttaaggtcatcctgaccgtcagcatcaattgaaatggttacatcggcatggtcctttgcaaccatcaatccggccaaaactgcattttgatgtccgcgattacgactttgttgaatccccaaataatgcggatctgtttgggcaaagttttgaattaacggccacgtttgatcttttgagccatcatccacaaacaggatccggctggttgctgcgaccttttttgcttcaatgaactcagaaagcttggctagaaatcgcggagccgtgattggtaagactttttcttcgttataacaaggaatcacgatccacaacacaggaagtgccatcttgtatccccccttgacacacgttcgccaccacaagaatctgtggtggcgagtatgacgtgcatgtaactcatttacttgaacggtgctggtcgcgtttcacgttttccgaattcatacaaaatcgcatctaaaatccgctgcgaggcgtgcccatcgccatacggattcttggcatcggccatgcgttgatattcgacttgatcatccagcaactgcaacattgcttttttcaccgtttgcggatcggtaccgactagcttcaaagtcccggcctgaaccccttccggacgctcagtggtgtcacgcaacaccaaaaccggcttgcccagtgaaggtgcttcttcttgcaccccaccggaatcggtcatgatgaaatagctgcgcgcagccaagttatggaagtcgaccacatccagcggttcaatcagatgaatccgttggtgatgacctaaaatcgaatcggctgcttcctgaaccaccggatttaaatgcactgggtaaatgatctcaatgtctggatgactttcaaccacatcccgcatcaccttgaagacgcgccgcattggttcgccttgattttctcgccgatgcatcgtgactaagatcattttcttgttgggatcaatcaggtccagaacctcgtgatgataatcatcctgaacggtttgatcgagcgcatcaatcgccgtgttgccggtcacaaaaatctgcttgtcaggatgatgttcttgtaacaaattcgcgcgactctgagctgtcggcgcaaaatacagatcactcaaaacatcggttaactggcgattcatttcttccggatacgggctgtacttgttccacgtgcgcaaccccgcttcgacgtgaccgactttggtttgttgataaaaggccgaaatactagccgcaaatgtcgtggtcgtatcgccatgaactagcacaatatctggctcttccttggcaatgatctgtccaagctttaacaaaacattgctggtaatatccgccaatgtctggcgtgatttcatgatgttcaagtcgtagcttggctgaatatggaaaatcgtcaacacctgatccaacatttcgcgatgctggccggtaaccacggtgacctcctcaaactcatcactacgccgtttaagtcccagaaccaccggcgccattttaattgcttccggtcgggttccgaataccgtcataactttgatctttgccaagttggcacctcactctttttcttgattaaaaaccgccgcttgattgcgacggatatttttaaactcagaaaaagtataacagattatcaggttagaatctaaacgacctgaggcttttgcaacgcaaatcgacttgtcaccttagcgtgttgcagtcccttcctggatcgtttgcatgggttccagaccggagatcatgtacaaagcattgccttctgtccacgtaatttgattttgccgggtattcgcattcgttaccgccaagtccactgttccgtgtccatccggtacaggcaaggcattttgggcaaaccaggagactgcctgcttggcgagcggtaacggatcttcgccattgaccgtagatgctttaacggtcacggtccagcgaccttcattccaggtcaggtaggatgatccggctgcaccttgactcgcggcataaataccatctccaatggcgacttggcgcaatccctgcgtcgatcgtgctggggccacctgcgcctgtgcgtcagctgcactcgcatacgttttcttctgaatggccaactcggcattgatattctgcaaagttggatcgttatatggtaacgctgactgccctggactgaagaaaatcgaataattcgcttgatcaccagttgcaaagatatttaaatgctgtgagtttgcaaccgggtatgaagcaggccacttggcatttggaatctggttaaatacagcttgtttcagtgttgccaatctctggtcatttgacgttgtaccactcgaggccgctgttgcagctttttgcccagtctgactggtagttgaagcagcaatctgactactcgattgcgcggaactttgacttgcgctagtcttcccattagacttttttgctgatgcttttttggccttatgactcgtctggctagtcttaacagattctttttggctggtactgctttgattactttgcccgcaacccgcagcaaagaccagcagcaacaccggtagtactaacagcgtcttcttcatttaaaacgcctcccccttaatataacttaagtatatgctttaattataaatagttcacttaattgacgcacctactggcggggagagccaagttattaagaaaatcgttaaacatttaaacgtatgcaaaaatcggctccggaataacaaacttgtctttccggatccgattcattcgaatatgctattagttccaccgccattgaccagcttaaacaccggatttaagctattacgacaggtgggtgatgtcctgctgaaccaccaagtcatgcaacttctgacgttccggttccgtgtcttcctcaagtccctgcgaggaaaccttgtcaaataagaccttaatggtttgtagcaaaatacgggcatctagaaaaatgctgtaagtcttgatatacagcagatcaaacttcaatttactgtggtagtcggaagcgtatttgccataaacctgcgcgtaaccagtaatcccggcgcgaacattatgacgcagatagtaatgcggttcctgttggttaaactgattgacgaaatacggacgttctggacgcggcccaacgatggacatgtcaccttttaaaacattaaagatctgtggcaattcatccaatcggaacttgcgtaaatatttaccaacgggggtaatccgcgaatcatgtgctttagctaacactgggccggactttgcctcagcagttgccgacatggtacggaacttcaaaatcttaaattctttttgattcagcgtaatccgtgtctgtttataaatcaccggacctggtgaagttaatttcaccaacaaagccgtgatcaacataaaaggtgatgcaacgatcagcatcaacaaggcaacgacaatgtcaaaaatccgtttaaggacggcactttcgggcttaatgcgaaattgtgtgatacccatgacgctttcatcttcgaaattcattagatttggccgtaacatcatcaagttatcaaacgttgatggcaacaagatggtcttttcttttttaatgatgatatcgatgatttcccgccgttgttcatcgggtaagctcttggtgagatagaaaatatccaccttatcaataatctttttggcgttctcaacaaagtgatctgagataacgtaggttactttatgtttgttgttcttagcagaatggaagttctccaaaacagcaggtaattcatgttcatacgaaagcacggccaccttgtagttactcgtaaagtggatgtacatgtaatatatgaaaacgcgccaaataccaagaatcagaatactaagcacaaacgaatatgcaagcaccagtcttggaaatgcaaagaaccgtcccatgaacgtgatcatggttaatcccaatatggtaatcgtctgggccaataccgtattgaaaataatgtcactgattcgccgattatagtaaacgtagacgcctaagaaaaagttaacgaacagaaagagcagcgaaatgtaaatggctgaaccttcatacatcttaaagttccattcgggaatctccgcaccaaaccgccagtaaaaggcgagcaatatacttaaattaaaaagaccgacatcgccgatcatcgtcaacagtcgtttaagaccgttccattcggcactttgtttcatacagcaaccctctcagtaaatatctttggttgaaaacagctcactcattatagcatatgttcggtatttgtctgctgccacgaacaactactggcaaggcacttgcgccgaaactaacgggacaacatcatcgttgataaggaatgccatctcgttcagcgcttttaatcccacgccgcgcagaaatatccgcccacaaatagggaaacagcactttgaagagatgctttagccgaccacgtaagccgacattggcgcttccccatgagttatcgaagagatgttccatgtagttagcattttgattccgacttgcatatgtaaaatagtcgcgtggataaaccacgattcccggttccaactcttgacgctgcccattcattcgaaaatcaggataaagtcgcatcaggatttttgtcacaaccggattactggtcatcctctgcatatcatcctgcaactcaggaaatttccgcccagcatagacatccaggatttcggctaacagcggcgttttggcttcggcgccgataaacgatgtcaaaatactattatcgtattgaaaaccccaaaccatcttatggttcaaaaatggttcaagatccttcttgataatcatatcggtgtcaagataaaatccaccatactgatacaagaccgcgtaccgcaattcgtctgcagcataaccgagcttacccgcttggtacattttttcagaaaatgcatattttttcaaatcaaagtttttgtcgttccagaacttgaattcccagtccggcagcttctctttccactcctgaacccgatcctcgataaacgatggcggtgtgctgccaaaccaggcataatgaataatcttaggtatcataggcttccccctctttaaatgtcagcgtttgtcggtaatacccatcagtgaataatgcaaaaagtaatataa

SEQ ID NO: 319 - DNA, 45314 bp, Lactobacillus casei
tcttaggtatcataggcttccccctctttaaatgtcagcgtttgtcggtaatacccatcagtgaataatgcaaaaagtaatataaacttttaaaaatattgagatgttcatgctgccgataaatcgtccatgtccactgagccgcctgcaatttgtttgaactcagcgatgtctgatgcttccgatattgagccaagattcggtcagacgcaaggtaggcaagcgttccgccacgggcaatcgacaaccagcaagcgtaatcttcatgatttattttaggaaatggatacttttgggcaatttcccgagtcaacatgaccgtcaatagtccgatccgattgccttttagcatttcgtggtaatccagacgggcttcagaaatcttacgctcgccgattttagtgccatgatcgtccaccacatcgtacgagcaataagagaaggctgcttgatgctgctgcataaatgcgacctgaagctttaatttatcgggaagccacaaatcgtcgctgtccaaaaaagcaacgtactgcccctcagcatttgccacaccaacgttgcgggcattggcaacaccctgattgtcatcgaggtgaacaaaccggattcgactgtcgctagcggccaactgttgaccgacttccgctgtctgatcagtcgaatcatcgtcaataatgagcaattcaaaatctttaaaagtctggtctaaaactgactgcacggtcttcggaagatacgctgcagcattgtaagctggcatcacaacggaaactactggtgtcttaaccaaaatatctctcctacaagcatcaattaaagcaaacaacacgaaaaatgaccagccatccgttacgcgatgaccgatcaatcttactattgaaccgacgccacatacttcgccagcccttcagcaagcggcgtatgggtcatgaaatcaaactgatccagtttagctgtctgggcatacgaatcgcgaatgtcacccaaacgtggcgctttgtgcgtcgcgtgaagcgttttgccagtgagcttttcgagttccttagccacttgatttagacttgtttgcttgccatttgccacgttgaagacatcatcgcgcgcgcttggcgtttctagcaagccgcgaatggcatgcaccacgtcgccgacatagataaagtcgcgggtttgttcaccatccccgaagaatgtgaatggcttgtccgctttcaacgcgtccatcataattgacagaacaccactgtacggcgattttggattttgttttggcccgtaaacattgaaaaagcgggtgcagaccattggcatatcatataaacgcccgtagtttaagaccgcgcgttcggttgcgaacttgtcgaccgcgtattgggtcagcggcttaaccgccatgtcctctttctttggcagttcaggcgaatcgccataaacagcggctgaactggcaaagaaaagtttcttgtaggcgatcttttgtgtccgcaaggtttcaatgatatttaaattggcttcctggttaacctggtgggttgcgtatggccgttcaacggaatcggcaacactggcaatggctgccaacagcacgatgtaatcgaactggccttccatcagaagttgggacatgaaggcatgatcggtgatgctatgttcatagaatgtaatccggctggaatcaggaatgttggttcgcaagcccatcgacaaatcatcgacaatggtgatcgtattatcgggatccgttaacaacagctcggttaaattggatccgataaacccggcgccaccggtcactaagtaactactcaagataatttcctccgtcttgctggttttatttctctcctatggtatcacagccgcgcccgaaccaccgcagcttataccaaatgttaggaaaatgataagaaccgttccagatggcatcccgtttaccagtaccgcacccggaaaaatgaatccgtcccgccatatactaaatcgactctggcagcgcacatggatgtgctgtcagagccgattttgatgatgttcacctgcttaaaaacctagttcgactgcaccaatcgccgatccaaccagcgacttgccaacgacaaggcatagttgacaacaaaatacatcacagctaacgcaacaaacattggaatcatgtagttaatgttctgcccatatatgatttgcgcatggtacgtcgcttctggcaacaggataattgtagccagtgaggtgtctttgaccagtgagataaactggctgacaatcggcggaatcattttcttcagcgcctggggcatgatgatgtagcgcatggcctgataaaacgttaagccattgctgcgggctgcttccatttgcccacgcgggacggcgttgatgcctgaccggacgatttcagccagcatcgccgattcgaaaatgctcattgccactatggccgcaatgatgacgttcaggcgaatgccgatttccggcagcgcaaagtacgtaaagaacaagatcagcagcagtggcaagttccgaatcacgtcaataacaaagccgacaatcgcggaaaagtatttaatgttgacataacgcgctaagcctaaaatcaccccgagaacgaagctgaagaagatggaagcaacagaaacttccaaggtcacgcctagtccctgaagcaggtagcgtaagttgatccaagaatacgcgtcgataaaattatgcatcagtcctgctcctttctatgcggtgacccactttttctcaagataacgcatcagataacttaacggcatggtcaagatgagataaaggatcccgacgatcaggtaagtatcgaacgtcgaaaaggtcgttgccgcaatgagtttgccttgatacatcagatcgaagccggcaacgaaggccagaaccgaactgtttttaaccaagttaatgaactgattgcccagcggcgggatcacaattttaaatgcttgcgggaaaatgatctgcgtcatcgcttgcgtataactcattccgatactgcgagcaccttccatttggccgctgggaaccgcttcgatccctgcgcgtacggtttcggcgataaacgcactcgtatagattaacaggccaatggtgccggcggtgaagccatcgattttgacgataaactgcggcacgatcacatagaaagccaacgtgatgaccagcaacggaatgttccgcaccacctcgacataaattcggccgatgatacgcagcgccttgaatggggaaatttccatcaacgcaaacaaggtgccgatgatcagactgccgatcaatgcaagaatactggccgccaaggtatagccaagtccggaaagaaaggtgttccagttattggtaagaatcgaccacatatcattccacctccttaagactgaaccctggcacatcgccaaaccactttttgattagcttggcataggtgccgttttgcttgagttgtttgatcgccttattgaccgccttgacaaacggccgctgccctttgttaatggcaatcccataaggctccttggtaaaggtgccaccagtaacaatgtagcggttatcctgttcagacatcccgtacaagatcccattatcggtagtaagtgcgtctccttgcccggacttcaacgcggtaaacgcttgagcataatcggccagctgaagcacggttgtctccggcgcggcttttttgacgttgtcgaccgagttggaaccctgaacgccaatgacctttgtccctttcttcaggtccttcacggttttaatgggactgccttttttaaccaaaagactttggccggcattaaaataaacatcggaaaaatccagaatcttctgacgctctggggtaatcgtcatggtagcgatcacggcgtcaacgttaccgcctttgagcataggtacccgggtatcactagtcacctgaaccagctgggcgttccccttcttgcctaaaatctgtttggtcacagctttggccatatcaacgtcaaagccttcgattttatcggttttaatattcatcaagccaaaaagtcgggtgtcggctttaacgccccacacaatggtattggtcgccttggcatggctcaaaatatcccgatccgcgacacttttcccgcaactgctaagcggtatcatcattaacaacaacaccagcggcaggagcatgcgtttccacatctttttcatttaacacacctgctttcataaagtatcccatccgtaactggtcttgttgggctaatgattgatgatcttactgatgaattccttggcccgcggttcttgcggatcatcgaagaattggttgacatcgctggagtcgaccagaatctggccatcatccatgaaaacaatccgattgccgacgtggcgggcaaagcccatttcatgggtgactacaaccattgtcatcccttgctcggcgattttttgcataacatccagcacatcaccgatcatttccggatccagcgcactggtcggttcgtcgaacaaaatggctttcggcttcatagcaagactgcgggcaatggcgacccgctgctgctgaccaccggataattcacccggaaaactgtccgccttgctttccagcccgaccatcttaagcaaatcgcgggcttcctgttcaacttcggctttatcacgcttcagcaccagatcaggaccgagcgtgacattttgcaacacgttcttgttggcatacaggttaaaatgttggaaaaccataccgacatttttacggatgcggttcatatcggttttcttgtcggctaaatcaaaatcattgacaatcaactggcctgacgtgatccgctcaagcccattgatgcagcgcaacaaggtgcttttaccagacccggaaggcccgattatcgtgaccacctcaccacgatcgactgttagattaatattttttaatgcttggaatttgccaaaatacttgttaacgtcatgaaattcaatcattgacattttggaggacctccttgggttcactagctcttatcatggattttacatagaaaactaatgatgcgcaaatatttcttttaaaaattgagcatttattcggtggaaaaaacgaaaaatgccggtttttgggacttttgcggatgggaccgcgatgtggaaatttggtgtgcagatattgcagaaacggatggcttgtttctcggcatgacgaaaaggctttcgcacgcaacataatattttatctgtattcacaaacaaagccaagcaaaaagccgcggcacctcaccttgactgatcgtcaacgtgaaatgtcgtgacttgctgacactattttcgtacgggaagtgacactgtgtcacttccttatttctgatgccttctactttctcgggttggaaattgctgggactcttgctgctccagcttggtcgtcgcatcgtcatcaagggcgtggcgtccttctctggtctcctgtggcgcttctggctggcgacccgccactggatgcgtgtcagtgtctgccttttcttgagacgctgctggcgacttatcctgataagccagctgcactgtcaggctgtatggctgcgattctttacgcaacccactgcgacccaataacttctgctcgccgccaatcagaaaaacgttggccgccaccagatgatagtcctgcgccgctttttcaaccggcaacaaacccacccgctccacagttgcgatgggtttggcagtcagcgcgtttaagccaccggtaataatcagctgatcgttgacatgttgcaaatcaaaaaacggcaacggatagggtgcgccaatagcgagaaccggttgctgcgtctcctgcgcaacccgttcaatcgctttgtcgtccaagccctgataattcaagctcaaaacgccttgcttaaccaaactggcaaccaatgcatcaagattcgcttgttggtcatcggttagcgtaacatcggccgtcagcagttgctcttgagaaaacacgccattagccggtgccgcgcctaattgcgttttcagctcattttcaacagcggttttctttgcaccattgctgcccagccatttttcaactgctggcgaaatatcgaatcgcgttgttttgttcgtaaaataataaaggaagttcaacccaataaaatacaaaaagacaacaaacgccagcaggaacaacgccccgcggatccgaaagtccggatagcgcaggttttcaatggcaacatagagcaagtaaaaattagcgaaaaatgccacccacgtgaaggccttgcctttgggtttatcggcaatgttaaagtagcccagcacgcggttgataatatcaataacagttaacatgatttcatcctttccgcggcttattggccattcgtgccggttgtgtcagttccttgatcagtacttgtctggttctgatcagtcgtttgcccattattggtggaagcggtgcttggtgtggacgtcacagaagatgttgacgcctttgaggtcgaagttgccgaacttggtgtcgacggtgcactcgcggtactggtcgtttcgttgttgttctcctcatgactcggctgcgtctgcgactggctggcggcagacggctgggacgctgaagtttgactggtttcaggctttgacgatgctgaacgcgcggccttagaagccgattcggattttattttggataccaacgaactctgatctgttgccgatttaggctgattgaccgggttaatcgtattcacaatgttatacgcactaatcaaaacaatcagcgaaacaatggcagtcggcggtaataatggcggtgttcgataagccatgtagccagctcctttcattcatcgtttcattttaccccaaaagtagcaggaagcaccttaagttaccgctaaaattatacgctacttatagcgttggccaaagtggtgcgcttttcaacaatcgtgagatgctaccaatgcatgagccacatttgaaacatgcaacacgacgcataactaaaaaagacatcagagaatggctatctctggtgccgatacatctacggagcacatctgcgtgatttacttgcaactgttcgttaggcattagcttcttttaaactgttcgcccgcttttggcattccgcgcacaaaccataaagttcaaaattgtggctttgaattttagcgcccggaacctgatcttcaaagtaattcagcggacacattttaagttcaatcactttgccgcagttcgtacagataaaatggtgatgatgcggatgctggaaatcacactgcagtttaaccacgatttggtcatcttgcatgcgactttccagaatgcccatttcgataaacgatttgacgttgcgataaatcgtatcatgtgacaccccgggaaattgcgtgcgcatataccgatccagaatcgtgacggccgtataccgatgctggttcctgcccagatagtccaccattgactcacgttgtttggtgacccggtaaccgtgttgttttaactgctttaatgcaattgttgtgttatccatggaaataagctcctttggcttgacactttaacttaagacgtgtaatgtatcaaatcgtactgattacgattagtaccactcagtgtaacacgcctgacaggaggaagcaatatggctgaaaaaaccgattatgcatctgccgcacgtcgtttgaaaagtaagaatcccaaaacccgttcacgcgctaaacgtgtgattaaggccgttaagaaaccgactaaataaccattgacagataccaaaatagagtgaacgtggccttttgctatcacatagcgaagggccacgttttattttcgttccggattcagcgatattaacccgcagcttttcagcgccaggtccttcatgaaccgatcaacctgttcccgtgcttcatcccaactgtcatttttgatcaccgtcgcaaacggcttgagttcatccggcaaggttaaatcgcgcttatattcaggactcttcagccgcgccgccaccatcgccggatcatcgccgcgacccagtaagcgatctttcaaaacagtcggatcatcaatggtgaggaataataccacaacctctttagggagctcctgaacataagtgatcgcccctttagtatccaggacaatacttaaaaaaggatgcttcgcccaatttttctcgagtgattcatgtgaggaaccatattcatagccagcataagtgaccttttcgataaaatgtttcgttgcaaaacttgccggcgtttcaaaataataatcgacaccattcttttcacccttacgagccggacgggtggtgtgcgtcataacgcggtgaattcggtagttatcgcgcaaatacgcgctcaccgttgttttgccggtacctgttgcccctgtgatcacaatcaacttatgcgccgctttcatgatccgcctccttgaatattgcctcgattgtaccaaatcagcgccgattcgtcagctgaaaatcaacattgagcggtatttaaacgccgaaccaagctaacctttgacgatgcttcaggccaaatcttgataaaaagcgaccacaccaaagtgatcactcgacacaaagccgatcttctcgtaaaaggcgcgtgtgtctggctgatcatccgttaacagaacgcgctgccgcacttccggatattgatcgaccaatgcgttcaccaattggcggccaatcccttgacgttgatagttgggaagcaccagcagatcctgaataaaaagaatcgtttcaccgtcgcccactgcccgaatcaacccaactaaccggtccccatcaaaggcacccagaaccatgagcgactgtgccaaggctcgttttagttttgcgggatcgcgcgtgtacatcacccatccaaccgcttgatataaggccaatacagcttcgtcatcaagtttgcgattgtcaatcttgatcattctttgtcccctcctagtgagcgtaaatctacgcttagttcaagcaatgattcacacataattatcagtttgagcatattgtcgcatagaacgccgatgataggctcacgaatcgcccgattattttgaacttattttaaagaaaaaagaccggccaccatgaccgatctttgaaatatatattttgcaggatgtgaacaactaattaaagacgacggccaaattcaggtgcaaagtaagccatactttgaacagtgacactctgacccggtgccggcgcatggatgtactggccattgccgatgtaaatgccaacgtgataggcactgccaacgccgccccagaagactaagtcgccggcctgaagatcagaaactgccacgtaagaaccgagcgtgctttgggcttgcgaagtccgtggcaggctaacgccggcttctttagcagcgtagtaaatcaaacctgagcagtcaaagcccgaaggtgaagtaccaccataaacatatggcacaccgatgtacttagcagcgttacttgcgatgctgccaccggaaacagaaactgtgctgctgccagctgaagcgggtgccgtggaggaagttacgcttgtgctggaagcattgttgcttgcagaagcagtgctggtgcttgatgccgttgacgtcgaagtggtgcttgctgcgtcactaacagccttttgtgcagcggcagtcttggcagcttcttcagcggccaattcagctaacttgtctttattggcatcaatcatcttttgtgcctcggcagccgctttatcagcatctgccttcaagccatcaatcttggccttatcgctttcaagttgcgccttggttgcaaccaagctcttttgcttagcttcctggttagctttcagatccttgactttcgcctctgaatccttgactgcctgcaaagcttcggtgctagcctggctcaacttgctaacggtgaaggaacggcctaccaagtcggtcaaactacttgaattcaaaatgaaatcaaaatagacattgccagtaaccgaattgccgacccgtttttgcaaggagatcaattgatctttcaagttgttcttgcgctggctggcttcctgattggccttcgtcagctggccgtcaagatctgtgatcttagcctgggtatctttaatctcagcctcggccttttgaatcgccaaaaccttgttggaaacgtcattgctcagcttcgcgcttttatcgttggctgcctgaagctgtttcatcaagtcgtcgttcttcgcttgcaaacttgacttgtcgtctgccgcgcgaacggttgttgctgctacacccgaaaccccaacaccagctaatgttgcaacggtgatagcgcccgtaactaattgccgtaatctcatctttatcgccactcctgctttcattttgttcacaattgtcacattaacactgaactattacaggcttgttacaaggccgttaccatcagaatactttcgcaattaaatcaacattattttatgatcatattgataattagtttacgccctagttatattttcgcgtttgcatgcaaaaaaaacaggaacaaagcgcggcttcatccctgactttttgcagtgtttgtcatttaatttttactggtaaattttttagttggcaacgtttacttagttgacccaaccatcaacgacatcgtttatttgatcttaaccaagaagtaccgctttttcccgcgccgaacgatgacatattgcccgtcgaaatgggtgctcgggtcaacttcaaaatccagctcgcgttggcgggtcccgttaattgtgatcgcaccattctgaatgtcctcacgcgcctggcgacgactcggttcgattttagtggtatctaccagccaagtaacgatattctctgcagttttcggcgcttccacctttggaaactgcttaaatccctgcttgatttcttccgcgcttaagtccgcgacatcaccggagaaaagggcggcactgatgctttcggcttgatccaccgctttttggccgtgaacaaacttcgtaacggaacgggccaattcccgttgtgcttcgcgtttttccggatgcgttttagtcgcttcaaccaattccgcaatggcatcccgtgacaggaacgtgaagaacttgaggaacttttcaacatcggcatcatcctggttgaaccagaattgatagaactcatacggcgaggtcttttccggatcaagccaaaccgctccgcctgcggatttaccaaacttggtgccatccgccttgagcatcagtggattcgtgaggccgtaagcacgggcatccgggccttcgatccgatgaatcaggtcaatccccgctgtgatgttgccccactgatcggcaccaccaatttgcagctgaacgtcttcgtgcttgaacagatgcagaaaatcaaccgactgcagaatctggtaggtgaactcggtgtatgaaatcccggtttccaaacggctggctacaacttccttattcaacatgttattgacggaaaatagcttcccgtaatcccgcaaaaagtccagcatcgagattttcgataaccaatcataattatcgacaatccggaaatcttccgtgccaaacagattctccatttgggcagtcaatttctttttattggtggcgatggtgtccatcgtctgcaaaacccgctcggaattacgtccggacggatcaccaatcgagccagtcccaccgccgataacgattactggacggtggcccatcagctgaaaacgcttgagaatcataaacgggatcaaatggccgacatgcaaagaatcgccggtcggatccgtaccgcaatagacactgaccgccttctcctgggtcagcttgcgcaagccttcttcatctgtcagttggttcagtgccccgcgccattttaattcgtctaaaatcttacctcgttgtgtttctgtcatcagtcgattccctcctatttgtcatgtgcgcgagccgcaatgtttacgcttcttcataacgcgttcgctggtgcagaagccggctcacgctcaaaaaaagtcgtccctgatcttatcaataagatcagggacgactttcaccgcggtaccacccaaattatgctatgcatcactctcatggatatcggcatgacccgcggccagtattttttgagttgtaattcatgctgttaagcgcaacggttcgcagcaaccaccgtttttctgaagtctacttaacaccactactgcggctcaactggtaaatgatatgtcaaattttaccacaggttcgtgatttgtacagaccagacattctaagctgagcactttcctcaatctgcctaatttttaaaggactcgtccttgagcaatccgtctaaagcttttagaacgccctcatttgatgcaggataccactgatcaggatgatcgatgcctgcgcgtttagcagtcaataacgaaccgatccaaacacttattttagcgtgcagcaataaagcccgatcatttgagtcgttaccaaatgccacatagtcaccaggaaacagtgattgtgcagtcgtatacttatttacgtcgcgagtggttaaatcaaggttatgttcaccgagagaagccactatagataacgatgtctcagtttgcagactgtcaaaaagttgcaccatctgttggtcagttagatttaggaggataatcttgatcggctgtaggatatcctttaaagggcgtctatgcgccaagtgccctgggtctaactgtttaaaaatgggactacccgaacttaagcatgccgcataatcccatgacccatcaacaatgtaatctagtttttcttttgcaataagcgttttcacgtattgataatcatcattgtcgattgttcgacaaaaagtgattttcccatgttgagagacaatggaaccattaccgccaattaatgaatcattagcgaaaggccccacaataggaatgaggtcccggatcggtcgtgcagatgcaaaaacgacttcatgacgccgttctttgagccgttcaagcaacattagaatacgttggtcaattttttgtccgtcaaaactgagcgttccatcaacatcaaaaataaacttcacagcaaatctcctatagtcactagtctctcaaacatgattctttaaatttatttttcaacccactggtatcgttctgatcgccgtattaattttgcggatcttgcggcgcatcattcggcggcaagtcggccggatacgttttgacatcagcgtcgagaatatcatacttatccatcagcttccgctcaacctgctcgcctaactcataagaatcggcaacggtcatcttgggatcaacccgaatgccaatcgtgagcaaaactgcatcgccagcgtaccgggcttcgatgctttgaacgccgaggacgccgggcacttgggtgatggtttgccgatacgccgcaattttcttggtatcaaagccatctgtcagttcaaaaatggcatcccgcaagatggtccaagctgcatacaaaatcaagacgccgacagcaagcgcagccccgccatcaagccacaaccaaccggctttggcccccaaaatagccagtaaagtccccgtgctggttgcagcgtctgaaaaactatccttggaagccgtcctcaaaacactactgttaagttgtttggcgcgaatatgattcattaacgagatggcgcccatggctattccggccgccagactcacataaactgccagtatgcccggaacctgaactttgccctgggcccaagcctgcaagccgtggtacccatccaagactacatccgcgccaaccaccagcataatcaagccggaaaataaggtcgcgattgtttgaaaccgccagtggccaaaacggtgctcattatcaggtcgctgctgagaaatttgcagcccccaaagcaagataagtgccgaggctaccccggtcaggttattcaacccatccgcggccaaagctcgagaatgcgccagctgggcaatccacaattcagccaccgtcaaaccgccataaacaaataaatttaacgcggcggcatgctgggcgcttttaagacgcgcaaatcggcgctgttcatcttttaaaatattgcggccagcatccatgctaatcccccttgttgaatagactatttaataactattataaagcatcaatgtggccgtaccaccgtaaaatacttgctttaaatgacgtaagcgttttcttacaaaacttttacattcatcacgccaaatcgcggatcagcctctcagctatcctgtgattcacctgtctcatattcttccgtctgccgccttaacgcactggccagacgttctaaccgcgcaatggtgtcgtctaacgttaagtagtaataaatcatattgccttcatgccgggatgcgaccataccgatgtccttcagccgtttcaaatgatgcgacgttgccggttgcgacaacccaatcgcatcggccagatcgctgaccttaacgcctgagttattcttagcggcgccaagcatcataatgagcctttgacgattcgtatttgacaatgcgttgagatgaccgatatcttgcttaaattcttttagtgcttcctgttgtgccgaactgtacgccatgatttactccttctagtgacttccactgcgaaccccacatgaatccgttaccattcacatcgaatattacctgaaatcgtaacgattgcaacaaatatgcaaaccgttcatactgtaaccaagaactatcaacgactttggaggtgcactatgacaacgaccacaacctttcacggcttaggggcggataacacgctgaccatttacacagacggcgccaatgaacttctgaatcaaagcgtcagcatgattcgcgcttatgcccatttactgtcgctttatgacgaagaatcgctgctcgtcatgatcaacaatcaggccggcaaaacgccggttcacatccctgtccgtccggtcttcaatctcattgcccaagcgattgcctggagcaagcgcggacttggttataatgcgttaatcggtccgattgttaagctgtggcgaattggctttgccgatgcccgcattccatcggccagtgaagtcagcgctgctttagccttaaccgatccgaatctggttgaactggattcggaaaatcaaaccgtttttctacccaaagaaggcatggcgcttgatctgggtgggattgctaagggatttattgtggatcaggtttacgacttgtgggacaaaaccggtgtcgaaggcggtctgattgacttaggcggcaaccaacgactggtcggcaaagcagccagcgggattccgctatggcagtggccaatcgccgatccgcggtatcctgaaaagcgcagtatcgcgaccttgacaaccgagccaaaagcggtggtcacgaccggcatttttgaacgccaatccaaaatcgccggcaaggaatatcaccacttaatcgaccccaacacgggctatccggttgagtccaacatggccagcatcacggtggttgccgataatggcctcctgggggatgtgctgtcctccatcggcttttacgccggcattccggctgggtatgacgccgtcgaggcagaaggtcaggaagccattttcgtcaccaaagaaacccgcgtttatcagactagcggcctacgcgaaaccttggccattacggtatagtgcgccgaaacaacattagaacacaaaaacagcaaccaactgccgaaaagctgggttgctgtttttttaatgcctggatcagttatcaaaaaccaaacttgcacctaaagttcctgccaaatcacactgcacggtggcaccatggttcccaccggtaacaatgcacgcagattcgccggaactagcttggtattggcgtcctgtaacgcttgcggtgaacaagttgggttggccagcaccaccagcgtttgctcttcattctgacggacaaagccgaagctgtcctcaaaagtaaacggaaagaacgcagcatctaccgccaatgctggttgatcgatgcgggtctgaatcgcaatctgatacaagtccatgatctcatgatcttcatgcccccaaggataaaaggcacggttatcgggatccttccctccagtcagcccggcttcgtcgccgtaatacagacacggcacccctggtaaccaatagaaaagcgaaaccagtaatttcagcttctgacgatcgccattcaaaaccgttaaaatccgcggcgtatcgtgggttccgatgttattaaaattaaaatcaaacgcattcggtggataattttcttttaacgtcatcaattgccgaacaaaaccggccgcgttgagcttgccaccgacaaaatcgatcagcatcgaccgcaatgggtagttcatgacggcattcagttcgccaccttcaaaatactggcgccgcttgccataagcctgcttgttagacgcatcttcccacacctcgccaatcaaaacacgctccggaaactgatcaagagtacttcgaatctgccgaataaagccatcggtcagttcgtcagcaacatccagccgccagccatcaacgcccatatccgtccagtaactgatcacggaatcctttttggcggcaataaagttatgaaaatcctgattgtctttattaatcgccggcagatccttcacgccccaccagctattgtaatcgtccggaaaccgtttaaacgaaaaccacgatgcatacggcgaatccagactgttggcggcaccgacgtcattgtattcattcaccgcattgaaataccgactatccgcaccgacatggttaaagacaccatcgagaatgacatgcatcccctgccgatgcgccgctgccaaaaactgtttaaagtcatgcaacgtgcccaagacttcatcaatcgcgtaataatcgccggtgtcataacgatgattgctccgcgcctgaaaaatcggactgagatacaacgcattgatcccacgcgcggccaacagcggcaacttttgctgaatgccagccaaattaccgccgtaaaaatcccaccggagaacttcgccgttattcccacgaatatacatcggccgatccgactgccgcccatagataaatgaattagccttaggagcattcacatgcccatcggcgttgccattctgaaaccgatccacaaagatatggtaaaagcgggcattcttgtaccaatccggcacaggatcaaacgcatgcaccacggtcagctgatagctaaccacatccgcattatccgaataagtctgccccaagccgccataaccaccgtcaaccgcaccaaaccgctgacgaccttcatcggtttgcaattcaaaatgataaaaccacaaccccgaagacggcggggcaaaagtaaccgtataaccattcggactctgcgtcatcggcaacgactgcgcctgatcccactgaccatccgcagcaatcaccaaagacgcctgcgtcacagcaccatcagccttagccgaaaaatgcaccagcgtcccctcccgaacagccccaaacggccgccgatcggtaaatgaatcgaattgaaacatgtgaacctcctgttaacataataaggcaacgcgcgattaaacgcagagtgccaaggcggagcaatcggaggccatatggggctcagctgtgaaattgttgttggtggggcgccctttgccccgcctacaacaaggctgagctttgagactcagcgggctttgctgaggctcaaagtcgtgcccacagcgttccagccccatatggccggagattgcggagtttggcgcggagtatagggtagcactgtcacacacaccaagctgagttgccagtgccaaagcgccggagactgcggagtttggcacggagcatcagagaacaagtgaaactagccttcagtatccgtgccatcatcttcaggcgtctgcggaaccacatgccaaatctcacggccataccgctgaaccgtaaagtccgccgagaaccggccactctccgcaatattaaccaacgccttcttcgcccaaagctccggctgctgataaagcttatccaaccgcgcattagccgccagataactctcaaaatccgccagcacgaaatactcgtcattgtacatcaacagcgcattgtaaatatcgcggccttccgtctcaatccccggaatcttcccattcacgagcatatccaacacggcatgcaaccgcggatccttttcataaaagtcccgcgaccgataatcgccgcgctggtaatacccggcaatctccttttcggttaacccgaagatctcgatattatcatcgccaaccgcattcttaatctcgatattagccccatccaacgtcgccaaggtcaacgccccggcactcatcagcttcatgttactcgtgccgctggcttccttaccggcagttgaaatctgctcggaaatatccgccgccggaataatcttttcagccatcgagacaccatagttcggcaaaaagacaacctgcaaataaggactgacttccggatcactatcgaccatatcggccactgcattcataaccttaatgatttccttggcatacacataactaggcgcagcttttgctccaaaaatatgcagccgcttcggtcgtttctcgccgcgcttaatcgccaagtatgcgtccagaattcctaaaagatgcagcaactgacgcttgtaagcatgcagtcgtttaatctgcacgtcaaaaatggcatcgggatcgactttgacgtgcacggtttggtcaatatacttagccaattcccgcttgttctccgccttggtcgcatttaaatcagccaaaaaccgcgtatcgtcaatgtagtcatgtaatttacgcagcgccaatggattctgccgccacgccgttccgattttcttatccaacaagtgcgccagcggccgatcgccgatttgaatccagcgccgcggcgtaatgccgttggttttattgttaaaccgctccggaaaaatctggaaaagatcatgcagcacatcttttttcagcaattcactatgaagcggcgccaccccattcaccgcgtgcgagccgatggttgccagatacgccatacgcacctgcccgttacccagcggcgcaatgcggtcaatcatagcttgcccaaactgcggtacaaacgccaaccggaagcggcgatcgatttcctgcacaatctgataaatccgcggcaataacccgctgaacatatcaatcggccagacttccagtgcttcggaaagcaacgtgtgattcgtataactcatcactttgagcgtaatgcgccaggcttcatcccagcccacatgctcatcgtccatcaacacgcgcatcaactcgggaatcgccatcgccgggtgggtatcgttaatatgaatcgccactcgatcggcaaacccggccatgctgttgtgagttcgacgataatgccggacaatgctttgaatcccggcactcgtaaaaaagtattcctgccgcaatcgcaattccttaccagcattatccgagtcatccggatacagaatctgggtgatctgattaatccgttcgcgctgttccaaggtaaaatgcgggccagcattaatcggcgcctcagccgaccacagccgcagattattgataacgccattgcgatacccaaccatcgccacgtcataaggcacggccaagacatcatcggtattatgataaatcacccgcaaatggccgctgcgactcggccgcaattcgacccaaccgccaaacttcacggtgacggcgcggttttccttacgggtctcccaaggaaaaccattgcgcatccaatcatccggcaattcgacctgatagccattcacaaacgcctgcttaaacaagccgtattgatagcgaataccattcccgttgccagccataccaacactggccatggcatccataaacgccgaggccagccggcccagcccgccgttacctaagccgggatccgcttccgcagcaaagatcttttgtggatgcagatccaattcctccaagccagcttcaacttcatccagaattccgagattcagcaaatttgattgcagcagacggcccggtaaaaattcgatcgagaaataaaagacctgtttggtttcttcctcgtcataacgctccttggtgttagcccagggctgggcgatatatgaccgcgtcagtaacgcaagcgcctgataaagttgctgcgaagacagatcttcaatcggcgccgcatacaatttcaaggccatatctttgaattccgtgatgaattgttccttcgttaatgacatcaaatatacacctcatcaaaataaacaaccgtaatcgttcgcctaaacatgaataacgaggcccaatcaaatctccgccatcttgggttagacgttgcccgccttacctgcttcgcgtgcgattcgacccgacctcgttgattgccacctcatgctttgcctaaaattcggtcataccccttcaaatacgcagctgccgaatgatgccagtcaaaatccatggccatggcttgttgctgcagtcgagcataaaccttaggctgatccgcgtaaacatttttggccattcgtaagattttcgcaaagacaccagcattgtactcccagaaactaaagccattgccggcaccggtttccgcgttatacggcgtcaccgaatcccgcagtccgccggtttcatgcacgattggcaacgttccgtaccgcatcgccatcatttgcgctaagccgctgggttcaaacgcactcggcatcatgaagaagtcggctccagcataaatccgctgcgccatcgcttcgtcaaaattaatccgcacggctaactgccccgggaagcgatcctgcatcgacagtaaatcttcttcaagatcgcgatcgccagttcccaagatcacaacttggacattattctgcaccaggaagttttccaaggcatcgaccagtaagtcagcacctttttgccgggttaaccgactgaccatcgcaaacagcggatcggaccgcttcggcaaatgcatctcttcttgcaaaacgcgtttgtcgttggctttgccttttaaattcttggcgttgtaatgatacgccagatgcggatcggtttccggatcatacacttccgcatcgatcccattcaggatcccgactaatttaccactttgtttgcgtaacgtgccatccaaatgctcgccaaacgccggcgattgaatttcctgcgcataactcgggcttaccgtcgacactaaatcggcaaaattgatgccgcccttaagccagttgaccgagccatcctgagcaaacccattgtcattaaaactctggcggccaatttgaaagaccgtgtccagaattgacggcgggaaccatccctgaaactgtagattatggatggtcaactgagttttaatgttttgatacgggcgaatccagccatacttctccttcaacagcaccggaataaacgccgtgtgccaatcgttggcatgaatgatatccggaatccactcaatgacctgcagcatttcgatcacggccatctggaagaaaccgaaccggccgccatcatcccagtaaccatacaggccatcgcgatcaaaatactggcggttatcgatcagataatacgtcacatcccccagtttaatcgttttaagacccacgtaaaccgggcgaccacccatctcaagtgtaaaatgggtcaggttcttaaccttaggcagatacttagccggaaactttttttcgtaaaacggaatggcaacccgaatgtcgacgccttgctttttaattgcttttggcaaggcatacgtgacatcacctaagcccccggttttataaaacggagcactttctgcagcagtaaaaagaactttaagcacgagccgtcactcccttaccatctggctgaaagactttctgattcttggcgaatacaagcggttcttccggggtaccttccaaagccaggtttggcccgataatcacgcctttgtccagaatcgcatatttcacgctggagccagtgccaaccttgctaccttgcatgacaatgctgtgatcaaccaacgcatcgcgatgaatgtggacattgcggaaaagaatcgagtggttgacgtcgccttcaatgaaatcaccggtgccgagcaagctgttcgtcactttcgattcggttgagaaatacgtcggaatttcgttcttattcttggtttcaatcgagttggcactgtaaagcaacgcctgataattctgatcctccaacatgctcatgttagcgtcataataacgctgaatcgtattgagcttcgccaaaaagccggtgtattcaaacgcattggcattattttgcaacacggcttcgcgcatgatctgcggcaggcgcttgaatgtcggtgcttcggaagcgtcgatcagtaaatcaatcaggtcaatggtgccaatgaggtaaatgtccatgaacgccgggattttgccttctttaaggtgaccgcggttttccgatgctggcacaactgagctggcagtccccaactcggtcatgtccaacgtgagatcctccggctgcatcgccgtttcgggtaaattcttgtaaacggcggtgacgggactttcaccggcttgatggtacgccacaatcgcgtccacatcgacattagcgacattttgggtgcccataatgatcgtgtactgggcgctgctcttgcgcagaaattgcagatagtcatcataataacgggcccgcagctgcggatcttcgtaatcgcggccagccatatacggatacgtgaaaataccgcccgtgatctgatccatgttccaggtggacccgctgcggatgtggtcggtcacactgcgcccggatttaggcaggaaaatcgccacactgcgaacattggcgtgatccagtgatgacagcggaaaatcaatgagccggtagcgccctgcaaatggcagcgtgccgatcgggcgggctgccgtcaatggctgaatttggtcgtctttttcattcagatcaatgattgctgctaaatcgccttttctcattctttttcagtccttcctaaaacttccccgtaaccgacaacactaatttcgtttggtttcccgatgactttgccattatcgccaatgatcgcattttcgccgacaatcgcatgatccacggtgacgttcttgccgatcacggcgtttggcatgatcatactatctttaatgactgaaccttccccaatcttgacattttggctcaagatgctgtgttcaatggcaccggcgacatagcagccgtctacgatcatcgagccggagactttggcggttttggtcaggaacatcggtggcagtgcttcgttttggctgaaaatacgccagttacgattgccgatattgagtgggttgttcggatttagaaactccatgttagcttcccataagctctgaatcgtcccgacatccttccagtaaccccgaaacgcgtaagcataactggcttcgttatgggttagatatgccggaatgacgtcatgaccgaagtcttccatcgcaccatctgtcgcgtaactttcggtcaggtattgcttgagcgttggccagttgaagatgtagatccccatggatgccaagttgctctttggcttggccggtttttcttcgaattcgataatccggtcagtgtcgtcggtgttcataatgccaaaacgcttcgcttcgtctttggcgacgggcatgacggccacggtcagcgatgctttcttggctttgtggtagtccagcatggcttggtaatccattttataaatatgatcgccggatagaattaaaaggtattgcggattataagaatcgatatacgcaatattttggtagatcgcatgcgccgtgccttcaaagaacttttcgccttcgcttgaggcatatggctgcaggatcgtgacgccggcgccgcgttcgttcaagccccagctagcaccgttttgaatgtggcgattcagttcaagcggctggtactgggtgatgacccccgcggtgtttaccccggagttggctaagttgctcagggtaaaatcgatgatgcggtaacggcctccgaacggcacggatggcttggcagtggttttggttaatttgcctaaacgcgtgccttgacctccggctagaatgattcccaacatttcagtactcatgattgcggcgcatgtggtgcgccttccccccttacttctttatataaaaaggttctctgatacaccgtgccaaactccgcgatctccggccagctggggctggaacgctgtgggcacgactttgaacccgcaaaaaccgcggtttcaaagctcggccttggtctaaaacgggaaaaccacccgtttaagaccaatttcacagctgagccccatctggcctccgatcgctccgctttggcactaactgattcccgacgcttttattattttctgtctcatgaagatgtacgaaaacatcctgataatctatagacagtggcacgagcgagcacggagaagctcagaagctcttgtttttcttcacactcagcgatgttgtcggcggctgcgcccgcgctggggttgttccccaatctttgtggtgactgatcgcctcgcgtttttgagtggcgatggctttgggtgatgggctgccggtgattgctggctggtgcttgctttgttgttttggtggcttgggcagtggtgccagttttttaggagcgatgagcaaggcgcccatggctggtaagatgacgtcgagccaggccggttcgccgtgggtgttgccttcttttgccgtcaaagttgcctgccacttggtccaggtgccgccgaagtcgatgttttctgtgttcaataacacggtgtacgtgcctagtcttggcaccgggatcttgaagtggtctttttggactggcacaaaattcattgcgaccaccgtaaaatcatctggttgtttaccgtagcggatgtagctcatgacatctggttcgtcggccatggtgatcttaatgccggctggttgatgatcttgttgccacaggcttggacgggcggtgtataaatgattcaacgtcttcgtgaacccttgcatcttcttattcatcggatctttcaagtcaacccactcaagctggctccagtcgcgccattcgaggaactgtccccattcactgcccatgaataatagctttttcccggggaatgtcgtttgccagacatacatggtgcgtaagttagcgaactgattgtaccggtcgcctggcattttgtgcatcaggctcttcttaccgtgcaccacttcatcatgtgaaaatggtaaaacgaattgttcgttgtacatatacatgaatgagaacgtcaataaattcatatcactgtggcgatacaccggatcttcttcaaagaacttgagcgtatcgttcatccagcccatgttccacttgtaattgaagcctaggccgccggtgttgatcggcgccgatacctttggataagccgagctttcttcggccatcataagcacatcgggatgcttagcgaacactttggtattcaaccgcttcaaaaaggcaatgccttcgaggttgtcacggccgccaaattgattgcggtcattttccttgccggcgtcatagtccatgtacagcatgttggaaacggcatcgacgcgcagcccatcgaggtggcaatgatccagccaatacatggcgctggaaattaaaaagctctgaacctgtgccttgcctaaatcaaaattccaggtgccccaccgaacattttccgcacggtgagggtcggtgtattcaaaggtcggcgtcccgtcgaattgtgccagcatatcggtatttttaataaaatgacctggtacccagtccatgatgatgccaagcccggcttcatgtgcggcatcgacaaatcgcagaaagtcttcgggatcgccgaaacggctggtcggggcaaaatagcccatcaactgatagccccatgaggcatcgagcgggtgttccattaatggcagaaactcgatgtgggtgtagcccaaatccttcacatacgggatcaacttatcaatggcgtcctgatacgtcatgtacccgccatccgggccggcattggtgtcgcgaatgaacgagcctaagtgcacttcgtaaatcgtcaggggttcgtcatacggccgccacttgctgcgcttggccagccaggtatcgtcatgccaagtgatccgggggacatcaaccaaacgtgcagcactgccgggtttacgttcaaaaccgaagccataaggatcgatcttttcgtgggtcgcgccgtccggaccaacaatctggtacttatataactgatgtttctgggcagacaattcaccgtaccaacagccggtttgcccttggagcttcagcgggctgccatgccaatcgttaaaatcaccgacaacctggacctgcttggcgtgcggcgcccaaacgaggaatgaccatttacctggttccacttcatgtgccccaaaccggttgtaactttgaaaatcctgtcctgtgttgaaaagatataaccaatcttttaatccttggatcatgatcactgctatacaaaatgtggaagaatgtctctttgacaccaataaaagttttatatatttcctttcttgattgacaatcctacatttcatttagtcccgtcaacaacggtattcccactctgaaataattcagcatgacagtgaccgcctcctgaactttaagggtatagcctaccccgtaacctttgattttgcataagccaccagattctcaacggcgttttcgtctcgccgcaacttcaccccacactggtaacaatgatagtcatcatgaccagttcggtgtttcaaattgcccctcagtgtgacgcgttcatcagccgttttaacataaccacagcgggaacagcgttgcgtactggggtaaaaccgatccgctagcactaacgtattgccataccaatcggccttatactgcataatcactttgaacttaccaaacaatgatcgatgcaggttcttcgcgagacgtttattcatgcgcatatggtgattgtccagatcctcaatcccaattaggtcataatcagtgacgagcatagtcgtaaacttttgtagtaaatccgtttgaatccgttcaactcgttggtattggcgcttcaacttggttctcgttgtgcgataagccgcggagttaaaacgcttgggatttactttccgtttgcgggctaattggcgctgataatgagcaatacgagtgtaaagcactggcagacggtcaggcagggtgggttgagtcgcataaccagttgacgtttgatagtcaaacttgccgatgttggcatcaaccccagtgacagttagagccggccgcttttcaacaaaagtctgaacctcaattgaaaaggaggcatagtaaccatcagcgtcttgaacgacgcaaacttgtttcaattctccttgccagcgcggttgttcggctagtttgatgtcataccacgttccagcaccatgaggtttatctaaacgtaacttgccattcacaagttgcgcccgatccgttttgaacgttttgcgagatcgtttcttagatttccagttgggcttatcgtgatctggcatcttcggattgaagtagttcttccacgctttgcttaaatcatttaccgcgagctgcaaaactcgggcggactgctcatactgccagtcggctttattccaaaccagctcattacgcaccttgcgttcgttaggccgcaacgttttatccgccatcactagagatgcgtcgtacatggcattccaagtttcaagagcttgattccaaacaaaccgccgataattgaaaagcctttccagttcacgccgcatggttgcattgggatagagcttaatcttatgcgttttaatcaaaagttgtcacctcctctcaattagctggctaaacactactcgggagaaagcttgaagtagacgttcaaaccaatgctaaatagcggtacgatgcaagcccaatagatcactagaactaagtctcttagcaatatatttcgctagttggcttgatttgaacacatgaacaccttccacttatttattttgttcacgttgtaccgcttagttcaatgtccttcaaaatatttgagtgttgttaacaacctcccccattcacatgattcggcgtgcttcaccttcatcacgtatcgcgaatattccctatcgccccaagtgtaacagcaagacattcaaaaggctcaagaaacgctcacctgaacacttttataaataaaacgattagctaccgccaagaggaatataatccccctacgcgtctaattgtaaccgcttacgggagatattaacagtaaatacaattttttcggttgagttatttgtgagaatcgcctaagatggaacctatattatttaatggaatcgcaatgttaaccaaactgaccaaatctgctggtctagttaagcacccaaccactggagggatgacgatgagcgtcgatatagattggaacaacctaggatttgattacatgcaactgccgtatcgctatgttgcccactggaaggacggtgcctgggatgaaggcaccttatccactgacccaaatctaagtctcaacgaaggctccccgattctgcattatggccaaggcgccttcgaaggactcaaagcttaccgtaccaagtccggaaaaattcaacttttccgccctgatcaaaatgcccaccggctacataactctgcggaaaagttattgatgccaccgtttcctgaagaccggttcgtggacgcggtcaaacaggttgtagctgccaaccatgactacgtgccgccatatggtaccggcgccacgctctacttgcggccaatgctcattggggttggtcccaatatcggcgttgcaccggcaaaagaatacatttttgacgtctttgccatgccagttggtccttactttaaaggcggcatggtgccaaccaagtttattgtggccgatcaacatgaccgcgccgcccattatggcaccggtcaggctaaagtcggcggcaactatgcggcttccttgcaagccggtaagtttgcgcatgaacacggctatggcgatgcgatctatctggatccaattgagcataagtacatcgaagaagtcggttcggctaacttttttggcatttccaaagacggtaaaactttgaaaacgccaaagtctccttcgatcttgccaagtatcacgaagtactccattttgacactggcgcatgaccggttcggcatgaagaccgaggaaaccaagattgccattacagacttagatcaatttggcgaagccggcgcgtgtggcaccgccgcagtcattacgccaattgccagcatcacttacaatggccatgagcatgtcttttattccgaaactgaagtcggtccttacactaagaaaatttacgatgagctgaccggcatccagtttggggatgtcccggctccggaaggttggattgtggacgtgccggttgactagctgagtttttgaacttgtcatcaccgtgccgtgccaaactacgcaatctccggccaaattaaaagcagccgtcaagtttttaacttgacggctgctttttaattcatgagtatcgcgatctttctaatgatgaaggcttaaaataactgcctaaatttcctgtcatattttggtgtcgatgtccgtgcggcgcttttcattagcgtgcaaaggcaatcaggcgccagtagtcaccgacacatgtttgtaaggtgatgcgttgaccaccgccagtaccggtgatgtcatcccacagatcctgaccatccgcggtgaccgcgttcgggttaacggttgctaaccgataaacgtgatacgtgcgggcttggccggctgcatccgtaacggtgatcggcgaaccaatgcctaatgacagcattgcggcaaacgctccagggttgtgcccgataaagtgcgtattttcgccgctgttattgctgtagttagcttgaccgccccaagtagcagcgccattagccggcgcagcatccatgctttcgttaccaataatatacggtacggtcaccccagcaaacattaagacccgactcgcataagttggtgcgggttgaacttgtggtttaactggttgcgctggtgtaacgactggtgctggctttgcctgttgaaccggtgctggtgttgctgccggtgcagaggcttgccttgtcgacggtgcggcagctggtttagcggctggtgctggtgtggaagcaactgatgcctttgaagctgccggtgctggtgtcgaagccttgactgcggtttgggcagctggctgttgactagcaacggtacctgaagcaactgaccagctcggatgggcaaccgattgattagccggttgtgaagctgctgtgctattgagcaaatcaacctttgtcgatgaactcgttgcggctggtgttgatgcttttgctgccggcgcaggagctttcgtagctggggctgtcgtcgtacttgcggctggtgccgaggtggttaccttggctggtgctgcaggcacactggaaacttgggtctcggttgttgccttggtcgttgtcacagcgacagcggaagaagcggttgctttgctagtcgaaacctgcgttgaagttgcagcaggctgcttggtcgttgttttgctagtaacactggcgacaacggaccacttcggatgggcaactgcctgtccagccggttgaacagccgccgtcgcgtcaagtaaatcaacggcaaccgtcgtcttcttggccaccgcggtagctgtttgtttgacagttgcagttttaacggcagatacggtcgatgccgttgtcttaacagcggcggctatagatgcggccgttgcgcttgccttagtggtaacagcagctgttttaactgccgttgtcttagcttcggtttgacttgccgctgaatttgaaacctgtaaaccaaaatacttgagtgaacttaccggtgcgtttttaacaacggatacatgatattgcggtgtcgccttaacttgcgtcggtgacgccgtttgactcgtcgtaacgcctgaaccacttgctccgtgcgccagcgcccctgtctgttcaacaggcagcgccgccagttttgcattgagcaaatcgcttgaagcacttacagcattaactttctcccttgttgtgatacgcgatccggccacgtcttggtgctgcatgtgaaagccgacagctgatgttaccaccagtccgcttgccacaagagcgaaagtcatcagactcttgcgtaacatatagactcccccagtccatattatgaaactgacttaccacataaattcttttttagagatggccatctcttgttttagattatgcacaaattaatatagcgggtaaacaaatacgcttaccttttaaaagtgtctttgttatttataatcaaaataatacccaatatttcgctattttcgttttatttgaccatattataaaagaaatatttttgaaagttggttatgggcgttgactaacggccgttgtttttcgagtacaggtgcgcttttgaggcagacaaaggttagcgtgatctgtccatgaaaaaactcccagatgacaatcaagtttgtcactggaagtcccgttcacattgatatcatgcctacaaattgcttgctcagatactgccgccgtgcacttcagtcgcggcgacggtcaaaataaatgcatgcggatcgacggcatggactaattcaatcagctgcttgaagttgctctgctcgacaaccaccatcagcatttctttagcttcatcggaaaagccgccgacaacttgctgaacggttaagccatgggacgtctcatcgcgaatctgctgtttgattagtggcagttggtcgctcatgacatagaccacctttttgcgatcaaaaccggtctcgacatagttcatgacaaggctggtgatcgtcaaggcaaacactgccaagataaacgcttcgacgccagaaaccgggatgttaaacaatgacaccacaatatcggtgactaacaacatcagcgacggtttcaacccgaagtattttttaaaaatcagcggcggcaccgtggtcccgccgcttgaggcatccatttggtacagcaacccaacgccgaacgcgaaaacgacactgccaacaatgatggccagcaagcgatcggtcactaggttgatctcaggcgtgagccacaacaacagcggcaacataaagctgccgaatagaatccgcttaagcgtgctgcgatcaaggaaaaaccatgccaacgccagcatacacaaattgacgcccatcgtggtgattcccacctgaacaccggctacttcctgcaccagaatggcaataccggttgctccacctgctgccaccgcatgcggcgcgtaaaacatattgatgctcaccgcaatcagcgtgagcgcaagcatgatccacagccatttcagcacaggatgccgcatcgttttctgcatcaagccaccctttccgtttggggttcatccgtttcttatcatattaataatatacgggaaaagtaacttgttgacaaacgcgtttgttcagagcgccaacatgtacgttgttttaactgatagacgagttctgtttaatcttcgttacgcagttcagccaaccgctgtttcaaaacttcgacttctgcttgaagcgccgtgccaatatcggtttctgccaccgtgcgacggcgcgcctcagtttcaacaacccgccgcgtggaaataatgtcggtcagattggcaatggcatccgccttcgtggtaaacggctgatgggtcaccagctgcatcccatatgaattgtccagcaacgtatagccgccgatcccagtcgtcttttgataaggtttggaaaagccaccgtcaatgacaatcattttgttattcgccataatcggatcggtaccctttttcaccggcgtatggccattaatcacgtgcccgacttccggatcgaggacgaactcctccaaaattttcttgataaaatccggatccttgcgcaaatgataataaggattgcggccttccacatgggtcgcaggatccttgataaagtaccgttcaaacgtcgtcatgtcgtgcttgccaaaaagcggtgaattcggtccggtccacaaataccacaacaggtcggtcgctaagtcagccttttcatctggttgactgtatgccaggcgcaagttggcttccagcatgtcaaataattggcggccggcataagtggtgccgtcaatggtcaagccgataaaattgccatcttcgtccacaggcacacacccatgcaacagcagattgcgattgtagcgcaaatacatactgccgcgattgatcaggaaatccatgtgacgatgcagcttttcggaatgcgtgaacgactccaccagcgaatcaatgacttccttttcctctggcaataaacggtacggataggcgggatcgaccgtggcaaagcagccattttcaatcggataagtatggccattaaggtcgatcgtagtaaaatccggtgcgagtttatccagcaacaagcggtgatccatctcaaactcgggtcgccgtttaatcgttggaccctcaagcttaaactgaatcatcgcgattgcttgatgaatttgggtaatttgcaggcgctccgcctcggtaattgggcgatctgaccgccccaactttggtgaaaatgccgggttatcctgataatattgctccgccaaccgcgccaggtgccgcaaattaatcccataaacgtcttccagaatactcaggttgttataccgcgccgaaatccgcacaagattggcaatacacaacgccgatcccgctgcgccgccaatccataaaatatcatgattgccccactgaatatccaccgaatgccgttggtcgcgccgaatcagactttcaacaacctgatccggggccggtccccgatcgtagatatccccgacaatatgaaaatggtcaacggtcagacgttgaatcgttcggcaggtggcctcaatccattcatctgcctgctccaaaacaatcaggttatgaataatctgccaataataggccaacttgtcctgcatcgaagcatcgttatacagcagctcttcggtaatataaacaaactccggcgccattgccttacgcaccttcgaacgcgtatacttcgtcgccgtaaaggccaacaatcggatcaggcgccgaaaagtggtcagataccactgctgcagatcgtcaccatccatctcttgatgaatcgcagccaaccgttcagacgggtaatacaccaaaaacgcaaagcgctgcaatgtcttctcagtcatctcatcccgaaaacaggaccgaatcttgcttttgacattgccgctgccattgcgcaagacatgctgaaacgcattatattccccgtggatgtcactcataaacgcctctgtcggcttcggtagattcaaaattgcctctagattgataatctcggttgcaatggctggaatcgtttgatattttgccgtcagctcactgtacaaatccatgaaatagcttcctttcacgtagaccaatttttggctcatggcaatatgatagcatatttcaggaaattgtatacggtttcaccactttttgaaggaaattcatcatatgacggtggtagcaccattagcaaccggaacataaccactgctttttaattggaacttttcgaaagataagctgattaaggcaaaccgaaaactataccaacgattccaagctcagtcgctaagttttgttgatccactattttcaaaagcgtacgcaaacaaaaaaagtctcatctgccaatgtcacagacgggactctttaatgcataaacctaacttatcaaaattgttcgttgccgaacccttcacacactcgaagtgttcagcaacgctgcccacaacttttgccgccgaacctcgcgcggtaggaagacgcggactgaatcttggttaaacccgaacaataagcgccgatcgtccacgatgatcggccgacggagaatggctggctgcttagataacaaatcaaccgcttctttaagtgacaatgcatcaaaatcaacatcaagggcctgaaacgcctttgaacgccgtgagactaaactatcgatgccatcttccgatcgggccaacagttccaaaatctgcgctttgctgatgccttgtttcgacaacgaaatctcctcaaacggcagtccgttggcttctaaccacgctctagcttcgcgactcgattttgacgaacctgatgtatacaacttgatcatccaatcacccctcaacaaaacgataatatatcattatcgtttctctgctaataccacccacgtgttcaatgctaacaacgttcacaagtcctatggtgatttacttacgacaccattttattatcctaataataatttaacacattcaggcacttatgacaataaagacactctcatgctatgtgactgggatttcaatcattcaggcatgctgaccaaaatgaatcaggtcgttaaaaaatgaacggttgaagtcaaagtcctgacctacaataattaaataacggtgatagtgcctgaacgagggcttgatttaattgtgaatttttagcatgaaatctgatatttcagtttcatatcaccggttggcttacatcaaatttagcacaagcttatatcgctttcaataacaatttttaaaaaaataatttgcgattactaacatttaaatatttttgccaaatatcagtcccttaaaagccttgtgcacaaggcttttgcactccctcaagcagacaaaagataagatcttcacctgaaaaaggacgtgcacaatttattttaaaatttattatacaacttttttgagaccaaaaaaagccgccaagcgttttcacgcttgacgactatgaagcatacccaatctaacgggcggttttaatttaaatgttttggcgagatacgattactttgcgccaacggcttctttcttaggcttgccgctggtcggctgggcttcgctgatgacgatggtgtcgtcaaccagatccgcttgcaacttcttcgccttgagatgatccagatagaagtcagttaccttatcacgaatattacgttcaatgacccgccgtaatggtcgtgcacccatcgcttcatcgtaaccttgggcaattaaccaatccttagctgccgcagtcactgttaatgtgatgcccttcttagccagcgtcttgttgacgtcttcaagcatcaggtcaacaatcttgcctaagtccttcttggttaagtgactgaattcaacgatgccattgaaccggttcaggaattcaggacggaagtaaggcgccaaccgcttcattaagtcttcgtccttttccttcttgccagttaacgcttcgttgccgaaaccagcgttggaagtggcaatgatgacagtgttcttgaagtccacgacattgccttggccatcggttaaccgaccatcgtctaaaacttgtaacaacaacgtcaagacttgtggatcagccttttcgatttcatcgagcagaacgatcgaatatggattccggcgtacttgctcagtcagcgtgttcttgttgtcgttgtagccaacgtacccggcactagtaccaatcaacttggataccgcggtacgatcgctgtactcagacatatctaagcggataatcgcatctttgctgccgaaaagatccagtgccaactgcttggctaattcagttttcccgacaccggttggtccaacgaacaggaagctaccaattggccgattgccttcatcaaaaccagcccgattccgacgaatggcccgagcgaccatatcaacggcttcatcctggccaatgaccttgcccttcagacgcttgccaatgcccttcagccgttcaatgtcagacgcaccaagcttcgataccggaatcccggtcaaacgctcaaccgccgcagcgacatcattcggcgttgccacaacaggcttctcgtcgttcgttccttcaagctgatgttgcttgtcggcaatctccttcttaaggctggcggccttttcaaagtcttcagccttcgccgctgcatccttttgggcgttcagatccttgatttgtttttccagttcaaccttgtcgacaatcggatgcttgcttgccagatgtgccgcggtcatatcgatcagatcaatcgctttgtcaggcaaagaacgctgtggaatatactgaatgctgtaatccaccgctgcctttaaaacattttccggcaactgaacgtgatggtgttgttcgtaaagcttcttgacgccatccaaaatcttgaccgtgtccgcagcgcttggctcgttgatggtgacatcattgaaccgacgtgccaacgcgctatccttcatgatggtattgcgatactcgtcttgggtggtcgcgccaatcacggtaatctcaccgcgagacaatgctggcttgataatgtcagccaagcctttgcctccggattcttcgccgccagttgcaccggcaccgagaatttgatggatttcatcaaagaacagaatgacattgccagcagctttcacttctttgatcagattctgaatcttctcttcaaagctgccacgatattgtgtcccagcttccagattcgacagatcaatcgaccaaatctgcttatccttaatcgcttcaggaacgttacccttcacaatcgcttgcgctaagccttcaacaaccgccgtcttgccgacaccggcatctccgaccaaaatcggattattcttcgtgcgccggctcagaatctcggcagtctcttgaatttcgtgctcccggccaataaccggatcaagcaacccatccttggcttcctgcgtcagattgcgaccaagcttctcaaggataccgcccttcttgacggcctgttcaccagtggtcgcaaccggaatttcatcgccctgcttcggcaactgaccagtcgcacgatactgggcaaattcatcaggcgtcatttcgtggccattgaccacataccgggctgattcacctttacccataccttgaagcatctgattaaaaatatcgtccatatcatgattgttgaaaaacggatcgttaaagtttgccatagctgaattcctccttgttgggaatgtgcggggaaaaggcggtgcgtttgcgcggagaagcttgatacttctctgaaacgcgctcaccagcccagagacctccgtgtaaggaccttggtcgcaatgaccaaacccgggtcatcacgctcaaggccacttacactccgacgcctaaccgcgccagttcacgctctacaaaaaagtactcccagacgcactggcagtactttcgtgtcgagcttattcacttggtggcactgatgccgttgcgccttttccttgtttacataatgtattatagcacgaaattagcactcgaacaaggcgagtgctaattatttcagaaatatttttatgcaaacaacttaaagtatcaataccgcgacagcagccgcttttcgactttccgctcattaaaccgcactagcggatcaccattgaccagcgctcgggcgttgtcttcaaaaatcttagccttcttttcaccacgtttacgctccagacgcttgaaagctgcagacatctcataactacgaccaggcaagtgatgcgcgtcagaggcaaagacatgtgccagtccggcatcaataatatcctctgaaaattgctgaacctttttgccgaacgttccgacatagctgctagcagtcacctgtgcaaacgcgccacgttcaatcatttgatatagcaaacccggatgcttcattagtcgtgtattacgttccggatgcacaatcacgggcaccattccgcgttgcatcacttcgaacaacatattttgtgtgtaaagtggcacatcatctgacggaaattcaattaggatataatggccagtcacatcacaagtcaaaatgtcatggtggtcaattgcttctaacaaatcgccattaattcgaacctcttggcacggaaaaacagtcaatggaatatgccgctgctccagcacatcctgaaactcatcagtcagccgaatcacatccgctgcatgattcgtataccgtccattcatatgatgcggtgtcatcaaggcatgtgtgatcccgtcagcgaccgctgcttccgctaattccaatgaagtcgttaaatcttttgagccatcatcaattcctggtaacatgtggcaatgcacgtcaatcatcattcagttccccttccaatactctctagtatctaatgaagcgctgccaacgtcaaatcgtttttttgtaacagtttgttaacgattcgcaatagatcagcgagatagcacactttgcggtataatatcaaaagattacggaggaaatgaggtctagaaatgaaaaagatcctagtacgcgttctactcgtcgtactcgttgccgctcttgggtttggcggtttcgtgtactacatggttcataattcaacatcccaaatttattcctataataagaagaccaacaaatcttcagacgacaaaaccaccagcggaaaacccgttgcttacttactactcggtaccgacaccggtgaacttggccgctcctataaaggccgcaccgataccatgattgtgatggttctaaacccaaagtcaaagacaaccaccatgctctcggtaccgcgtgacaccaaagttactttcgatgatgtcaccatcaaaatcaacgccgcctattcctacggctcctctgacacggccatggaagccgttgagaagctcttgaacatcaaactagacggttacctacttgtcaacatgaaaggcctagaacagatggtagatgccgttggcggcgtcactgtcacctcaccactgagtttcgactatgaaggtaagtcctttgttaaaggacagtcttatgacctctcaggtagcgatgcgctgaagttctcacgtatgcggtatgacgatccgcaaggcgactatggacggcaaatgcgacaacagttgatccttgcttcagttatcaataagttgaagaagaatcccacgactgtattgagtcaaaagttccttaacgctgttggtaagaacgttcgaaccgatgtatcacttggatcggttaagaatctagcaacagcttatcgtgatgcaggtagcagcattaaaagcgatcagctgcatggtactggtcagaatattgatggacaggcttttgaggtgatgtcagacactgagcttgcccggggacatgatgtgattcagaaggcgttagacgcaaagtgatgtgatacaaaaagaggccgacgacttgatacagaatatattctgtatcaagtcgtcggcctctttttagcgcaaccataaaaaacaaactgtaaattaaaaagctccatcagctttgaaaattgaaacaaggtttttgcaaataatcaataaatcataactaaaggaacgattggcaacataggaaagctctaagtcggctctctgcgggtacccgatcttactccgcccgctagcttgccaaagtcccatagcgcccggtttagcagtaagcagttgatcaacatgctggccatactcgcgtaattcactttcaacaactggccgagggcccaccatactcatgtcacccttaagaatgttgatgaattgtggtagctcatccaacgacgtcttcctgataaaaatacctagtttagtgatccgtggatctttcttaggaggtaacttataattattacttacgtatttatcgtaaagagtagcgtctttatgtaaaacgtcctccgcattaacaaccatgcttctaaacttataaattttgaattttctaccattctgcccaacacgagtttgtttaaaaaacaatggccctttatttctaccgactaagcaaaaaggttctaatattagtgctgtcacaatgactaacaccattccaaagagaccgcaaataatatcaaacacccttttttcaaacaaatagactgacgaaacgttagccggctcactctctaaaacttcgactcgatgttgagtcttctccaattgtttttccaaactaatctcctccaatattaaaagcgttggtgctgcgaaaccccccaaagatttcctccccattttaagatattcttaacgaatgagcaaggtctccattcaatgaaatggaaatgaaattcacgccgaatttctaacaactggcgcaattgctataccggctattctacttggttccgatgtgtgtgtccaaattaacatgtgttcccgtcaatttatttaaaataagattgcgcgcttttctgacgatgtgctcgttctccataaagatgactgggcattccaggtacgttttgttattagctaaaagccaagtatccattagtaactcggcgagaaagcccatcacgcgactttcattgccttgaagcttagagaaatcaatttttgcttcaactgcaaacaggatcgaaaacagccaagaagaatatgccttgaactcttctcgacgcatgataaacatattaaacatgtgggcttgtttcgaatgcatgacttttgagaagctctcgcgatattcagctggttgctgcgcaataacctcgtacaaagcatcaataccaatggcactatggctatgtcgataatgggactcgattgtttcaatgtaatagtttcgtggtttaggtacgataatgctagatcgctttaggagatcttcaatctgagactcacgtaggatcgatgagaagtcttttttttgtgcaaaagaacgattagaaaaatatcggcgatagtgaaccaacccaattgcgtctgcattaagattttgagatgcccagtatatagcagttacctcgttataatgcggattcttatccgatatattgataccttggtcatcacgttgatacccatttggaatttctgaatgaagactgctacccacaaatatcggcaaatacgcaggatctgaaggcatatggtatggtttatgagttgcaataaggacactgatatgcatttttataacgctccttaatgattggcaagcttcttgcaagaagaatagctttatatcaaaatttcaagcaattaagcttataaagctttaacatctgcttattcagaaaaagccacaagaaactgttcgagacgattaaaatatgacttagaataaaatttagaaaccgtactaggtaagtcatcatgattaaagactttttctttattaatgatagcaatcatcttctctgtcaacatgcttacatcaccaggtctgtaaagataaccattgctatcatttacaatatcggcaggcccggttggacagtctgaactaatgactggaatgcctcttgcaattgcctcggcaagcaccatcccaaatccttcatacgttgaagttaacaccaaacaatcagcatgagctagtttatcgagtggttgagtcacccagccgtgtaaagtaacttggcttgcaatacctttttgcgcaatcaattctttaaattctgacatatctggtccgtcaccaaagacatccaaagtccattgctttgttaacttatttagtttgttcaagccaagcacaagttctctcagatttttttcgccatcaacaaaaattcgtccactataaacaaacctagtaataccatccgtggatgctgggattacgtttgttgttggggaaacggggtttccaactactccaattctcgaagcctcgatgttaatgtcatgcatctgttgctgaatgcctgtgctaatagccaaatgataatccgctttttggagatcatctagacttacatcttgtccgtgaagcaaggaaaaatgaatccaagaaattattctaaactttttgtgaaatagcctttttaaaaatgccacctcataaattagctttgtacttaaacaaactacctcatcagcagacgtaaataaaactgcgaaagcaagccagatcgctccaaataaattccgaatagagcgcctatttctaaagagttgagcgaatttaaacactttaactttcttagagaaggacgggtaccaatgatcgcgcattgatccttgtggtaggaggaatgacatctcaaaatcagacgagtgttcgaaatgagatatccactcattaacgactgtttcggtaccaccttcaccagataaaaaaggaaggattacaagtgttttgattttttctttgtcacgcataactatatgctctcctcctgaagcaataatttatcaaaccattgctttaagatagctgcagatgacacaatcgagtatcctgccaagtcaattgattctatgtttcgttcactgatatcattacggttgacgggtaatttatctaagtatgagcgtagatttttgatccacattttgggctcattaagtggtaacgccacaatactatcagtcaacatgacatcatgcggaatctgatcagaagcaaccacttgaagcccagaagcctgcgcttcaagtggtacaaaaccaaacccctcaaacagtgagggaaagagtaggacgtcaaatgctgtgtaccaatcattcatagcatcagtatgttttataaaagaaacatcagcatctaggcctttctgatggacttcctgttcgagtttctcacgaagttcgccattgccgataattaccaaatgactttccaaatgcctatcatgcagttcttcgaatatttttagcgagaaaaaaggatttttgcgttcagttaagacacccaccataccaacaacccatgtctcattacctaatccaagtgactgtcgcaagtcatggcgtggcttctctgaaaaaaggaatttgcgcagatcgatgccattcttcaagacaatgccttgattgtctttgccaaacatccatgccaagctttcatttgacacacctaactttaaatcactgatcctagaaaaaatatgccgacctaacctgttcacggtgtctatggtagccttgaaaacatgcgatttaattggtttgctgtagtcagtgttatgcgattgtacaactatttttgcattcgtaaaatagtgtgcaaacacaactggcaagaaattccaggatgacgaaaagttgaaatggataatgtcataagattgtttatgctgcttacaaaatcgagcccaatctatccagtgcttcataggattctttccaacacgtgtaacataatacactggccaacctaatgcgttcgtttccttttcaaagtcatgcttgccagaataactaacacactcaactttaacacctttttttgacagctgcttgtatgtattcatcatataaacggtcatgccactgccgtattgaaaatcccccaccagcaaaactttcaactataaactcctcctcggattcaacttccgtatttagacgaacgtgagaacatcttcgagtgcctttttaaactgggcaccttgtctcaattgaagtccaaaagaacgaacactagcggtgagttctgcatattgttcatctgttacctgctttattgccgattctgcttcggctaatgagttaaccgtaataccaagacgatgttggctaacaaaatcagcgatagcagcattcttccaaacaactacaggaatgccgcttgccaagaacatagaagccttgaaaggactgttgtaccgcaaataatcacccataacgccagatataccgtcaaccgatgatccatcccaaaccagtccaaaccctcccgagaattgcgcggctaattcgtctgaagggaaagaaccgcgataatcaaggctttcaggtaaagcaaacttagaaggtttattcccgtatatctcatagtgaaatgtggaatgagtgagtttacttaaaaaagaagatttgtccaagttacctgcaaatatcatcgttcgttgattcttaaatgttggtacgtcaagagaatcagccaagtgctcatatagtccgaaaacgacaactttagcggatactttatttgtattttcaatgaacttgcgcatcgcatttgttggcaccaaaatccccgatgcgagtttaagtatcctgagttcatttcttagtgaacgttgagcattgtttgtatgccccatcccccccagcccgaccgttggatcgatacgtaaagagttgaca

SEQ ID NO: 320 - DNA, 20951 bp, Lactobacillus casei
tttgtcgtaacgagttggcatgtaaaaattccttccttttgagagatgatttattcattataccctctcttaaaagttgtctcaggaatcagcttacatccatcgtttcagatattttacagggagttgccggtaactgttgctataattagctttaaataggggaaaatttaattaagcgaaaagtagaagttagcttcaagtaaaggggaatattatgaaatattgtataaagtgcggggaactactaaagaaggaggaccaattttgtgaccattgtggcgctaaacaaccccacatcgaggagagttctcacagcattgaactgaatgatctaaatggtttgaagggaaggcaagggttagaagttgattctaataacaaacgtcggagcatgaaaccatatccgataagcattgttgggctcattgctattattgttatcgcttttgtaggcctacaatcgtttaatgtatacaaacgtaataatttaacccaacaagaaattgctgatattggtgctactgttgtagatgaacatatgagtggatgcgacgtatcatattcaaaagaagctaatcaattaaccatcaatgcgtctgaaggatccgcactgtatgacaagcttattgacattcttgatgatcaggattctcccagcgaattaaaaacagttaaaaacagtttagaaaaaatttctgctgaactatcgcctaaaatgcctacatcactgaaggatgtgaatattgttctgctgaatcccttaaatagtaacctagatttgtacattgcatctgaaggagaagtcacgtatgactacatcaaagaaaatgatgattaacagtcataatatcaatttgattataattagcaaatgaattttctgcggctacttgagattattgtgggcagtgtttcgaatatttatagagatctacccatagtgattgctctaatgacattagattttacgagatgaggttagtatgcgagtgagaagtcatccttgtttgattcttgagacctgctttaaaccagcgttaatcaggacaaatgcaataagccacgctactactatgagcgtgatataggttatcatcaaacttcccatcagcgcgattcctttatcccaaagcgcatgtaaaacgattacacttccaagaaacacccaaaaattaggaatgagtaattgatgataattgaatctttcagattttttaaccatcacaagcgcaccgccgctaatcgcagcccaaaccacatgcccacctatcgcaatcgcagcacgtaataaggccgtttgaagcaatagattacccgaattataaatatagccagctgtttcaaaagcagcaaagccacctcccactgcagcacctatgaggataccgttcaaaatatattgatagttcttgcggcgcacaaaatagatcacaataaacagctttccaagttcctcaactatcccaacagaaatcgtgtctgaccatgtcatcatgccataaacttgattttgaaccgaaaaggatacaaattgatatagaaatagcgtgacaaataaagataaggcaccccccaagaagaacacctttaagacttcataaaaactgatattacgatatgtattcatttcgaagaaaaacactaatgcactaaacggtaccgtaaaggctccgatcatgatcacacctggaatggcattagagttatccatatcagctgcaatgtagacaagtaacatgaagattgctccgaagaacatcaaaattcgagaaaaaagccatggacgcccccagtctgcagagacctctgacactgtgggcgttgttgtcacagttccagcaatgaatatttcctcagcttcattttgggaatggcgcttaaatacttcagaaaatagattcttgagattgatattgaccggaccggtttctccggtgtaatgattcaatgctgtcgtagcactttgccaaatggaagagtgttctgccgccttttgatttaatgcgggccctctttgtgtcaatcgcattcctgaagcattatttgaaacactttttatttgctttattggtttcccacattttgggcaaaaattcgattgagttgttaacctttctccacagttcacacaaaaattaattttatcactattattagccatagattggccgccttcttagaaaaatttttcaatgcgatatctataccattgttttaaccacacatcgcttgaataacatacctgccttaattataaaccttgaatttttttcgatatctgatgaaggttgtccttttaatacccgtattacgggcgacgtccacatcactcatgcccgcttggtaaagcgtaaaggcatgttgtaagcggggatcatcttcggcatattggggctttcgcccatgatatttacccttctgtttggccagagcaattccttgttgctgacgctcaatgattcgcttacgctcactttcggcctgatacttatatagttctataatgagattagtcatcagttgacgtaagttctgatcagcaatcccagacatggacggcaaatttaacacatctagggtggcgcctttattttgaatggtgttcataatctgagttaggtcctgattatttctgcctaaacggtctagttcagtgactatgacaatatcaccatcgcgaatataagccagaagtttttgcagttctggccgattagtattagctccacttagtttatccgtgaatagtttgtcaacgccttttaaggcaactaattgccgatctaaatgctgctctttagagctcacgcgagcgtaacctattttagccattgtcagcacttccttttggacagttctaatgaacatttataatcaccagtatagcactaagccaaaaacggccactagggtataccctagtggccgtttagtaggaggactatcatttcatttgttcatctatgttcaattgaatttcatgcttaagtttatctacgtagctgcccaaacctttatcaaataacaattttatattgcaaaagtcagttatagatttgagagcatttccaacaaagagtgtactaataaatctgggtctagaatttttggtgttggaaagtatttccattccaaaaattctagacccgatgaagttggtgaccgtcagtacgacatctgctgggccaaacgtatagactgctgcctgattggttcctaaatcgttgtaatagttcacctaaagcccttctttatgctgtttcaactctgtcccggtaccgctgatggctttagccgagaaaagtactcggcaatcacggttgccatgagttgccgccgctgattgagaaaatctggataggttgagaagttgccgttcacgatgtcaaccggaattgcattctcggccaacccttttgcagtcgaaaattcagttactgctggatccttcatataccgttctggtgccaaatcactgatctgtaaatttcggggttgtgtcaaccagcaataattggcaatttgattgatctcattctgttgtgcgccatgcttacgcagatacgccttggggaaaatatggtgaatattgccctcttgactgatcacggtccgcaccgtaacatccttttccaaccaggcaacggtctggttgtgtacctgagccatttgaaaaattcgccaaccgttgttctgcgtactttgagtggctaaattattcggtaattgaattgtccaataggtctctggcagtgcatccgcaatttctttttccactgctgcaacgacatcagcacggtgaaacagatgactatcctgctccatctgtgtttcactggagccactataccggccagtcaaagcggacataataatccactgtttaaccagtgactcgcggacagattgaggtatgccgttttgtcctttcaagatcagaaacaacatatatccagcattcaggaacgccgtgccattgaattgcagcttaccgctgatcatgccgagactttccagaatcataataaatcggcgaaagtctgactgattaacaaagtcatcaattccttcacccaacttactatatgccgccgccatggctgtttccgtgtatttcttggtctcaaaatcacggccagaaatcagggcaacaagatctgcatgttttcctcgaccaaaatggctgcccaaaatcacatggaaaatatcgccaaaggccggttgataaagggtcgtgttttcactcacgatccaggcaatcttctgcattgccgccgattgtgcaaattttggatcagactcttgaataccagacaacgccgacgcgtccgcttgcagattggtgaaatattcaaccatttttcgttgaatattgccttgatgcagagtgtccgctgacatcttagacatgatgaagtccgcagtggatagtcgggtcccctgtgaattaatccggttaaagatttcagtcacctgatcaatcgtcagcgcatctgacaggctgatattgccgacgccgtatgacgtaatgtgcttcaaatcatcgattgcgcgcgccacttcgtctggtgggcagtcattggcctgggaataggcggtaatgaaattgaagcttgagaagtcgtccgcaaaaacttccgcgatatcactgatccagcgtttgtccttctggagcaaagcattagccgtttgaaattccctggtcaaagggttaaaagcaatactaatccgccgccgcttaaatcttcggtcgataatcttctgccccgacaatgcggtggctaatgctgtgagacgctgctgcccatcgatcacgatcttctttccaacagagattgacccatctttaagccgaatactggggttattccaagtgataatgtagccaatcggaaaaccattaaacaacgaatcgattagatcccgaactttggtcgagggccacacaaatggccgttgcagttccggcagcccaatctccccagagttaatccaccccaataatgtaccaatctgactattctgtacgtcgtatttcgaatctgccacggctgattgcctcccttatacgtctacgctactgctgcacacccaatgccttcatcaccgcatcctcaatcgtgttgtagaacttcagcgagaaagccgcaatcaaatctcccggcaccgtacccaattcactcgtggcactggatggaatcaagaccgccttcgccccgctatccagggccacctgtagccgatctgccagactatccatctttttgatagtcccgccaatggagaaatcccccaggatggctaatccgccgatgaccggcttgcccaccgaaatagaaaccagggctacataagtcgccaacgacaattccgtcgccatggcgtcattattcaggttagtcgcgttgacgatatagtcatgctgcgccggcgcaatattctgactaacctgggaaaaattggccttgaggtaattgaacgccgtatccatttcttccttcgccaaccgattggactgaatcccggtccagctcgtcttgccgttgccagtcgtcatctgtgattccaattttatcagactcaaccgctcatccgcatcataagcaacggtgtaaacttggccaggcttcccctcattctcaggaatcaagcctgtcgaaccctgctctggcactggtacgaaatgttcgtcgtaagtctccttgtcgatgtaagaaaagttcacatcgtagaactccatgccgccaattttcttcaattgttctttcacccgtcggcgcatctccagcgcaaacgccaaaatctgggcaatgtcgtccttcgtgaacttaccatctggatacagcagcttcaccatcccagacactgtcttgcgtaccgcaatcgtatcccgctggttcagctgattacccagggtgaagtacttgtcgaaagcatcgccgtaagaaatcttccgtagggcccgcatgacctccgcgaaatagtccgtgatcaggccatagccgttcgtaaagaaattcggccgatacttcggaatctcccagccaggcaagtagttgtgaatccggtccaaaaacgccgtgtcgttagccatgacagcgggaaacggatcaaacagattggacgtccgcatcaccacgtccaccggctgattgatattcccaacaaagaccatcccggccgacgcctggatttcgtcccggccccgagcaaaggagccagaggccatgtagtccttcatgatctgcacgccatcgttgtccttgaacttgatgccggccacttcgtcaaaggccacgacgtcccacatgccgactagccccacttcatgccgcgccatattgaagaacaggttggccactgtcgtctgaccgccagaaaccagaatcgaattgggcgataattctttgtagacgtgggacttcccagtaccccggggcccgagctccacgaagttatagttattctcgacaaacgggatcagccgcgataccatgagccatttcacccgatcgtcaaattgtgtcggctccatgccaattgtccgcagtaacaagtcaatccactcgtcggtcgtgaatttctcccgggcatcataaacttcctgcatgttcacagacggcacctgaaccggggtcagctgatcaatgagaaaatggtcatcgctggtatggtcgtaccgcacccgtacgatggaccaaatgccgcccaccaacagccgctcatagtcctggacgtagcgctcatccaccggcacaccggtgatccccaagttgccaaacgccgcctcgtatcggtccttatccgagttcaaagtcacggtgatcttgtcgatgaccgtatacgctccctcttcccgaatccgagacttcaccttttccgcctcgtctggccgcacgtagttattagccagcgtcttcttgacgttttccacgccccgttcaatgatcaccggatctgagctgttggcatactgccccagcaggaattccagcacataagtagggacgttcgccccctctttgatcttttgcgtcagatccttgcgcacgaagcgcccggggaaaaaggcctccagcttgtccagcaagtctgtttgcacattttctgccgcttgctcctgagcaatgggttccgctggcaccgccacgtcgccgtcactcttcgctcgcaacttttcttcctcttgcttgttatcagatgtcaaagccgaaatcccctttaatcgtcaagtccatttgatattgaatccgctgaatctcttccttggtttccgcattctgaataatcaggtagtatgcgccgctgttgtcgaagtcccgatcctgtaaggtcaggtagaagctctggcgccggctcgggctctgcggatcatcctcccgactatcggctacatagcgttgttcgttagaaatgggccgatcctggctatcgacaaagtagagtacataggtggcggcggtggttttgtcggttaccggtttttcttgagaaatgggcaccatcacgctgcggctggtgatgcgatgggcgccttccgtaaccttgattgacaccggtgtggccttggatcgaccactttgtgtccgcacgtgcagcaccggcacaatcatttcttccggtgaggcgccaccatgcacgtagttttgtcccgctccggcggacttgaagatactatctgtggccggatagtagacacgccgctgatcatcattatctagcaatgcccccagacgctgtgaccgtaccccgggctgctcgatggtctcgctgctgattgcatagcgctgccccaacacgtccagatcgtggccgctgatgtcgatcttgtccgccgaatccagaccagaccgtttgtacagatagccatgatcggcggtcacgatgatgtgcgctacacttaaattacgcaaaaaaccaattgtccgcgcaattgtgttgatggcttcctcggtggcgttaaagatctgcttctcagtcttcgcgtcatcaccagtggcatccacttcgttgtggtacaagtaaaccaccttttgccccgccaagagttgttttctttgcggcgtatcccagtctttgagaaaagtcatcacatggtcggcgttgctctgcggatcccgattttgcaggatctgacggcgcttccccagcgtgtctgctttgagtccatccactaagaccgtcttgtccggctgataggttaatgtctgatgcggcagcaaggctggcatcccgaaatacgtcacagaaggcagctcagagtataccgtatcgagttctgtactgtagacatcctgatcatccagcttgcgtttcagctcggccgcggcctcaaaccgaaaggcgtccgaaataatcacgacaatgcgctctttagccgaactgatgaatgaccgatagaaactgcgctgccagctattgggttcaatgtcccgcggatcatacaccgtggtccaagccgtcactgtcggcgtgagaaactcgttgacgtacgtgttgtccactttgtcagcgataccttccagaagatccgtaaggtcaatggcaatccggtcgtagcgctgaacgaaatgccggtacgctgtatccaccgcataatcggtggtgatgtattgttctttggcggccgctaagtttttcacctcacgccggcggtacgtgagaatcaccaaggcagcctgcagtaaggcatacgcatcatgatacgttttaccgaagtacatcttttctcgttgcgtcaagacatccgccaacggcgtcgtccccgccacagcatggaaatcatcagcctgcaatcgctggacaacccacgccaggatttgccggtcaaagttggcaaacacatccgtcttgagcaagtccacaatatccagttgctggagctgccgggaaacaccactgaagctttcaagatgctgccacactgtttcggccaactgacgatatgtatccgcaaatgtctggtcatttcttgctaacgacagaaaggtgacggcattgttggcactggtcagcttgtaattatcgatacttcgcggcagatccttctccatttggtaataggcaaagttcaaatacagggccgtcgtgaaatccagcagcgaattggtggcgccattgaagccataggcgttccgcacgttctcccagaactgggtgagcagaccatattttttaaactctgctagaactggattggtatcaccaatgccggcctgcagcacggcccgcaagaccatcgtcatggtgtggtcactggccccggccagcgcagccatgatcgccatctgcaaatccttgcccggctgatagagtctctgaaatttagcctggcggtctttgctggcaaaaaaccgtttctgctcctggaaggtcgcggcatcctcgtccggcactcgcaactcctgccgcagcatgaccagcgcattagcggtgtattcccgcgaatagtaaagcatgtccgtcatgaaattctccgtcagatccggcttcggcgccggcgaataaatcaaggccgactgcccttgccgctccatcgccaccagcgtcagcttggtcttaaactgctcgtttttccccatgatcacgaccggttcccgcagttgctccgtaatatccgcaatgttgtccgcaaactcgccctgtgcgtcataccaaaaaacaaagtgattattgtccgcaaacagcttctcaatacccgccacgatcttcttggtgtctagctccgccatgtttttcattctccgttccagtgtccgcttatccgtgttctcaacctgtgttaagtataacgaaggggctctgccaatgccatacttcgctaatcttatcgttctaaccaaacgaacttcggaaagattcccgggagcccgattgcgtattgggcgagtgccaatttgattcacgactttgaagttggcaaaccattgagtgagtacgtagacccgcgtcaaggcttagcaacaacagacaataagaaatatttacggcaatggttcgaaatctcttttccaagcattcatttttctgcgcattccacggaagaggccctccaatcaggagcaaaatggttcccgtataacaaaggcggtgcctacagaaagtggtatgggaactacgattacattgtcaattaccaaaatgacggtgaagaaatcaaacgggatgttctcagaaagtatccatacctgaaaacccccgactttgtggtcaagaacaccgattattacttccgtgaagcgattacttggtcggatattacaagtgggagctttgctgccagatatagactgccaggtagtattcatgacgtcactggcatgtccatcttttttaacagggcgaaaagtaacatacatgaaattcttgctgccctgaattctagggtagcaaatgagatatttagcatgatcaacccaactatgcaccttcaaatcggtaatgtaacaaactttccagtgttggaagttggcgcagaaaaggatgtgaaaatgaaggagcttgtaaattcatcaattactcaatcgcgtgctgaatggaatagctttgaaacttcttgggaattcttactacatccaattctgcgatacatcgctgagcatacggtattggtaatttgccatatccatcggcgcatttcaaaaatccgcgtcacagctaagcatccattcaaaaagttggccacctggtggcataaaatacagaatgtgccaaaaaagtgtcaaacatttggattaggaggacattaacatggtcagttaccgaaaaagaggtaaggtgtggcagtacgagatttcgtacaaggatctggatggcgcctacaaaaaattacgaaagtctggctttcgcctcaagtctgatgcggagttggcagctagtcaggtgaagtcgctctatgctgatgtacgccagttcaaggcgggcgaaattccactgagcatctatttcgaacgctggataaatctctataagcggaactctgtaactaacgtcactttcgtcaagtacgaaaacacgctgaaccacatccgcaagatcttcggcaaaatgccgctgaaggatattacccgaacagtttaccaagaacggctgaacgtctttgctcgggatcatgcgccgcgcactgtatctgcattccataagcagatcagggcggcactgcttgatgccctggatgagcacatcatttccaacgatccaacacgtaaggccgtcgtcacaggggtggcagtacaccggccaaaaaaagcgttggattacggtgaatggcaaaagctgattcaccatctagacccggatcaaattcccgagatgatgatttacttggctgctgttaccggcatgcgatatgcggagattttgggagtgaccactagcgacatcaattggcaagaaggtaccgttgatgttaataaaacctgggactacaaataccacgccggctttaagaagacgaaaaacaaggcgtcaatgcgaaaattaccgcttgattcaatttccttgcaccgcctgcgcgtcttcgtggagaaccaccccacatcaccgaatgctccgctcttcttgatcaacgggcatgccatggtcagcgctgaaatcaaccaagtattgactaataaattgcgtacactgtgattgcctcgggtaacattccacggtctccgccacacccatgcctcagttctcctttaccaaggtgtgagtgtcctttctgtctctaagcgcctcggccacagtagcattacgactacccaatctacatacctgcacattatcaaggaattggaggcaaaagataccgataaaatcctggcaattctcgagaacgcataattggcacatctattggcacaaaaatcccctccagatcaattctagaggggaaaatatctattttatgggcgtcaatagcttgacgtctgcttgtactttctggtggttcaccacgacgccgtcatccagatcaatcgcaatatgcatgttggcgacgtgttggagttgagcgtcatacttcaccaattcttctaactgtttgcgggtgtggtcccgctgtttaatcaactggttcttctggcgcgtgttggtctctgaggcgatgaaggtgtccaacgtggtcacccgcttttcataagcagcctgcagggtgtgtaaatacgacgtgcgaatcatcgccatcgtgtcgccgtcgtaccgatgcaggtacatcaatgctttgaagccaccttgccgaccggagtccagttgccaatagatcggtcgtttctgatagatagtcagatggttcttgtagaagtcgttgaacagataactccgaatttgatcttctgctgtgtcgcccgctttacccagtgccttggcaatgaacgtgagattctcttccaagtgttctttgccaaaagtaaccgtcaaaaactcccggaagcggtgcatgatatctcggtcatcgccaaaataatcagagtcagtcagcacaatcacatcattcgcattgggttgatagctcgtgtacttcgaagcatcccaatcgccaccagcaaatgccaatcctggcgtatctagcgagtaccggccaaatgtgactccaataaagtaggacatgaaggcgcggatgtcccgtcctagatctgccttattacgtaccgaaacttctttgtcagactcttctggtgacaactcgtcctgcaagccgtacagatcaataaagatcttgttcagctcttcttcgttcttcttcagttgatcgaaccgatcttgggcttcttgtttccactgattgaaagctgcttccacggtccaatttcgattatgctcagcgatgtggatgagaactggtaacgtccagaatccccaacgctgctcttcactattccagtcttgctttgttagtttgactgagttttgaataagtgagtcccaagttggagcctcgattgcgctatgcaagaccgggaatactgtaacattgccaacctgcaaattgattgtagggtttagcatcttgaagcaatgttctccaactggcgagtttaatagtgccataatacgcatcagttgattgtgatcgttagagaatgctgacatccctgatacatcatggatactgccaggttctcgatatctgatactgaatcctccgcttgttatgagcgaccaagtaatcgcttcacggaagtaataattggggtttcttactactgaacgttgcttaccatttggaaacttaaagttacggacttcttcaccattgttatgccagttaataacataatcatagttaccgtaccatttacgataggaaccacctttgttatatggaaaccattttttgtttgatgagatcgattcatcgattgatttagcatcaaactttattgtttggtacgcaacctcaaaccactgccgtaagaatcgatcattgtccgcagttgctaggccctgtctcgggtcaacgatttctgacattggagtcccaacctcaaagtcatgtatgagattcatgctactccaatatgcgattgggcttccgggaatctttccgaagttcgtttggttagttcgatagagacccttgcaggagggatctttcaccatttccaaatacgcgtcctctttagccgtttgagaaggagcattcaccaatctctcgtatgtgccgacataactcggtatagacgcatttctcatcacgaacgcagttgattggaccacttcgcccccaatttcttcaaacgcacgggtacccaagtgagccatattgatgagcacattcttacggagcttaacccgtagtttttcaaaactagacaggaacatccactggtgctgggtaataagtgcgtgatatccattttggacattcaacttctgtgccaattccataaagacagcaaataaatctgctttactgtctggatactcccttttgacaaactttgaaaggctcggtgtcattttgccagaccccatatagggtggatttgttactacgattgtgtactgggcagccaagatagtaagcacacgggtgatgcgggacatctcttcaaaattgaaatttgtcgtcgcaaaggaaagctgtgctgattctggctctgtggctgcactcgtttggagttcagatagtattccttgatcgaggctaggcttgatcaaggagccgagaacatcgccccggttgaactccttcactgtgccctgaaaggacttggcttgttgctgtggcaactgattagcataggctctggttaactcgttgagatcatcattgagaatattagtttgcggaatatccgacagttgcggatcaatggattgattcagtgcgcgccggtcgtattgccggagcttcatcatcactgcaaagtaggcgagctggtaggcacgccgatcaatgtctagaccaaacaggttgttggcaacaatgctattggcagcctctcgtgctgaatagccttcactttgatataactgcatgaagacatcgaatgcatagatcaggatgtggccagaacccatggcaggatctaaaaaggtgatctgttgaagcttcttgcctgacagatgactattgaaagccaatagttgttgctgaacatcctcagtttgctgagcagcggacatgaaatatcgccaaccgaaactctgggcaatatcctgttcagaccgttgatcaccgcgtgtatggagcacatcgatccaatagcggccgagcgaattttcaaccaagtacttgacgatccaatctggtgtgaacaactgagtgacggctggaatatctgatgccgcgtacttacttttcttaaaggcaatgtctttgggctcttcattatagtattggtacaaccacccaatgatctcgacctgcccctccttctccacatcaaaatcatcccgcggcacttcagttacaagctccttaatcaccccgttctgatagctgggagtgaacaataattggaaggcatcagttgttttctcaaacaaatggggtaaattggcgttcaaggcattggcctgcttcaaaaacagtagtcgatacgcattatccatcgccgctggctcttgagtttcttgcgcatgttgaatgagatctcgctgctcatcagaaaagccgccaagatcgtcttcaatttccagtgcatgcgccaaaatatccggttctgcccgtccttcttcggaagaaagcacggcaacccggcttggcaaataatggttcacttccatgaatcgtaatgcgatgatccggttgaaccaggtgtatgacgcttcttccacgagattatcataggcggtatgccaatcatccttggctgccgcggtctgcaaccgctgaactaagctgacccggcgcgacgtatcccgcccactgaccccttccgtgtcgtttggcacatagaaggcaatctcagccgtcgatgttggcagtttctcttttacaccgtctctggtgatccccacttgggtcagctttaactcaacactctcgatgagctcgcggcgggctttcaccgcgaaatcatgaatcttctttttatccattgcgattcctttcaaaataacggccactcccacgaatagccgttattgtctgctagagggtaaacttcgtgatctggttttctttaacttgatccagcaatgcctgccgaagcttctcaacataccggtttacgtcatcttcagaggaaatggaccattcccgttcaatggggagttgatcggcttcaagatacttagtttgaataacaacaggcgctgcaggttctggttgaggcgccggattggggccaggagcaggaagcggatccacaagcttaatggattcctcgtctgaactcggcttcggggatactttctccacctcggccgctttcttccgagcgagttcttccagccgctctttctcagccagcttctgttcttctgctagtcgctgctcctcattttccaagctctgcgtaatgcgccttaacaccgcatcagctgctgccggtttggcctctaagcgcgtcagatctggcgcttcctcagcctcggtcataattcgcttgatctgctccgtcaacgtcgccagccgttgctgtttgaagtcatctccggtggaagaatcgttaatccgctgtttggccttttcattgactgcttggattttgtcggtcacttgtttctggtgatcgtccataatcttggcaaaggtatccacaaacttctgatgaacaccatcaatttcttggataacacgtccagctcggtcctcattcagcagtttgttcagctgctggtagtcctcggccaaagccgtgctggtgaagaagtcatgggatgccttgtaccgcgcaatatcatccaatccccgcgtccaaattgtctgctgctgatcgctgaaatagaaatccatgatacccttgtcgctcatgtcatccgcccactgcagcaaatcatcataacgagtatggatcttgtcgtagaaagtttccgcatcattaatggccagtaattcactgaacattttgctgccttttttgagcagttcatggcccgggaaggaactattcttttgatcaaagaacttcagcgtcccattgtccttggcaatcttctccttcaattcagccaccatcagatccggctgagctgcactgaatgaccgcttattgaagacctgatcggcgacgtccttcatttcccgcaggtaacacggattgatgtctttcttcacctgaattgaaatctgttctgcgtattgcttcttggtcaggaaattggcaatatcctgagacctgtacgccagattgaccggagaaagtacttgatcctgtagattagcttgaatcttgccatccgccagcagcttggccaccagccattcgatgtcgtcctcaatatagccatagggaatggccttgaagttgtttaagatggcttgcaacgtcacatgcttgtccttttgcatcgtccgctggagccagctgtacactgcttggaccgcgcgctcgttttcctgcgtggatactgccaactcattatcctgatccaggatttgcgtaatatctgacgacgacttggccgcatcaatgagtcctaaactgcgatacgtatcatccaccaacatcttcaaaccatctgtgaagcgcccctggaagtctttgccgccctcaatcttatgtccggcaacataaacgtctgcttgttccaaagccgtcataatccgctcccgtgccttgactaacagctgctgccgttcagcagtccgctgttccttgataaagttgaaccgagcgtcggcatgggcgttgccaagcatgacaaatttcccaatctgctccgcccgccgcaagtcgccgaggtagtcgtccgtgctcggcagatcaaccacgatcttatgtttagacggatccatggacagaagcagcaggttggcttcattccgattattggcgccatccaaagacgtgatgacttggatcgtcatgtcattgttggtccggccctggggagtttcatccacgtattgattcaacgtgaaattgtaacggcctttcagcttggggtaagtgtacttattggtcatgccggtcttcggatcaaaaatgaagttgcccatccgatcttccaactcgcctgacagaacctcttcccggctgatggcctggttgacttcctgttccgcatcggtcaagaattcgtagttatccaagtttttctcgacaaaccgttgctgccgcagaatggctaacgcattctggacctttttctgcaattcaacccgatcagtatccactgagtcaatcatcaacgtcacgatgttgttcagcgtcgcgtcaaagtctttcaagtacttgaccatgaacagtgctttcagtacttggacgttgaagttatcttcttcatgggtgggatcaacggtgtcgttgtccaccgcgtgggcaatcacgatgctatgggtgtggtccaagaactggcgcaggccttcaaagaacaagctgaatggcaccagtgccgtatcctgctggtccatgatagcttccacagattcctggaacagggacagcatcgaccgtgcaccttcagacaagtgcttaccatcagagccgtgggtccggaccgctgtaagcacattttgcagcaagttaaactgatacggaacgaacggatacgtcgccgcaaaatcttcccctgaacggaacttaggccgatccacgccatcgtcaaaatcaatcatgttattgattgcggctgcgttagcctcgtagtctgccgcaagttgtgttgtagccggctctgtctttgccaacagccgcttgcgaatgacttcgtccacgttggccgaactcatgctgatcttggtcgcaaaccggccttgaatcttggaaaagtcctgaccgctgattttgtccgtaatagtatcaatagcctgctgggaagtaacaactacccaagccttaccatgggtagctgcccccaagtcctcaacgacggtttgcaggttaagcatccgctgggtactttctccaacaaactggccgacttcatccaccaggaaaacgacccgcttaccggtcttcttgatataggcggccaccagtttagagaagtcctcaatactgacttgataagatgtcgtcaattgatccatcaagccctgggcatcctcttcactgtatgcatcgacttgcactagggcatctttgatcgtgcctttcttgaaaatggcatgatcccgaccaaccgtccaatccatgtgagtgttatccaactccgtgaacttgtccttaaaggcgtcgtacttaccctgcgcaactagttggcgctccatttcagcaatccaaaaattggtgctcgaaaagccctgcatttcgttaaacacttgcaggaaaacattgatgatggtattgtcatctgacttggcaccagtcttagctttggaatcaatattgaacagcaccacgtcggttggctgttgcgcagccagctcaatacggttgatcgtcatctggtcattgattttctctttgaaataatcaatggcgctcttgccgtcaactttccgatcctccaacagataggaaaggatcttcagaaagtgtgatttaccagaaccgaagaaaccggagatccagacccccatttcatcagtatcatggttgatgcttttctcataggccgcaaagaagtcatcaaagtggcctttcaattctcgggtaacaacgtactcgtccagttcttgcttcacgttagcgtctgcatcctggccaaccttgatgacgccttggatatttcgatcaatcggtttaacaaataagtcgcgtatttgcattgttatctcccctattcgaaatgaaacgcgcggtagtagttgtcttcctgcagctccccgaaggcctgcaaccgcacactgttgtaattacctggatagaacatcatgaccggaatttggtcaatgacctgggtcatggtgttcaacaccttgtgggcccggataattggataaacctgcccaacaccggtaatgaacacgatggtgggaccatctttgttcaaatggtcgctgatatactgcaccactaggttatgttcctcgttcatctccatgatgttgttcatccagtcaatcacttgggtgataccattacttttttccagatcaatgaatgcttcccggtagccgaactgatcaacaatcgtcaacatgatggtgaacaggttgaacacttgaatggtgacacccgtaggcgccgctttttcttggcggataatatcgccaatttcgccgcggacatatagttctttctcgggatcatagtcgaaaatatagtaaccaacctcgttcgacaggccccgattctcttgaaatgactgcgtttggatcttttcccgcaagtcctgaaacttcttcttcagtggtaccattacgacgtcctccccgtcaggattgctaagtaatccaagtggttttcttcgcgcagccggtctgccaagcgctcatcgagcaaatagttttcaatcaccagtgtgtccttgtagtccttaacgatttgggcccggcgcagatactgcgccacagtggactgcagtctcctcaatgtttcctcggtccaatgggcagcctctttatgcgtcaacggcagtttcttaaaaaaagctgccatttcgtaagcttcaatctgccggtcacccaggattagttccggacggaagacgtcatacatgaaggcatacatcaactgctccgtattcatgatggcgataagattcataatgcgctgattgactggatcgagctgatcaaagagtgcccgcatcgctggcgtgagtgagcccacgcgccgtaaaaccacaccggtcgtggtgatcagccgggcatgggaggaggcatggaacgtattctctgccaggatctgttggcgcaacaccgtgaaatcatcgttatcgttagccatacccattgcttgaacaaattctgtgaaccaaaactggaatttaaccgctccggccgatattcgtttcatgtctaccttccttgcttgtgaaatgtgaaaaagtcacttgtgaatcgtttacatgtgtgtcaaaatacattttactcgtttggacttagtataccagatggacggctaagaacctgtctagtatcttttaagaactatcttcaggaaggccaatacaaccatttgaagactgctgttaagggcacgttcacagtttttccaaagtcgccgacatttgtctagccaacgccatgaacgttcaacgatccatcgttgcggtaacaccgtgaacatatgcaactcgttgcgtttagctaccgtcgtcttagctggattgaagtcaatatttgagacagattttaagagacattcaagaccgcgtttaccttccacagctcaaataaatcattaatcgcgattaataacttatttgaaccctggaaagcattaaatcaggcggccatt

SEQ ID NO: 321 - DNA, 170935 bp, Lactobacillus casei
cccccagcccgaccgttggatcgatacgtaaagagttgacatcatggataatgaatacaagtttgcagcgtttagcgaatcgcaaataataaacaacctgcaagaacgcaggataagagatatacaaaggatattgtataaagattgtatctccggaactaacctgcttaaaataatttgctaaggaactgtaagaaatcactttcctaccaagaagattcggcaaagaatcaattgaccccatatcaatagaccctaatgtcgaaagtgttttaatagtatcagcaatcggcttacttgccgcaaatgctttgccccctgcagtgttgttaatagattgaatgttaaagtagctcataagtcccccctacttcctgtcctacccaaaatgttcatgtttttatgattatctatttgccccttgactgccgtagtccggtctcgaagataaagaaatttaagaagacccagaaaaagatgatcagcacaaactgacgtgcaaatatctgctcaaagaatttatttgaaaaaaacgaaagtacaagtgagctaacgatattcgaatagattaaaatgctgtatggcacatgattggggttttttgtcacccgaatgcgttcaaaaaataattggctaattcctgccataataggaactaacgtaaacacgccccaaattccaaaatcatacagataagcatagtatgtggtataaacatttcccagatagacaccgtttacagtttggtaaggtaacgttaacccttccggcggtaacgtaaagttgaagatcttagcaaaccatggaagaatgtttacaaaagtttggctcccccaaactgaacccgtaacaggaatagttgtagttcgtaagaatatatccaaattttttatttctgcaccaatataaaccgacaagtaatctagactattagaacccgcatcactttctcgtcctaacatattagcgattggtggaaataccagcaacacgatggtaccgacaatcacaataccggcaatgaatttcttgttgtttggtttggaccagttgcttttggttctcagtaagcaatagtaataacagaagattgcaatcaacacaacaaccatttctgttctgtcgcccattaacaacgtcgtcacaatggccagcaaaactataaagacatttgagagcgagaatttatgaaaataaacaaactcacggactagtagataaccaaaaaagaatccgcaacttaacgaaaaattcctaatgatacttactgaacggggcaaagtattcccattaattgtaaagatcgtttgcaccctgacatagtaaatggcatctcctaatgacataccaccgccaatttttttaatttcataaattgtatagaaaataccaactatcaatacaaccaagataagaacgagtttccatgtggcaactgtccactcctcgatcttttcttttccaacatttaacttttgattgtctactgcacgcgttagatcgtgctcgttcactacctgttttgaccgtattgaactaaaaaaaaggtggataaaccatgtcacaaaaatgaattcgagaccgccaccgactaaaaccagaacggttaacgaggaaggctctaaaaaccattttcctgcataagctaatgcccataagccactaaatgcaaatgcacctgaatataagacggcaggggacattaattctcgattattcaaaaaatacgctgcaattagaatcagaattaaagtaaaggctaatgggagcattctttctccttacattctctatacttattttttaccatcatgttttgggcccgacgtaggatctttccttgaagccaatcgattaatgaagcttttttaaagacgtgagcattctcatcaataccaccggtcgaaacatgaacagtgctaccgtgtagatcaaagcgccatagatgatagctccaaacaaagccgtaagactagataacgacaacacactgatgaaaatccgaacacttacacccatcacaagagcagcaaccacgtatttccaaacttcacggaaaatgatatgaagtctgatctggtttttgacctttaaaagttgataaactgtcacgagtaattctgacaggactgtcgctatcatggctccgttgcttcccaaaattaaaatgagcgggacatttaagattatattcgaaattgcacctaaaacaaccgaagtcgcaaatggtttaagttgatttgttggcagtaaatattgaacgcctgttgcattactaattcctataagaacaataacaattgattcgatgaccaacaaatctgaaacagggtcaaaccctttaccaaaaaaaatccttgtaaacacaggcgcgatacctgccagccccgttgccagcgggaatgcaataaccagaataaagtgcatcgacttgtttagtgattcttcgacctcatcgtgctttcccatcgcaaaactgtgcgctgtgtggggtaaaagaaccgtcccagtcgcagtcacaatcgctagtataatttttacaatcttatccgagttgtcataaaaacctgaagcttggacaccgattaatgcacctaacatagtcttgttaagctgcaaataaacttgcgtcgcaatttgcggtataaacatctcaagtgttggacgcaaatgatttattaattttaagtctgataggtgagggaacctaacataccgttttagatacggaagtaaggtcatgttccctaacacttgtgagccagtcagaatcaaaatatacaagccaagatcatttttagttttgatcaatacaaagatcaatatcaaagaaattatcttcactaaagtatttcttagtacagtaatcctgaattcctcaagaccctggaagaaccaggaaacgtcaatggcagttgcaaccagcaaaaggccctggatcaaatagaaagtttgatattcccctgctattatgatgaaaccaatgtagcatatcgtggcaatgctcgttgttccgacacgaatcaatgttaattcccaaaacagacttgagagtctcttaggatgatcacgttggtatgctacttcgcgattaccgtacatcgtcagcccaagtgtgccaaacagcacaaagtactgaacaattgaatttgtgaaggcgttaattccgattccggttggtccaagaacacgcgaaacatatgggatcgtaacgattggcaataaaaggataaaaacttgataccccatgttccacaggagattcttgacaactttcgtgacgatccacctcatttccacgtattatcaattaagagtcagttaattagcagtttatttcttgttaaagaagtccccttgcagaaactgcaaagctgctgcaataacctgatccatattgtaatagcgatagaggcccaagcgtccgccgaaagcaacctgtggtgtttccttggcagctaattcgcggtaactagtaaataagtggttattttctgagttatttaccggataatatggctcatcaccttttgaccaactggcaggatattcatgtgttataaccgtcttgccaggattacctttcccaaattcgaaatgtttatgttcgatgatccgcgtaaatggcgtttctgcatctgtataattgacaacggcatttccttgaaaattatccatatccaaaacttcggtttcgaatcgtaaactgcgatattccaaagtccccaactggtaatcaaagaactgatcgatcatacctgtataaataaccttatcgtattggttcaagtattcctgtttgtgatccaaaaaatcggtattgagttcgacatgaatattaggctgatccaacatcttctcgacgatctgagtataaccgccctccggaatgccttgataccgatcgttaaagtagttgttgtcatacgtcaacctgacaggcaagcggcggatgatgaacgacggcagttctttagggtctctcccccactgcttagctgtatagtccttgattagcttccgataaatgtcaatacccactagcgaaattgcttgttcttcaaggttttctggctttttgccagccatagccgctctttgttcggcgatctttgcctctgcctcagcaggtgtgatgacgccccacattttattaaaagtattcatgttaaagggcaggttgtaaatctcacctttatagttggcaatgacttcgtttgtataacggttgaaggttgcaaactggttgatgtactcccaaactgcttgattgcttgtgtgaaaaatatgggcaccatatttatgaacctgaatgccttcaatattttcggtataaatgttaccagcaacatgttctcttctttcaagaacatcaactttgtcaccttttagtgcgcgttctcgtgctatagtggccccgaacaggccagcaccaacgatcaataacttcatcgttaatcccccaaattaaactaatgcgtatttattttgaatattgagtttgtttattctgctagcaagtctcactttaaaaagaggttacacgttactttgatagccgtagccataaccgtatccgtagcctttgtcaccatgtcgtgcttttacacgctcgactgatccgagaattttagcttttgctaattttaagacttcaacagttcggcgcaagtcgcttttttgtgtctgaccgattttagtcacaatgacaaccccatctgtctttggaactaaaacctgcacatctgacactgctaaaacaggcggagcatctaaaacaacaatatcaaagtttccccgcgcccaatctaataaatctgacatccgcttggaatttagcaattcagatgggttaggcggaattggacctgaaggaataatgcttaagttatcaacaaatgtttcctctacaacttcatctggctttgattttccagttagtaccgttgtcacaccatccaagttaagctttctaaaagttgcgtgaacggttggccgacgaagatctgcatcgagcaacagaacttttttccctgcttgggcccatgtaaccgcaacatttgctgagacagtagatttcccttctaacattgtagaagacgtaaacatcacgacctgacacttgtctaaggcagctgctgcaaattcaatgttcgtgcgaacggtccgatattgttcagacacgacatgtttaggttcagcatacgtaactaacataaccccgtttttttgggattcttggtcttcttgatttcgtttaaaaccaaacttaaatagccagttcattaatatcttcctctcttaaactcgacgacgacttcgctggggaagatttggtccgtcaaaactatctacatcatcgtcatattttgcttttgtcgcctgaatgacttcatcaatatctttcattcgctgaacataattcacagcacccaaatctaccagtcctagtgaatctgttatgaagtcgagatccttaacggtttggtcagttagttcacgaatcaatccccacatgaaggcaatcagaaccccgatacccaagccaacaattgcaattaaatttaatcgtggtgaaacaggcgtcgagttagctgtagcttttgaaacaaccgacacatttgatatactcatcatttttgcaattttttgttcaaacactttggcaacttcatttgcaatgtcccgagctcgaaccggatcattatccttaacattgaccgtaaatacttgagaattttgttgtgttgatacggaaaccattttagctaaatcgtctgctgttaagttagtatattttgccggttccaacttgtacttagccggcttagctttttcaacaacatatcgttcccgaactcctgtcgtcgcattataccgggtgccgtaaacagctttttcagctttttttgttatcacacgttgcgggcttgtcaaatcatcagctactgcctgtaagacgactggacgcgtaataatatctttatatgtattaatgatttgcacatcagcttgttgcgcatttaattgcatattcggatcattatcctgcttccggttaaccaaaagcgacgtatcagcctcgtatttcggtgctataagcgtcttagcaccaaaataagccacagccatacctagaatgccgagaatgatcattgctagaaagctgcgcttgaggatctgccacaactgcgaaaggtcgatctgtttgttcatgaactctttccccacctaattcaaaattaaaaacaaatttttttatgcggacatgataagatggtccgcactgaagacaaaatctaaaaagccactcctgagcataataccttagcaagtgacttcaagtccacccattttaaaatagctagacactttttgaactgaatcaattgtcgtcaagtcagaaaggcacaagctattatgccattatagtaatccttgataacgattgtgttacagtctctttacattttttacgacggttgtcaaaatgactgcgcgctttaattatttcagcttaagttctggcttaaaatacaatcacgaattctagaaacaccaaacctgcatgccatcaatgagatctaatttactttttctcgtgaactggcaatgcctgcctgtttttgtccttcatatgcttttttaaaactttgctttatctaacagtaaattccaccagttgcgatgtgttatataccaattgattgtattgtccaaacctgcgtcaaaggaggtaatcggtttccagcctaattcaagactgattttagtcgaatcaatggcgtaacgcttatcatgaccaagccggtcctcaacatattcaatgcgatcttttgataatcccaaatgatcgacgatattttgcacgatcgtattgttgctgcgctcattatggccaccaacgttatagatctcgccagcctgacccttcctgagaactaaatcaagtgcacgacagttgtcttccacatacagccagtcgcgaatattcttgccgttgccgtatattggtagctgttttccagttagcccatgggtaatcatcaaaggaatcagcttctctggaaattgatatggaccatagttgttagagctacgagttatgttgacgtcgaccttataagtctcataaaatgcacgcacactcatgtcagcggatgctttactagcggcgtaaggtgagttcggctgtaacgcagacttttcggtaaaatagccttgcttacctaatgaaccgtaaacttcgtctgtcgagatctgcaaaaacttcaaatgcttccttttggcttcggacaacagcgtcaatgtccctttaacgttggtttcataaaacacttcaggatgttggatactgcggtcaacgtgagactcggccgcaaagttaacgatggcatcaatatgatactgttcaatcacatatgccaccaactcccgattaacaatgtttccgtgaacgaagatgtaacggcgatcattttgtagatccgccaagttctgtaaatttccagcataagttaatagatcaagattgacgataagatcctcgggatgattttgtcgctgaaatcggacaaaattactacctataaagccagcgccaccagtaaccagtaaattcatggatgcagcaccttccttcctgccactgtatgtctcagtagtgtaactctaaactgaaattattaaatcgtcttaaattttaacacggaacgcctttcgaaaaatcctggccagaaactattggctacaatcgaagagagccttacggataaatacgctcgaatttgtcgattatgacaatctctttacaatttcccccaaacccgtcagaatgaccctaacttgtaaccagactcatctggattttagtttaaaataaaagcaacgtaacttttgggggcttacggatcatgaaaaaacatacgctgcgtttgcgggacttgatattgtgtatcgcgttaggtttgttgattgccggcgttggtggcttcttttatttccgccactatcaatctgaacaggcgattgccgttaaccagcagacgcgtcaacgcattcaaaacgattccaaagctaaagttaaaaaagagaaggtgctgaatcagtaccggctttttgggctaactgatagcgatatcacagcggctaagaacttgcctgtgacagccatcggcgactcagtcatgctaggtagctcggcttacctcaaggtgttgttcccgaagatgtcgattgatgccgaagttggccggcaagtgcaggcagcgcccgcgattatcagtcagcttaagtcggaaggcaagttggacgataccgtcgtgattagccttggtacgaatggtccgatgacggaatcggacattaatggcattttggaccagctgggcagcaatcgccaagtgttttgggtaacggcgtatgcgccgggtaaagcgtggattgatccggtgaataagctgattcattcggcggctaagtcgcatagcaatctgcatgtgattgactggtattatctggctggcggcaatgatgactggtttgccgatgatggggttcaccctaacgatgccgggcgtgtgcattattacacgttgatcgccaaggatgtcatgcagacgcttaagaagtagcgtgccatctgtttttacctacaggcgtgtttcacataagcctcaatttcaaaaataacaccgagatgacggaaatcttctcggtgttatttttgattgattcttaattctgccggcgatcagtgtgaactttttgcttcacggcactagccaacaggtttctgctaagtttatttatccaagtccacataacgtgtcagcaccatcatcacaacgccgccgactgccattgagacagcctctcccaaggcaatggtggcgtaggaggcccagaatggtgccttgctcatgattgtgagctcaccggcgactgtgaacatcgagaaggcgaagagaacgcccatgatagcgaatttggcccatttttggtggacgaatttggctgcccagcgactgatcacgaggaagacgagggtgccaagtgtgccgaccgggacatcgagtagtgcggttggcgaggctaaattggccaaaaaaacacccaacgtaaccgcccagacgtaccggcgattgaagagcgccgtgtagttgagcatctcggagaaccggacctggacgaccccaaagcttagcgggctgagcatcagggtcatgaccacatagatagcggcgacgatcgcggttttggtgagactgacgattgaacgatgggacattgatgttgtttgcatattgttctcctttgtggctttgccagtaataacgacgatcaaaggaaataagtatcgtcgtggaagcggtgtgcgcttccgattcaattaacatcatcttaacaatgtttcaagtttacttttctaaccaaccgccgtcaataggaatgacggtgccgtgaatgtaatcggcggcatcgctggctaggaaaagggatacctgggcgacttcttctggtttggcccagcgtttggccggcgtttccttagctacccacgcggccatcttcccgtcaccggcaaagtctgcagcgttcataggcgtattaatagcgcctggcgctaatgcgttggcgcgaatgcctcttgcggcgtagtcaaggtctaactgcttggtgagcccgataacggcgtgcttggcggctgtgtacgccacgcctccaccgccaccgactaatccggcgatggagctcatgttgataaaaattccgtgtccacgcgtgagcatccctggcaacagtgccttgatcattaagaactggctggtgagatcgacatcaataatgtgctgccaggttgccagatccgtggcagcgacgtcttggtagccgtccagaatcccagccgtgttgcagacaatgtcgggctcatagttacgggcgatagtttctgctgtcgcggccttactgacatctgcctgaatggtgacggccagccctgtcatgggttgcagatcgacgccaataacccgcgcaccagctgctgtaaacgccgctgcctgagccgcgccgattcccgatgccgcaccagtcacaacaaccgttttgccgctaaaatcgaatgctatcatgcgtcaacaagttgccagtcttcagcgagaatgtcacagtcagtcggggaccacaagctgaacgcttcatccgcggttttgatcagaaaatacggatttaatgtgtcgccttcaaatttgccttccggaactagctgaacatacaactcggtgccttcccaaccggtacgaacggctttttggccatttttcagtgatggtagaactgcttcgaatgtcatgaagttatttcctcctttttacttggcaggcagccaacagcctttgtgcggcttagcggcttccttggatgtgaattcagtgcactaagtatacgcgattttttgattagcgaacagccccgagcgcaaaatgcctgattgggggaacggccatcaagagtgctcatccttttgacactacctgcacgctgccaatcaacaacaaagaaaatcggtgctagcaacaattgccgctagcaccgattttctaattacccagccacttaaccgcaactggcgtattttcaacctatgaccgcactcaaagattaatcacctgcatgagtacctcggaaacgcgtgctcgctcggtttccggcaagccagtcaagtacttcaccaacgctaacgtattgatgtcgctcatttccggtgcgatgaagaaatcaccgacctccatgtctaaggcttgtgcaatgtcagtcaacttcttaacgctgatgttgttgacatcaccgcgttccatacgggatatcagacttactgagacccccgaacgctcggccagcttttcaatcgttaggttcaaactgcggcgttgttgatgtactaattttccgatattatctaacatcatgtcccccacctttaatgtacggcgttatgctttaacattaaatgaaacgagcgaccatcaaaagattttatattattatttaataatctaaagacggcctattctcacacaacgctggtgtacgaaccccacattaacgcgccaatacatctccactactattgtaagcgctcacgtgggggaagcgccaaatattggcttgataagcgggaaaaaagagcacattccggcggggacaaatgattaactgatccttcgtgttctataacgcgctcgggacaaatgcccacaaggtgccgcgggtaaattcttcgccgtcatcggtgtcgatttcgctgatactattattcggcggcatggccatttcatcgcgggcgttgttgaggtctgcgccaaggtaggtgctcagtagcagcatccccagcaagccgtgggcaaccacgagcaccttgccatccggatgttgatcataaattcgcgtgatcacgcgccgtccgcgagtcaacgcatgctcaaacgactcagcgccgattcgtttataatcaaatgcctgcaggttatgataataattatcgatttggggatcatcttggacctttgtcaaggggcgaccgtcccactgacccaaatcgacttcacgtaaatcttcttccgtgatgatcgccggttgcgccaccttgctttgagccacaatcaactttgcggtggtttgtgcccgcggcattggactcgcatagatgccagcaaaaccggttgtttcaaaaaatcgtcccactgcctttgccccagcgcggccagacggtgtcagcggcgtgtcggtacgcccaccgttaaagcggcgtgccagattcgtctcggtctgtccatgccgcacaaaataaaacttggtcattccttgcacacttcctttgaggatagtgtagcagacccgcgaccagaaagcgccatcttgcagtcaaaattcgattcagccttggcaatatttagcgaatgttaacaagtttcgggatgccgtattagcgcgctcacaattgcaaaagctacgtaaaccggcggacccacgtccttgcgattaacttacataccgatttctaagtcattcctgctcacgccaaaaagccggcaacacttttacgtgctcccgacttttataaatcaaacgccactttaataagacttgccgcagacaagactggcgcaagtgaaaatgcatttttttagtccgcagctgtcccagctggcgtcttatgatcctcttcagcctcagccttgtacgctgccacctcgtcgtcagcggcaaagatgtaatgatcgggataaacctcgaccattttacgttgcttgttgtcgccttcgaccttgctggcgtcgtatggaatcggaatacgcttccgctcgacatctgggtcagggacaggaatggcggacagcagactcttcgtgtacggatgcagcggatgggaataaacttcgtcggcactggccagttcgaccagacggccatagtgcatgaccgcaatgcgatcggaaatatacttcaccatcgacagatcatgggcaatgaacagataggtcagcccttggcgatcctgaatgtccttcagcaagttaaccacctgagcctgaatggacacgtccagcgcactgatcggttcgtccgcgataataaacttaggctgcaccgcaagcgcccgggcaatcccgatccgctggcgttgaccgccggagaattcatggggataacgggtcgcatggtcggcgttcaagccaacttcttccagcaactgttcgacttggtgatcacgatccgccttgtccttggcgagatggtgaatatcgatgccttccgcaatgatgtctttgactttcatccgcgggttcaacgatgcatacggatcctggaaaatcatctgtgtgtcccggcggaaagccaacatctgcttggaaccatttttgagcttggcgatgtcctggccgttgtacagaatctcaccgctcgttggatcatatagacgaatgatggcacggccggtcgtggttttcccggaaccggattcgccaacaaggccaagggtttcgccttcgtagatatcaaacgaaatatcctgaatcgctttaacttcgtctttcttgccggcgttgaacgtctgaaccagatgcttaacggaaacaaggacttttttcttatcgtcagccatgtcagttcaccaccttctcgtttggatgcttacttgcccacagtgcatgccgccgcgcgatttccgggggcaactccactttcggcgcacccggcgctaacagccaggtcgcggctgaatgcgtaggcgagatcttgaagaaaggcggttcctgttcaagatcaatggccatcgcatacggattacgcggagcaaacgcgtctccttttggcggatcaagcaaatccggtggcgtgccggggattgcgtacagccgatcgctctttgtttccagtgtcggcattgcttccagcaggccccaagtatacggatgctgggcattgtaaaagatttcgtcaacggcgccgtattcgacaattttaccggcatacataaccgccacgcgatcagcgatcccggcgacaacaccgaggtcatgagtgatgaaaatgatcgacgtatcgattttggactggatttcttttaacagatggatgatctgtgcctgaatcgtcacgtccagcgccgttgtcggttcatcggctaacaagatttgcggatgattgatgatcgcaatcgcaatgacgatccgttggcgttggccgccggagaattgatgcgggtaatctttcaatcggccacctgcgtccttgatgccgaccagttcgagcacacgttctgcttctttcaaggcgtcggattcgctaatcttgttgtgcagcattaatggctcagccacctgtttgccgatcgtcatggtcggatccaacgatgtcatcggatcctggaaaatcatggcaacatcattgccgcgcatggcattcagctgtttctcggactttttgagaatatcgacgccatcgaagagcacttcgccgtgggtaatcttggcattaggcgccaacaagcccatcacggtacgtacggtaacagatttcccggaaccagactcaccaacaatcgccagcgtctcgcctttgttaaggtcaaaactgacatcccgaatggcgtgcaccggtccagcataagtggcaaagtcgatttccaaatctttaacttccagaattttagtcattttgccacctcctaatgttcactacgcggatcaaacgcgtcacgcaagccatcagctagcaagttgaacgccagcatcaggacaacgatgacaatcgccggatacagcagttgatatggtagaacttgcaggttcttctgcccatcggataacaacgtcccaagactggcagttggcgctggcagcccgatcccgatgtaactcaggaaggcttcaaagaagatggccgttggaatcgtgaacatggtttgaatgatgataatggagctcaggttcgggatcaaatgcttgaacgcgattttgacactcgactcgccaagcgttctggccgccaagacaaattcctgatcttttaactgcagtgtttgcgcccgaatcaggcgggccatggtgacccagccagtcaacgcaattgccaaaatgatggacgtcatccctggtttgaacacttgcaacatcaagataacaacaaccaggtttggcacactggagatgatttcaataacacgctgcatcaaggtatcggtcatgccgccgcgccatccggagatgatgccgtagaaaaccccgatggtcagatcgaagaaggttgcgacaatcccgatgaacagtgaaacgcgggtgccgaccataatacgggatagcagatcacggccgaggtaatccgtgccaagcaggtagtaaacatttttgcccatgccggcgtatttattttggccattcaggtaaccgtttaatcctggcaaatcaacgcctggccattttggtggcaaattggaatagttcaggttctgcttgttaggattcgaaggtgacagccacaaagatagaatcgaaatgaccgcaataataatcaagatccaaagtgagatgagcgcggctttgttcttcttcaatcgccgcatcgcatcttgtgagaacgtcagcgcaggcttggcaatgcgttcctgttcagccgtattcactttgacatgcttgaatgcgtctggacttaattttgttgttgccattagtttgcctccccgctcagtcggattcgtggatcaatgaagccgtagagaatatcaacgattaagatgatgacggtcaacattgcactgtaaagaattgccaaagccatgataaccggatagtcgttggtcgtgatcgacttgacgaattgttcaccaatgccggggatcgcaaaaatattctcgacaaccagtgagccgaccatcaagtcaaccgccattggtccgatgatggtaacaatcggaatcatggagttacgcagcgcatgcttggcaacgacctgccagcgtgattcgcctttggaccgcgcgagctcgatatagtccgaactcagcacatccaccatttcggtacgcataaaccgcgccgtctgagccagtggtgcaatggcaagagcgatcgtcggtaaaatactgtacgtaaatccgccccacaatgcgactgggaaggcaccagttttataagcaaacagttgtaacaacgcagcgaacacgaagttagggatggaccggccgagaattgcgaaaattgtcgcggtcgcatccacccaggtattcttccgaatcgccgcaattgcaccaagcacgatgccggcgagtgtgccaacaaccatggcttgcgcaccaatttgcagtgacggtcccattcgcgaaacgatcaggccggacacggtttgaccgggatactgatacgacatcccgaagtcaccatgcgtgatccctgccatatacgtgagatattgcatccaaaccggcttatccagtccatactgtttctttaaaattgccagttgatctgccggaattttaggattattaaacggggtccccggcagtaacttcattaggaagaaagtaatggtggcaacaagaaacagcgtcaggagcaggaagccgatccgttttaaaatatatttagccatgattcactcctgttttttgggtttttactcaaacggcgttgtcccgccgcaaaacacgtgacaacgccgtttgtgaagaattagttattgagccgacaactcacagtactagaaatgaggtttgagttcatcttagcttctgccgatcctcacttgaccgttgcattaacgaagtcgtaagcacctgttgggttgtatttcaaattagaaattgtcttacgttgcaaggttgtttcaacccgttgatacagtggcacaacaccctgttctttggtcaggatttcttgggctttcaacaacgtattccaacgagcagtcggattagtcgcatccgttgtcttggactgcttgattaacgcatcatattgtgcgttagaccacttaccatcgttataagtgttgtcagtggtgaacagatccaagaaggaaatggcatctgggaaatcagcattccaaccggagtaaaccatatcgaactgaccgttttgggctcgtgatagacgtgtcttgaacggcaccgtcgaaatattgaccttaaagcctggcaatgcttgttggaaagcactctgaaggtattctgcagaacgcttagcaccagtcgtatcatcggttaatagttccaaggtcggtgctgactggccagtttccttcaaaccttctgtccaaagctgcttggctttcgccggatcatacttggtagcagacccatcgtttttcgcagcttccttggcaaagtcttgaccatttttggtgaataaaccttctggtgttgcgttggcggcaggaattgaagaatcattaagaactttcttgatgtattctttacgattaatggctaaggaaattgcctgacgaatcttggcattcttgaaaatcggatctttcttctcgtttaattcaaggtagaaagttccgttttgcttgagcccgcgataatctgccatcgttttggcttgagccgcctgctgtccactaatctttgttgcaagatccagcttcttggactgatacaggtttaatgccgtctgggaatccttgaccacttggccattaatggtatcaatatgcacgttctttgcgttccagtaagtcttgttcttggtttccttccaagtgttaccagttccgttccagttcttcaactcgtaagggccattggacaagagatacttagaagccgtcccatatttcttaccagctttctcaacaaacttctgattttgcgggaagaatgccgggttaaccaacatcgtcttcaaataaggaatcggatgttccagggtgactttcaaggttgtcttgttaactgcctgaacgcctaacgtgctaggtgctttcttgcccgccgtaatatcatcggcattcttcacaccggagtataagtaagcgtattgcgacttggtctttggctcaaccgtccgtcgccatgcaaaaacaaaatcttgagccgttaccgggtcgccgttgctccatttagcattgcgtaacttgaaggtgtaggttttaccgccgtcagttaccgttggctcgcttttggcaattgccggtttcagtttattgcctgaatagcgatataacccatccatcgtatcaatcaacgcttggccaccaatgacgtccgtgttggttgagggatccatcgtggaaataacatcagattccatccgcgtaatggacttgccgttactgcttgctgaattagaaccacaggctgctaacaccccagcgagcgcaattgttgtgcccgcaaccattgtttttctaaatttcatcttgttccctcctaaaatgattgaacttaccttacattagaatctcattaatgtaaataagtaaaccctcaatttcggataaaaaaaccgcgatgtcagaaaatgtctcgtaaaaaggttaaacctagtatcaaataacaaatcgtacaaggcttatacgaatgttttagatagcgcattaaatccagaaatagcaaagtttgtttcgctggcaaggagtgacattgaaaactcgctgcaatattggaagctgcagcaacccaaatattaaataacacgcacttttggcataatttcttccagttttcatgaaattgtgtgttttgttcgaataattttcgcttctgtcaaacaacttgctattcatgtgctcactaaaaaagcaagaaccagctctgctgctaagttcttgctaattattttcaaagtaattacttattattagtgagtgtcttaccatttttgcggctgcggatgcttcggaataccacaatcaccaggccgacgacggagaccaaagtggctaaccaaaagaccgtagccagtgcgtgtaaaaatggttcgccggattgtggcgagatgcgggtcacgccaggaagttgggcaaatagcaaggttgcgccgaaactgatgccgatggtcaacccgatcgtgcgggccagtgagttcatggaaccggcaaccccggagaggctactgtccacggcgcccatggttaaggcgttattcggcgacaggaacaaggccatccccgcaccattggcgacaatcggccagatgatcggcgccatggttattttggcgggataactggcatacccgatttgcgagatgatcaggacgaataagccgagaatcgtcagataatagcgattccagtgatcggccagccaaccggcaaatggcgtaatcatcagcatcgtgacactctgcaacatcatcagcaaaccgctggcgaacgcggaaatgccgccataactctgcaggtagaatgggaggagaatattcgataccgaattgaccagcatcacaatcaacaacacgctcaccgaaatcaaatagtccggattgtgcataatgctcggcgcaatccacggcgagcgtgagcgttgatcctgaataaatgccagaatcgttaataggatcccgcctgccaaaatgcctgcgcccagccaaagctgttttggctgttgcagccagtacccactggcgaacatcaaaatcatcccaccggtgaacaggttctgcccggtccaattagcttgttgccagacgcgcctgatctcaccatgcgctggccgtcgtaacggcaacaaacgcataccggccaaaacaatcatgattcccaccggtacattgaacaaataaatccagcgccaactcgcccaagtaatgaggataccaccgaatgccgggccggaaattgatcccagcgacacgaacatcgagatgacagcaagggcttctgcgcgattagcgtccggaaaatattggctaatgatgcccatcgaattggccataatcattgccgagccaaccgcttgaaccacccgacctgccataatagtcagataggtcggagcaatccccgtcaacagcgagccaacgataaacacaacttcgccaatcaggaagaccagattcttggagactaaatcgccgatatgcccgaacatcaccaacaaaaccgctgtcgtgatgagaccaatggacacaatccaggtcgccgcactactggaaatcatcaagtcttcagaaatcctgggcatggctagattggtgctcgatccggatagcgccgtcaataacgacatcatccctaaaacaatcagaattttaatgcgttgcgcccgcgacatttccatcgtccccacaccctttcgagtgtattctatgctcattgttattttgtaacaattaattagcccagagcgcgaactggcccggttagaagccggagcataagtggcctcaagcttaaatggctggtctttggccatttaagcttgaggtccttatgtgcaggcttctgggccagtgagcgcgtttcggaaccggattgcctgcccccaaatacccccaagtttggctatcaagcccaaggcccttacacgcaggtttctgggtccagtaaacgcgttttcttttgccaagcatggtcatccaatgctacccttgcccatcaaaacccaactagacttttcggccattaaaaaagcgcccctttaactggacgcatcttgctatttacttctgagcacggcctttgtaagtaccggtatcggtggtgaccaaaatcttttccccagccttaacaaagtcgggtacagtaacgaccaagccagtttcaagtgtggctggcttgccacctcctgcgactgtgccgcctttgaccgctggctgcgtgtcggtgacttcaagctcgaccgttcccggcagctcgaggccaatcacttcatcaccatagaactcaatttcgaccggcacatttggcagcatatacttaagttcacgcgcaatgctggcagttggaacctcatactgctcataagtatcactgtccatgaaataagcggtgtcgtcttgcgtatacagataagtggccttcttacgatccatgatcgcaatttcgaccttttcactcggccgcatcgtcgtggtcacgttggcaccggaacgcacatcatacagcttcatctgcatcacggtattacccttgcctggcttgtgatgattcgattccaaaaccttaatcaacttgccatccttaacaaagaccattccggccttcaaatcgattgcttctgtcattgagctatcccctttattatgagcaaaccggcgccagcaaaatgtgtgagcgcgtttacaacctaagtgttcactaagcaccggtacaaatcgtttcatcagcaagtataccatatctgtatgaacggtcacttaactgaaaaaagtggcataaaccccgccgcaccaaaaaacggccacagagacaactgctgtccctaagaccgtttcattcaggcatctcgcattaacgagctacctgctacatatcttcaaccaccaaataagtcatatccagcggcccgtgcaccccaacaaccaacgtcatttcaatatcgcccgagttcgatggcccggtgatgaagttaatgttactggtctgcagttcaccagctttgatggcggcatcgtaacgatccatcgcctgccgtgaccgtggcaaaatgttgcttttcttaacaatggcgagataatgcgttggcaaaaagtggaacccgcggccctgcccaggcgttgtcgcaatggtaatggtcccggattcagccagcaggtaatcggcaaagccaattgcaacatcagccgcagccgcctgcttcaagttgaagtcgcgcccttttcccggcgtccaatacatcggcttcggcacaacggttcccgtccagtcacgcaggccaaaatcctcatactgatccgttgtcggcagaataagcgttttcggcgcgtcgtgttcaatgtaagcattcaacgcatcggccagcccagccttgtccgtcgtggaaaaagtcacatgcacggcctcgctatttttcttggcgatcgcttccagctcgtcttgcgaatggccagacaacgtggtttccggcagatcattcagtggctcaaacgggtgatcctgaagctggtggcgcgggcgaccggctttttcggcaatagcatttaaaaagtcttcgcgattactgtgatcaatcatgtttttgcgcctccaatgctgctttgtgttgtttgaaccagtgccggaagttctcattcttcttcggcgaccgcggtaaatcacgcacatcggtccaaccgcgcgccagcttcggcatcataccggtttgtttgattcggccgctgttgtattcattttcaacgctgccttggtctttggtagccaaaacgcccatcatcgcatgatccatatcaagcgccatgttgaagagaaccggcgcgctggtgccgacaccgaccattttcataattttgtcgctaaaactatgatccatcttcagcttgtccatcatgacttcacggtgcttgatcagcagatggtgcagcggaatgcggacaggacaggtttcggtgcaggcggcacaaaggcttgaagcaaacggcaagtcgccgaacttttcatagccgtctagcactggtgacagcactgcgccgatcggtccggggtaaatcgagccgtagccgtgtccgccgatatgacgataaaccgggcagacgttgaggcaggccccgcaacggatacactgcagcaccggttcaaacggggtgccgagcgcattgctgcggccgttgtcgacaatgactacatggaagtcttcggggccgtctgcttcgccttcgacttgtttaccggagaaggaacagtaactggtcagcttctggccaaccgccgaccgcgacaacatgttatccagcgtctcggcttccttcagactcggcacgatccgttccattcccatcacaaccacctgcgtcttcgggatagccatggtcagatcagcgttaccttcattggttaccaaattaatcagcccggagtcggcgatggcaaaattacagccggtaatcccaaagtctgcctgtaagaagtaacggcgcaggtattcccgggcaaaccgcgccagatgttccggatcgttgtcgccttcataaccgagtttgtcgaagatttctttgacttgatcgcggtttttggctaatgccggaaagacaatgtgcgttggttcggcccaatcgtcttcttgcaaaataaattccgccaaatcggtttccatcaactgggtgcccggaattttcaataattccttgtccaggttgatctccgtggtcaccattgacttggacttcacaattttatgtgcctgcttttccttggcgagcttcgtaatatacgcagccgcctctttgtcggttttggcaaaataaacgtgaccgccgcgcttttcgatgttatcgctaaattcttccagataatccggtaagtacttaatgacatgttggcgaatctgttcgcctagatcccgccattgcggccagtttccgagctccttacgtgaagcttcccgcttgtcccactgggcatcttgcgacttggcaacgctggcctgcatgaatttgtcttgttctgattccttaacccgctccaagaacggcttgtcactggttgaaattgtcatgggcgcacctcctgttcgaccccaagcggttcatggaatttgatccgctccggattaacattgtggttcaaaacttccgcgatatgcatgatcttgatcttttcatttcgccgggaaaaacggccggcaatgttcatcaggcaagacggatcggctgaaatcagaacctgtgcgccggtgctcaacacatcgtcaactttttcatcgaccatttgtttggaaatttccggctccttagcagagaacatcccgccaaagccgcaacagttttcgatgtgcggcaacggttccatctgcaaatccttcacatgatccagcagcttaaacggcgccgtgcgctcaccgagcaaccgcgtcatgtggcaggaacgatgataagttgccttggcatccaactcggctccggcatcgatgacattcagcacgcggtatagaaattgggaaaattcgtacgtcttgtccgcgacttgcttagccttttccgcatattcgggatcatcctttaacaaaatccggtattcccgcaacatgttcacgcaagaaccggctggcccgacaatataatcggcgtccaccgacaacaacgcatcaatttcgttgcggaacaccttctggctggctttcacatagccagagttataggttggctgaccgcaacaaatctgtttgaccggcataaacgtttcacacccaaaccgctcaagcacttcggtcatcgccgccccaacattgggaaagaaaagatccacgatacaggtggagaaaataacgactctcataatgcacctcccatattacaatgattccaatttaactatacaccagtggcgctaaatgcaacaccgaaaacgcttccaaaatggcaaattgttattttgtgatcaagttttcctgccaagacagtcagcaaaagccttggtcataccgcgttattgtgacatacgccacttagcttaaagccagattgcgcctagctttaagctgttttaatcgtacaacgcttatgcaatcataagcaatgattggttgtggtcaattcaatgatataaaatcacaattatttaaatggcgctggtcgtgtcgaggatggtcagcactttaacttttgccaagttgatgacctcttttcctctgtcaaaatccctgttcctctgttgcatccatttctaaatcaggacgagtatagcaggttgttccgatcgagccacatgaagacacttgggatgttgggtgttaacgatcactaacttttttgcgcgcaatattcgtttcttttacaataatatcgatttcgacgaacagccttgcatattttccctgttccacattgatatatcaatgtttctcgatgtttcacggccttgattttttgtctaaaaggactaacattaaaggtgagttaggtttacctaaaataactcaaaaatggaggcgggtttatgcgtaagcgatatagggcaacgttgcgggcacttaactcggattgcattggccgccaagcgcacggatttgcaaattttgaagtcactgatgatgatgctttgcaaatccgaatagagatgttcaatacgccagcggatatgaaccatatggcagtattggaaagtaccggatcggatgcaccggttgcgccggcgactagcgcccaggatcagaatcatgacggtgtggttgatgaagaagaagccgagcaagtttccggcaaggtctttgtgccgctcgacaatgcaccggataagctgaaactggtcggcagcaaataccccgaggccgatgacaatggcttttacatttatcaacagcgcgtcgttgtatccgcactgcgcgaccaattgcgcaagcgctatggccgcgacgtgctcaacctcgacaacacggttatctatgtcaacggcgtgcaaagtgatgttattctgcctaagaccgtggcaagtgatctagacaaaagcaagccatatcttactttgccgattgcggttggtaaactgcggaaagttatgggttaattctgtcccagactagcaatcgagttatcgcgtctcacacgtcaatctaaaaagactggaacaacgcgcctgataagttcaggttcgcgttgccccagccttttgctgagttccgattcaaattttgtaaagcgcacgcaatagtttttgcgccgtaccaaactccgcaatctccggccagctgagggctggcgacagcgaagctagagtggtgggcacgactttgaacccgcaaaaaccgcggtttcaaagctcggccttggtctaaaacgggaagatcgcccgttttagaccaacttcacaactgagccccatctgacctccgattgctccgctttggtactacggtttacacgtgcctaacgcactatcttcctggacatgaatgatacttcacgtaccactattgttaatcagtcactgcggttacttccgccaagcgctgatacaccgccacgacttcgccagctaaatcgcgaaacgtgatcgcattcattaaatgatcctgagcgtgtaccatcagcaacgaaaccgtcgcatgctcgccgcttgcctcggccgttagcaattcggtctgcacattgtgagccgttaccaatgcttcatcggccaattttaaatgatgatccgcttcgctaaagtcaccggttttcgctgcctgaatggcttcaaaggcctcgctcttagcgtttccgccagccataatcaaacccataatcgtttcttcgtttacttcattcattaatttattttctcctcggattaatcttgaataagttgctactcggcaacacgttttagcataaacgtccgccacggcttcaacaatggcaacaacgtcaaatcttcatcagtcagttggccgattttattgcggcgcccatcgttgggcagatcacgcaacacgatttgcaactcgcctgcgtaacgcttgtaagtttcattgaccaccacgacatccccgcggtgcaagattccggtggcatcatgtgcaggaagcggttgcccggcgtaacgcacacgcggttgggtatcgcgaatcaggtagtcagacgcatcgccgcgatacaggtgagcttcactgaacgcaattttggcctcgagatccgcaagcgatggctcagtggtcatccgcaatgtcggataaggacaaaagaatgccaatgccgctgcttttaaatcggcctcacttgccaacgcgttaccaatgaggacgtcatcaattacctcagtcaagcgcaggtgatgcacttgactggcgatcgagcggtgacgatcgctttccaacgtcggcaagccttcgctgaccggccacggcccgtgatccgcactcggcgcactgataaaagcggctgttcggagtccatactgccgaaacttctgggaataagccaccatccgttcatcgcctaagccagtgtattcttgcggataaaagttgtgacaacctagtaagttcgaccgccgcggaccaaaggacatgatcgcatcaatcgcattcgtcccggcgctcatgttgagttcaattttcagaccatattgattatgcgtcatcaaggcttcttcctgaccggtgaagccttcatcaagacgcaggccccaaacgcctaagtcatggaagaaactcagatcatgatagtcaatgcccagttccttaaacagcggcggcgcaatatcgacaatggtttgaaaaccgagttgattggccttggccaccacggctttgaaaaccgcaagctgatcgcgaccgtggtctcctgacagttgtagcagtgacgtgaaaagccggtggtaaccgaattgctgcgcagcttctaaataggcagttgcctgcgcgaccgttgtttgttccggatagaggctgatgccaagtttgcccatagttcctccttttagcgtttgttgcgcgtgatctttcagcgattatggcgcaaaagatctcgcttcatttttgtaaagaccgattaagccctcaggtgatacacatctggcgggccatttttttaaagcggcgtttacggaaccaaccgagcaaaaacccgctggcacgattattggcggcaccacgcgcacttttggcgacaagtgactcttcatagacgagccgacttttaccgctttccagtggggttaactgatagcggactttaaaatcatcccgcggcgttgccaactcatacgcatagactgaattaggttcgaactcggtgatggtcaaccgcgccgtgcgtccattcggccaatttttggcataactgtatccgcgcagacttttaggcaacggttcacgccccgtatgctgacgaatatcggctaaggcggattgttgcagttgattgaaaaagacgttcggtgccaccggtaaattcataataattttcatctcggcctccttttagcacgatgcagtgtggtggatcaacccagatcgtgactgcgttggtttattttgctttggccagaccgacgtaccagcgcgtgcagaaaatggtggcgatgacgcctagaagacagccgccaatgcgccaaggggtcggcatgaacgcgcttaaaacgatgatcgccatactgatgttgatcagaattagcgcggtggttgcggttttcaaatcgcatcaccttctaagttgcgatcgtcatcagctgtttctttgtttttttctgctggcggttcggtcatgtgcagctccggatccagcttattggcagccttgacgaacggtacataaatcaggaagccgataaccatgttgacggcctgtaaaatcggtgcgcgccagtccatggtggcgatgatcgagttgataaatggtggcatggaccacacgatttggttcttgaccggcgatacccagcctagcatgtgtgcgccgtacgcgattgagaccatgacaaccggtgccgcgatgaatggaatgaagtaaatcggatcaagcacaattggcagtccgaacatcactggttcgttgacgttaaagcagccgggcgcgatcgagagttttgccacggtgcgctggtcgtcacgcttggagaacatgaggatggcaatcagtaatagtaaggtactgccggcgccaccgatccatgcatacagatcgaaagcgttacgggtccagacaaacggcagtgcttcgcctttcataaatgcattcatattggcgatttgggcggttaaccagatcgagtccaaaaccggtcccaagacgttggtgccgtggagaccgaagaaccagaaaatctgcaccagtagcgtcatcagtaacacagcccagaaaccttgggacatattcaaaagtggttcctgaacaatcgtggcgatgaactcgatgacggtggtcttgttgacgctgaagaggtaattcacaacgccagccaggtataacgcggcggtcgcgggaatgatcccggtgaatgccttggcaatggctggcggcaccgattccggcatgcgaatcgtgacgtttttcttcattaaccagatgtagagggtcatggcaagggcgcccatgatcatgacggtgaagaagccataggagccgaagaacttgttgaagttgaagaagccccacatgctgacgtttttgccgtctacaacgccaccggcatcggtgatcagtttggccgcgcttttacccaatgttccttttaacgctaaggtaaagttctgcggcaggctcatgatgaacgtgccgagaacaacaatcccgccggtcaccggttctacttggtactgaacggccaggtggtacccgaacgtgaaggcgaagagcagacctaaaatggctaaggttccggtccacaccatggcgttgatgccgatgagccattgcatgctgttgacgatacccatccacttgaactgtgtcgggatgtcccgaattaaaacgttcaagacggtggataccgcaccggccatcatcgccggcatgatcgcgataaacgcgtcacgtaatgcgactaaccagcgaatcgatccaatctttgctgctaccgggacaatatgccggttcagccaaccaataaatgcattcatactatgcactcccttcaaaaattttataatgtcgttattagtgcttaactacaattaaaattctacgggagtgccagatggcaggtcaaagattatagtagttattgtttataatttttataagcaaaatgtttgactttatcaacaatgatttctggcagagggcgttagtaatgatcgcgctgctgcactgtgcggtccttattggaattatcagttcgcaaagatcccaagctggcggagcggcgatgggctcagtggtgcaattgtactagccgggcggtcttcccggcgtagtacaaggccgagctttaagactcagccggttttgctgaggcttaaagtcgtgcccaccacgttccagcccaatcgccgcgtagccagcttggcgtatcgggagccacttagtcatcgcagaatctcaaaatgtcaaccattgtttggctaaggatgccaagcaaaacaccagccatttgcttataatagattaaaaccagagatttctcaggaggctccccatggcaaatattgaatatgatccgcaacgccagctttttcacctgcataacgccacttttagctacattattcaggtaattcgcgggtaccttgtgaagcgttattgcggtccagcgctggagcagttttcggggacggcgaagctggaagatttcagccatgcgtttaacattcaaaatgatgctgcgccgttttcgctgacgaccctgccacttgaatacagcacgctgatgggtggcgattatcgcacgcctgcttatgccgtacggaatgctcatggccagttgatcggtaatctcaagtttcacgattttcagattctggccggtaacgaaaacttcaacggcacgctgccgactgcgcggacgccgcatggtcagacgctgattattaccatgcatgatgaaaccgatacgttggcggttcaccttaaatacacgatcgttggcgatttgccggtgctgcttaagcaagtggcttaccgcaatttgagtgacaacaccctgacgattacccatgcagccagtcttcagcttgattttgacgatcatgcctacgacctcattaccttgaccggggcgcatctgagcgaagccagtgtgacccgtcagccgttgacgcctggtaaaaaatcaattgccagcaattatggggcgagtggacctcaaggcgtgccggcaacgattttggcggcaccggcgaccgatgattttgcgggtgaggcgctgggggttacgcttttgtggagtggcaattttaattacacggcgcaagtagatcagtttggcaatagtcgcctggtgatgggcttgaatccggaactcttttcctggcagcttaagcccggtaagccgtttgtcactcccgaggctgcggttgcgtatacgactaagggcctgaatgatctgagccatattttccatcaattcttcgccaatcacgtcatgccggtgccgcgacagaatctaattgaatataacacgtgggaatcgacttattttgacgtgagcgaagccaaggtgctggcggagattcccaaggcggaggcgctcggcgtcgaattgatcgtggtcgacgatggctggtttaaaaatcggcccaacgatgctggccagcttggcgattgggtgccggatccggttaagtttccacgcggcttgcggccagttgccgatgccttgcatgcgcgggggctggcgttcggcttgtgggtcgagccggaaatgatcagcgaaaatagcgaactgtatgcggcacacccggattgggccatgcaatatgtcgggcaaaaaccgttgcggtcgcgtaaccaattggtgttggacctcagccagcgcatcgtgcaggatcatttgattgccgtgttgactgacttggtccggacgaatcacatcgactatctaaaatgggattacaatcgccacttcagtcagcccggcagcccggttttgccgccggatcaacaaggtgaagttggctaccggtatacccgtggcttgtatcgcgtgttgaaaacgttacgcgatacttttcctaaactcatcatcgaaaattgttcttccggtggtggccggttggatggtgggatgctggcgtacaccgatcagacgtggaccagtgatttcaccgatccggtttatcgcatgaagatcatgaatggcttctcgttattcttcccgcttaaaacgttcgtctcccactttacgatgtcacccaacctgcaggattcgcgggtgacgccgctgcgaacacgggcactgctgagtctggtcggcgtgaccggcatcgagtgtccgccgagccagctcagtccggctgaagccgcagcggtcaaagccagctttgccttttacaaagccaatcgtgccgaattgcaaaacggcagcctttatcgcctccatcccagccatccgaatcaggatcaggtctgctggctcatcaccgacgaggcgaaaaccaaggccatcgtcctgacgtcagccggagtcattgcgccgattccccactatcagcatgtcctgctgcactatctgcgcccgaccatgtcgtatcagattaacgacaaaaagaccgcaaccggtgcggagttgaactttgccggcgtgaccttgccgcttgcgcatggtgacttttctgcaaccttgatgacattgcaggctgtcagtcatctgccgcaaacaacgacgcaagcgaatggcgatattgcgaagctgccgttttaacagtgtcagcactgccattttttgaaaatggctcatcctactcagaaagtttggttttctctatgaagttcatcattgcaccggccaagaaaatggtggtcgcccaagacgatttcccggttcaaagccagccgcagttccgcgatcaggcggcaatgttgcttaagcggatgcaacaactttcccaagcggaaatgcaggcgctgtggcaaaccagtgatcgcctgacgcaggcggcttatcaacaactgcaaagaagtgacgtcacgcgccagcagtcaccggcaactttcagctatgtcggcattcaataccaatacatggcacctgatctgctagacgatgcgggcttggcttacattcagcaacatctgcgcattttgtccggcctatatggcattctgcgaccattcgacggcattgttccttaccgtctggaaatgcaaacgcgcttggtcatgccgccttaccgtcatttatacgatttctggggcgatcggctttatcaagcgctggcagccatccccggcccgatcattaacttagcctccgatgaatacgccaaaaccatccgcccttatttacagccggacgacaccttcatcgacgtccgctttgctcacttagttaagggcaagctcaaaacccgcgccacttatgccaaaattgctcgcggcgaaatggtccgctatgcggcgatgcatcaagtttcgacagttgcggaattgacgcagtttgattcgccgacttatcgttacgacccggagcgttcgacggagacggaattggtttttgtggcgaaataggccatggcgtgcacaaacgagttgataaactaaaggactgctgtatattgtcaaataatttggcaatatgcggcagtcctttgtctggttcatttatattcttgagaatgcgatcaaattccaagtgccaaggcggagcaatcgtaggccagatgggctcagctgtgagattggtcttaaacgggtggttttcccgttttagaccaaggccgagctttgaaaccgcggtctttgcgggttcaaagtcgtgccctccgctctagcttcgcggtcgccagccccgtcctggtaggagattgcggagtttggcacgacacactttaaatcggtatcaacgttcccttgtcaccttttcaccggcaacttggtaacttcctcaacaacctgattgagaatatccaactgctcggcatacctcacactaaatggctgggtggcagcttcaggtttggcggcggtgacagcagcgcggggctgaatgccttggtgccgctgatgatccagccaggccaggatctgttcgaacgtgaaacgactgaacgtgtcgaccgttaattgccctgaaagcagactgccgagcaggtcatggcgggagtcaatcggataaattttggtgcgcgccagcaagacccggaaatcgccaaaaaagataaactgtgactgggttcgcgtcagcgctgtataaaaactctgcgcatttagcatgtgatccgcgccgttgacgatcgcaatcaccgtatcggcttgaccaccctgcgccttgtgcaccgtaatcgcatacgccagcgtcaaggcacgcggtacactgccaaaactgtaataacaatattgatcgccgacttgaaccaccagaaaatgccgcttgggatcgatatgtgccacaacacccgtatcgccattcgccatgatcgtctcacgccagcgcttcgttccgaactcatcggttttctggaggccattttcacctaacacagcgcggcgttcccaggttttcgggtcaaccaaggccacatgtttgtcatttttcagaatcatcacccggtcgttaagacgcaggtggtgtttttgattggtcaccggatcaacgtagctgctgacgtactcgggctcgcccgccttggcagggttaaccagcgcctgaagttccgcattaaaccgcaaacgcccggtcgcaccgatgttcttgttgactatcagcaactgcgaatccggctggtggccatgcttggcaagcgcctcttgatacgctttgatgccggcgtcgaaaacccggcctgcatcgcgctgattgtatagcgccacattaccactcacatatcggtcgtcatccggcccaaaaggcaacgccaaccgatcacgaatgcggttagccagcgccaacacacctgactggctgtcctgccgataaacccgggtcagcgtcgttgccgcgacgtgctcatctgccagacaatccttcaaaaagtttcccggaccaatcggcggcaactgaaacacatcacccacgaacaggacgtgcgacttcttgaagttcacatttttcaacaccgtatacgcaagcggcgtcgttaacatcgaactctcatccacaataatcaaccgcgcatcgccaaacgtctcccagtcagcctcagaatcaaaccgatcgagttcttcaccaggcaaaagatgcagatacgcgtgaatcgtcgccgccggttcgtgagtatagcgcgccagcacctttgccgcgcgaccggttggcgccagcagcacactttttcctttagcctgcgcattgaaaaagtgcaccagcaagttcgtcagccaggttttcccagtgccggcactgccattgagcacacttaatccatgttggttaacgttttgaaaagcggcccgctgctgatcgttgatgaccagctggtggcgatccagaaacttatccaatttttcatccagttccgctggcttaatcaagggttcggccgttttctgcgccacggccatgatcctggccaccgaaccttctgtcgcaaacatgtcgcaactggtgaccagatcgtattgctcgtttaacaaaaagccatacgccaacgcctgtttgggatcagcaaacatggttaagtcatccgtgctgacgcccaataaggtagctgcctgctccttgaaccaagtaatcgtaatgtaagtcagtccctgcgtcagcaccgccgtacggaaaatatattgcagcccggccgcgagtcgatgtggatcattcggcgccaccccgcgacttttcgcaaaggcatcgacctttttgaaatcgagttgcgccacctgcatcaaaacatacggattggcatccacgtgctgcatcgccaactcggcatctttatacgccaaccagattttttcgtacgtcatggaactgagcgctttgccccagtggttcgccaacaccgcgacttcaagtttgccgcgaatggcagtagcaattttttgaatcgtcgccggcccaacgccgggaattttcgctgtcttaatctcatcttttgaaaaaagggtcaaaatcggcgcgtcatccgcaaaataatcgtgcagccggcgcaaaaccgtgggctgatgtaccagcagcgtgtcgatcagctgccactgccgccgcggttctttgggcaagccaaaatgcagccgcgcaaccttataggaaggtttgcgataacgcagggaatccgcgtcatcataaaccaagtcagccgtgatgatggcccggcgattgtaatagcccatatcgccagtcacagtgacttcctgcgtcagcgtcattttcaacttaggattcgaatttaaaattcgcacggcatacactttataatcgctgctatcgctgttaaaaagtaacttgataatctgcaggtcgacattttcataaacttgggcttgctccacggtacaccagcctcctttcaattagatttcgcagtgattgtcacaactgcattcgtagcttggtcgtttcatgggtggcatcacgatccagtttggtggcaatgcgaaaccgaaagtcagacggcagcgtcttgagttgttgctgcgcccattgctggagaaacgtggcttgatggcgcggttggtagaacgttaagtcatgtcggtgggtgctataaaccaccacgtcttggcgttcatgctgcgccgcccactgcaacgctgccaccaacgcgaccagcccagcggaaggaacatagaaattgcgcgccggcttgtaatcatccggtgttaactcggcattggctggcgcatcggcgtaggccagctccttaattgcatcatccaaaaattgcgtatgccgcaacagctcatggtcagccgcatcagttattttgatgccaaaccgattgccattcaaatcgttcatccacgccaaataagccttcgtctgggcgggaaaatccgcctgctcggcttctttttggagattcaccatcccgcgctgcagcaaaacaccttttgccgtcacgccattcggcaatttgatcagctgctggtgctcaggcgatgtttgatcgggttgttcatgtttttctgtcatcattgcctcacttctcaataagcttacctgcgcaggcggtgggatgcaaacgggattaaggcagtttttgaattaatagtctgaaaatatgtagtgatctaagaaccctgaacaactcaggagcttaaagtacttcttagaaaagaaggattattagtgttccgacgatattattaagaacgtgaaggacaatggtgttctgcagcttaccggtttttgaatagacagttgcaaatacaatgccagaaaaggcgtataccaagaaaccaaagacggtatcggtcgcatgaaccgcggcaaacaagccggcacttaacaatgttctaagcacgattctatttgggctaaaaaacaagttgaaaacaacgcctcggaaaatcaactcttccgtaatcggtgcgattagaattatttcaacaataagcagaaccgtgactgtccagttagcgtccataaaagattctctaatcatttggctgttaggcgtttctgactgatggtaaatcagatcgtttaaagccaatagcccttcgtccgcgattacagtaatgacatatccaccaagaatgtaccaaatgtcgcgaagctcaaccttttgtatcattcttctccgcgtatatttaaagacaatccgatacgtaatgtaaatgacgaccgcacttgacaaaataaatgcagcggccagcatcattgatgacgagatccttagtatgtttggcatgatctctaagaagatcgaaggaacctgccacaaaaaataaagtaatacaacgtacgccattcgtttaaccagagaatctttgctgctattcacaaattatcacagtccttcactattttttgaataagctgttgatcgtcagagtgagcgatccatgaatcgacccacggatttttgccagctttccatttctatcaaaacttcttgtggtcagtgcaactcatcgcaaaattcattttcagaatcaccaaactgaacggccatcaatttgccgacagtttcccatgcatcattaattgcatcatcagtatcttcaaatttaatcccctgtctgtcagcccactcccgtcgattgatggtcccaagaagatcaagtatgcgggcagctccggtcaaaaagttacaaaagccactgcgattaattttcaacatctgagttcgtcccgcctcccttttcagccgtaaaatcagtctaccatatggcgtttttaaatcggcctattttgcctgagccaatttccaaacgtgctttttcggtgtccttttctcgaacagactgaattctcgacttggcaacattctttttgactcggctcacatgtaaacgccatgtttctcagcggcaatctttagtcgcacgccagaattccatcacttttttaataaatctgcgaatttgttcttgtttctcactgaaagtcgcaattttcggcaattattttaccgaatttgagacaaatgacagcttttttgcgctgcttaattttgatcttacccacagttcggagcggattgctgctagaccggttttgggtaattattcacaatattaacgaaacagattaattaacttaacaagtatcttgcatacaattaaaagtgttccaaagagtttttcattttgacattgtctggggggacttttatgtcaaagaaacgttggatcagcggaatcacttttgctggccttcttgtagggagtttgacaaccggctccgtcgttttagctgcagacgaagataccggaacgactaatacgtcagtcacagtaaccggtggcactatcgggctttccgcgccaagtgcgctcgcttttcccggtgtcacggttgaaagtattgtaaaaggcaatttgaatgatccagttaccactgctgatagttcactgctgacggtgagcgattttcgcggtaccggcgcgggctatacggtttcggcaaaagaatcaccgattacgaatggtagtggtgcgacattgaaaggcgcctttgttcaaatggtgccggacactttggtaacgcctaacgctgcggcaccggcatggacaaagtcggttgatttggcaacaagcgatcagccgctatttgcgaccggcacgggccaggacggcggcgggatcacgagttatgacctcaacaaaatcacattggacgtacctgaggataatgatgttaaagctggcaactacagcggcgtgattacctttacactgacacccggccagccggcacaagccgcaacgtccaatccagttccgtaaaaacgcgaccgcaacgactgattaatgaagggatagacgtttagtcacgcccattccccccgatgatctgccttgaacagaagggaggtggtcaccggcgaccgcaatgcatctatattttaaagcaggcgcggggctgatcctgatcacgtcagccaaacccgcctttgagaccgcaatcgacctaactgttggtaaaggtttagggtaaactttctcacatttcctctggaccgccgaatcggctttggggagccgaggatggccatggggttttaggaacgttattaaaaatagttaagttaatgctcagcttaaggttggccacccgccttcctccgtggctgccaagttgcgacaaaagttagatcaagactaacgcgccgtcaacagaacttggtcaggccacgactgagacgctcgcagtctatattgatcaaatctcaaaaatgatcacagactaaccacgtcaaggtacaaaggagccgccgattacaagtcggcggcttcttttgtgttgagcgcgaacaggagcgcttagaaatcggagtgtaagtggccttgaaacccaaatggctgggctttggccatttgggtttcaaggtccttacacgtagatttctgcgactgtgagcgcgttatagaaagcgcaaggaaactttttacttgccttcaacagaacattctccacgtggtcaagctttgtccatttagtctcgaaaacccttacttgcggaactccacgccaacacctacaccctgcttcctcatgcgatcaaagccgccccatgcccaaacgaccctggcacacgcacctgcgccgacgaaaacttcgtggcatgactcaacgactccgaaactttcgcatcaagcgttggcttcgcggaggaataaagcgtggctgcaaacgaagtaatatacgcatcccccgcccctaaaggatccaccgctttaacgccgagcgcctgctgccaagacatcgtatccttgaccaacgctgccgagccgcgaagtccccgcgagcaaaccacctgatcgcaaccagctgccgcaacccgccggcacaaagcctctacatcatcgtcagacttggctttcccggaaagataggcaaggtcaatctgcggcgcaatttttttgaatactcgatcgtcatcaatcgttgaaaagtcataaattttaggcgccgtgatggctgacaaaaaggcatccgcaccactttcattattcaagtaaaccaaatcaaaagtattaatgtacgcgatatcatcagggctcaactgaagctcctgaaccggttcgccaactgttttctggcgtttgccgtcactgaggcgcatcgttgtgaaggcattagggccgtcgtactgcagcgaatggctgatatcaaccccaagttcgctaagcgtccgccgcgcaaaatcaccgcgcgcatcattaccaaacgtgccaaggtaagcagcctcaagccccatcatagtcgcaaaaaccgccgtattggcagcatgaccgccaagaaacatcttcttgtccgctggataaaggtcaacgacattgtctccgatcgcgatgattttcaagagtctttccttctttcccacacgaagcgaaattggttgtgtcagtgcaaggataactggcaatagcactactaaagcaagtttaccacaggttgttagagggaggcggcttgcttcatgatagcaaaaacgatagccggaagccttcctctaaaaggtgcaattaaaaagcagcccatgtggccaaaagtgagctgctgttctggtacgattaatgaggctgctgcccccaagggggggtgtcttcatgacgttaaaagaattctttgtcttggttatcgtaccgctgattactagcatcatagcgggaatagccacaacgctattcgcccgttggtggaacggacgacggtagccatgcagtggcctcatccacccacacgcccgtcagttgcagcgggtgaaaaaaatagccgtatcccctacccgggatacggctattgtgctctcatgactattagaattctttgtcttgtcgctacaaatatagtatcacgagatttcaaatagatcaattttcagagatgtaaaagttgacatttttggggcaacaaaaacaacagctcattgggtgctgctgaagaactcgataaaatgtaggttaggtagttgtgtggtcttcaatcccacttttcagcatatattcgctataatatagcatgccaatcccatataagcagtaaatataagttcattgtggcagactacctcgtccgccgataaccactgataagataagtggcagcgcttgcgacaacgaggatgaggccgaggatgccagttgctagatcattctcgcctgtcgctggtaatgtgtcacctttctttttgctcgaagacgacgatgatgtctgactgtctgatgcctcgctggattgtgaactggaagtggccgctttttcagacgaagatgcttggttgtccgacttcacctgtcctgatgccgtctgattatccggagccgttttcgaaacgattaaccaggcgttcgccacagcgcgctcgtggccatcagaaggatgattttgcactgttaattgtgtggaccccggttcgcggctcacataggtcgcagaaccgccgccgtctaagttcaaagcggtgaccgcaccacgttgaatcattaaattggccaagtctgccatcgaaatcccgttggaggtaggtgcttcccgtccatcgatcaccacgaaaaagacagtgccatcagccttgatgccaacagctgtccgcggttcgtgatcggtgcccataggcttagtatcattcactttaccgtttgccaccaaaatgttccgcccgccaagtgcctgttgaagttggcttttcaccagaagataggtgtgttcgttaccaatgatcggcgtaccatctttttcaacgccaaagaaggcttcactagcactggtggccgcatgtaactcaacgccattcttcacgacattgccggtggggatacctgtcgccattttgaaaaagtctgcgttaacagccgcaacaaccggctggccctgttgaatcacagcgttagcctggtcgcggactgtctgcaccggtaaattcgttgtggtggcagcggtgcccgctaccagttgggtttgcggattcttgggattaagcgacaccgagtaatacttcgtttgttcattgctccggttaagatatgtaagcatttgctccgtgatacctggtgcgagtgtgttttcccgatgagcaatgatggatttgatgaccgcggtcctggcattgggcagcgcacttgaactactggacgccgtactgtttgtggtgccagtgcttgatgccgtggcggatgaggacgccgaggagtgagttgccgtagaggatgctactgatgagcttggtttctgcgttgacgccagcgccgccgaactcactgttgtggtgacactagaaggcaccgcagctgcgaccggtgccgacgttgcgcccatcaataaagccaccattaaaaatgggctactaaccactttccatctttgtctacccattattcagcctccacatacaaaacagaatcattatcggtgtatatcaattcatttatacacaggggatgtaaaagcgttgtggtggttttgaaaagtttgggtattggttgtgtaaaaggctgttcggcaaaaactttgaacgtaaaaaaagcctgccttactcaggcagacttcgatttgttacttatctggctcaacttcttctaattcaaatgcttctgcaagcttgcggaattctccgtcgctaagttcatgaacagttttttggatatcctccttggaaaatttcgggataagtttaagtaccctttcctctggcatcagcttttttctagtgactggcaccaattcaggctttgacgttcaaagaaaatctaacatttctggttacaaaatacacgtggtttatctgaaacttaccgcgccaaattccccaccactttaatcttcacccgatttgcattctccggatggtaggccagcggcacctcatcgacttcgactacttcaatcgtggcttcatctgcacctgattcgatggccgcagcgatcgcctttttcttggcgtccgccatggcttgatcgcggggaatctggttgtatggataaatgcggccgtattcgccggagacctgactgatcgaagcgccgatcgcattggccacgccgccgagcggatcgcgcaccagtttcccgacgccgtccagatgccgcggcgcaatgatcgcaccgccgccaaccaaaatgacggtggccggctcggcgctggttttcattttatcaatcgccactgcaatcatctcaccgatggtctttaatgcagcttgggcaaacttaagcggaatttgcttcaccagctcgggatcgccgacctcggacaagccgaggcgcacggcaatgtcggtcgccgtgatgatattgccgccaaacgtcagcgccttgtcggtaatttggtagccgaccgaatccggcccgaccgtgacactaccatcgcgctgctggcggacgatggaaccgccgcccaagccgattgacataatatccggcattcgaaagttggttgccacgccgccaacggtcaccgcaatcgacgactcgcgcgggaacccggcttgcagcacgcccaggtcagtcgtcgtcccgccaatgtcgaccacaatcgcatttttcaggtgcgacagatacgccgcgccgcgaatactgttcgtcggcccagaaccaatcgtcagaatcggaaaatgccgagcatacgccgccgtcatcaaggtgccgtcattttgggtcagatataacgaagcatgcttaatgcccgatgccgccagcgcctgctcgaagccgtccacggtattttcgatgacgcggaaaaggccggcgttcaggatcgcggcattttcgcgttcgattaagccaagtgacccgacttcatgcgacaacgtgaccggaaaatcggcgccataagctgcgtgcaccagatcggcagcttgctgctcctgatcgactcgcaaagcagcaaacaccccgatgatggcgatcgagtcgacttcgccgcgccactgttccaacactgcgttgatttcagtcggatcgatttcgttcagaatctggccatcatactcgtaaccgcccttgacgatcgcgtacttacctgacaatttgttcaccaaatcctccggccaggccgtgtacggcggaatcgcctcagttgccggatacgccagacgcaacaccccgacgcgggcaatatgcttacgctccacaatcgcattggtgatttgggtcgttccaagcatggccttgttaatttgatcgcggtccagcggttgatcggccagcaccgcttgaatggcgttgctaatgccggtttgaatatctttggtcgtgtggcgcttaaccgaattgatcacgtgatgctggtcgtccaaaagaatcgcatccgtattcgtaccaccgacgtcaatgcctaatcgatacatacttagccctccttcaccaattcttcaaccggccgataatcgtaatcgaaaccaaagtaacgcggcccggccgttttgatgcctgcttccgtccgccagcgcgcatctgccggggtggccaacactttcacgcgcttaccgtatttaatgacctcagtcgtgaccggcaataacgtgtccgcatcgacaatttcaatcaaatcaggcgtcatgactagcggcttcccgttgcgcaatgccagaaggttctcgttttgaatcaagacactgagatgctgatcctgaaaatcattgaagccatcaattttaatatcgccaacgttgaacccgcgctcggtgcgccgctcgacatcgatgacttttccttcaaaaattaaatgcccattcgtgacttcaagaatttccgccaacgccttggccggattcagatgggcatcacgaatccgcaagccgacctgttcgcacagcgtcacaatgccgcgaatcccgttttgcttaatctgcgcgccacttgacggatacaaggccaccgtcgcactgccgcccatctccacggtttggacccgggccaagcgttccgcccacttcgcgtcaatcgttttgatcacgccggcgttccctttttcatccgtgatcaccatgggcgtggctgccacgccgcctaggtagaacgtcaccatctgcaactcgggaaacgcccgccccataccgtcgcagtccaccaaggggatgcccagcgacgccgccagtgcaatcggcaccatcgagttcaccccgcctgcctccatcggaaatgtgccgacgaaccggtgcccggtatactgactcagcatggtgaaaacccgctcaaactcgtcgcctttgggaatcttctccatcatcacagccggcgcgcccataatcgccgcgggacaaaaataatcatcatcatcaatttcggacacgtccagcaacttcacggggccatttttcttaatggcttccagcgccatcaacttgcctaaaaaggggttgccaccaccgcctgcgccaaaaaaggccgcgccagtcgcgatgttttcgattgattcttcgtctaataaccgcataattgcctccttaacattcatcagtacacgttttagtccaattcagaagctttatcccactccggatgcaatttcgcgccgacgtaataaagtacaaacgcgaggatgatgcctaacaccggaatattcgggaccgccggccacacaaccggcaaaacgccaacaaccgcacctaatgcccacgcggtcaagccaagccagttcaccccaggcaccggctgccagctatgcaaatcaccgtgatgaatcacccaataagacgccgccatcgcaccagccaccggcggaatcatggcagaaaagatgttcatcactggctcgaaataattcaaaatgccgataatcgacaaaatcgtgccgcccacgccgaccagaaacagcgtcaacttgcggtatttttccggaatgttgaatatattcgccacggcaatcccaccagaataagcattcaccacgttgactttccacgtgcccaaaatcagcgccaagccaccaatgaccggcgagccgattttcatgaaaaggctgctaatgtcattcgacttaaacgcaatcgtcaacaccgcgcccaccgcaatcatcaaaacgcccgcgggaatgacgccgaaaatcgccgccttcaccacatcgctacgctttttggaaaactgcgcgtaatccccgacaatgacgcccgccatcgcgaacgagccaaccgtcgacgagaagccattgacaaacgacactgcgccgctcggatgatacgccgcaatcatcgccgcagcgtcctgcttagcaaacgcgaaccacaggccatacagaatgacgatcaccaaatacggaacggcgacatacgcgagcagccgaatcagcttcacgccatacatcgcggtcaccaccatcagcaaccccgtcaacagcgaagctaaccaagcgggaatcggcaaacccaaatacttcaacaagttcgccacggccaagccgccaacattcgcctgaataccaaaccaccccagcgccgcaatcgcgatgataatcgaaatcactttcgacgacccaacttttccaaacacctgttgcgccaccacgaccgcctgcttaccttgatcaacactctgcatcccctgcgacaccatcatcaagacgatgaacccatacccggccagtccggtcaaaattgcggccggaagcgacattcccgaaaccaggctgccacccagaatcaggctgggaatcgagaccaacgccccacaaagaatcatggctaaaccgaaccaagtttgatcacgtttgttttcttccatactcggcacctcacatatttttctaataattgcggatttcccagctgagttcgcgggtgaattcgtgaactcggctgaaatgtaatggtttgattatagaattatgagattcgttgtcaatgggttcatttaatttttaggctaaaacttgggtgaggttttggctgatgtgcgtgtgtttaagggtgttctggtggtgattgggatcgccgatagatcttgtgtgcgccaaggctttgcggcggaaaggttctgcagaaattaaaaaagcccgaatctgtatatgatttttgcaaattcggacagttaaattttaattttgatatgaagataaatagggatgtgctttgctggcttgaaggccactgtcagactacttttaaatgatcggtcgattaaaggatcgccgtctcagtactcgcaagagttcatgactgatccaaataagatcacttatgcatcctctgtcatgccacatgttttcgcgccccaccgccggaccattatcgccaatattttctcccttgatgtcctttcgcagatcataatccgggttgctgtcaaaaatatgacgctttattgggattagagtgatgacgccgtttttatcgatcgttggttggtattcgacgttttcgccaatgttgaacgtagcggggacggggattaggattgaatctccttggcgctgtgttttaactgtcatgggtatcatcctttctctttttcgtcattgtatgaacttgctcgcagtgccaatgctgcactgcctgtaaccttccctaatggtttacattggacaatcaactgaagtgtaagtattcgattcaaaagtgcggcactctaacaaacttaatcgttataagcgtcgcactttagtgtggaaaaaattttttgccttaagtcgtttgccagcagagaacgaaataacaaggtacttttaagaaacagccggttttatcatgacaaacattgatcattaattctatatcgcttcgacaccgttagttacccgaacagttagtaacagaagatctgcctactgatcaatgtcaataacaaaatagttgagatctcctctatacttagaaatcgaatactccacaattctgttcttatccgtaattccctgggtatggaaatagaagatcggcgcgccttcagaaacgttcaacatgtccccaatggtttcatcagcgaccgccacttcaagcttacgccgaacacgcgtaacagcgtacccgcttttcttgagcaaactgtaaagcgatgtcgtttcaaaatcagttttaagaaattctgagtttacgtctactgggatataagacgtaacaaagacaataggttcttcatttgcataacgaagtcgcacaagtttataaaccttctggcccttttcaatttcaagatgcttttgtacttcttcgttggccgtttcttcagtcaaattaagaactctcgtctctggctgtaatcccttttcgcccatctcttgactatagctttgcaaccgatgagtgaattcttgtgcaattttcttctgtttgaccaaggtcccgcgtcgtttctttttttctaaatagcccttattcactaattcttgaatggcctggcgcacagttggtcggcttactgaatacatttcgaccaagtctaactccttaggaattaacgtgccaataggatattgatcatcttgaattctacgcaatagatcggcttcaatctgtttatactttgcggctttcatggcggcctccttacagaactcgtactaaaagtatacagcaaggtcgcagatgttcaccatcatcttaaaaagtgtgagtccgatatccacgtaacaaaacagaatctgtcagtgtctaaaagacattaattccgttggagcgaaatgaattgcgcatcactttttgctatgcgttctcttagttcctcgatgatcttaaccccagcactcgtgcctatacgatcagctccggcttcaatcattgaaaggaaggcaccggcatcacgaatgccccccgcggccttaacggatactcggttcccgaccacgcttttcattagttttacatcttccactttggcaccacttggaccaaaccctgttgaagttttgataaaatccggcttgactttcttagcaatctcggccacttttttaatttcctctttagttaagtaggcattttcgaagatgactttgcaaggaacattgtgattgtgacaaatcgtcacaatctgactcatctcatcctcaatgtagtggtagtttttagctttaagttcagtgatattaataacataatcgatttcatttgcgccattgttaattgcatctttgacatcgaaaagctttgactctatggtcgtttgccccaaaggaaaactgattgctgcaccagtatcgatgtcagttcccattaacagatctgagcaaaacttcgactgagtctggttgatagctaccatcttgaaatggtagtgttttgcctcatcacacagtttccgcatatcttcccttgttgcatcagcatgtaaattagtgtgatcaatcatccgtgcaaaatcatctaacgtatagtctttcatgtgagtgtcctcctaatatgtcattacatattacatagtattctgcgaattggtttttgtcaaataaaaaatcagactcatatcatgaccggtgttgactttttggtagcgcatacatattatagtaagcgaacaaggatcctcaaatatgtatttacaaggaggaattagctttgattatattaattacaagccacgcaaatctagcggatggcttagtctcagcttttgaaatgattgctggccataagaattacattcaggctcttagtctgaatacgagtggggtcaacgaatttcgtcgacggctactcgcattcttgaataacgcaccatctcctgtccttatcttagctgatgtgaaaggaggaaccccatacaacgaagcttacaaatactacttagcacattccaataaatgcagcctagtcagcggcgttaatttacccatgctgttggagattggcacaaatattgaaaattgtactgatttagatgacgtgaaggcaaaaactaaggctatcggacagcaaggaatagaaattgctgaagatatagttgaagacaatgatgatttagacttttaggaggaatcaattatgacaatttcagtagtcagagtggatgaccgggttatacatggtcaaacaatgacgcggtggactaaagcccgaccggtagatggtattctcgttgttggcgataatatcgcaaccgatacgcttcgtagaaaggtacttaaagccgctgctaatgatttgaaggttggtatttacactgttgcggaagcacctaccaaaataaagaaaggaatcgagtcaaagaaacgtttctttttaatcagtgattcaccgcagactttttccaaattagctgatatgggcgttgaattcggttctgtcttaaacgtcggaccgatgaatacgcgtgctggcgccaaggtattaggtcgcaccgtcgcaattgatcaagcggattataacgcgtttgaaaacttagagaagcatggtatcgatgtccagttccaattactgcctgatgatgaaattaagcgttggaaaactatgaaagcaaaatatgatgaaatgagctaattctcaggaggggcaattatgaacaccagtctatttatttcagcgatgttaactgggatcttttgttatctaggggctatcgaatccccatggctgttcgggatgtctggaggcttttatattgttggtagaccgttagttgctggcttattggttggactagcttttggcgatgtaaaatcaggcattctttgcggactagcggtacaagcagtcttcatcgccaatctttctacaggaggtgccacaaatagtgaaatcacctacgcggcttatggcggaatcggtctagccatggcaacaacgcgcaacccagctatcgcagtaacactggcaattctgattggccaaacttttggcttgattttctataatggtcgaatggcactttactctttttggaacgcccgtgctgacaaagccgcggaagaaaataatgatcgcggaattgttttaaaccacctaatttaccctcagattactacttttctgttgcgtgcagtgccagtatttttcgccatttattcaggaaaaggtttggtcaactggttaattcaaagtattcccgatattgtaacacacattattcaggtgctcggaggcgttttaccggcacttggaattgcaatgttaatggcaattgttatcaagagcaatgcacacctgatattcttctttgccggttttgttctactggcatttgcaaaattaagcatgattgcaattgtctttattgccgcacttgtcgcctacatgtattatttgtcctctaacaatcatggcgcgaaaggtgttaaaacttcagaaacgtcaaaagatgatggaagtcacgaggccacagtaaatactgacacagaatatgaagacgaggatcttttctagaaaggtgaattaagatgccaaaatcaactcaatcaacaagtggcgacaccatgctatctaaacatgaactaaatcagatttggtatcgctggggttttacccacctcagctctatgagttatgagaagttacaagcacatgcatgggcttattcctatattccatttgcagataaatattataaagatgatgaagacggtaaaaggcggctgctagtccggcattcaatgttttacaacactgaaccccaaaccggacaattgattaacggcattgttgcatccttagaagaacaaattgctatgggccggaatgtttcagaagaaatgcctgtcaatattaaagcaacattaatgggaccattggctggaattggggactctattattcagggaattatcgtaccaatcctgctctccatcgccatgagtttagccaagggtggcagtccgttaggcccaatgttttacattattgcgtatggcattattggccctacgatctcttacattgcttttcatagcggctaccgtcttggcgtcaatgccattgacgtcatcgttggcgagaactctaaaagaattaccgacgcttttaacatcttagggatcatggtcgtgggcgcattagcagccaatactattgtgttgaagacgattgcaaaaattccattagggggaaaatcagcgcctttagagaacgtcttaactggaatcttcccagatttgttgccattagctatggtaatgtttgcatggtggttaatctctgcaaaacaaatgagcgcaacgaaagttattctcatcatcactgcaattgttacagttggctgcctggttggtttcttttagaaagcggtggaagttttgtatctcctgaagagcttatccaaagatcgcatttggggtacaccacgactccttccctatggtgccacctccgatcacaccggatccgtctacagtgttgccggaatatcatatctggattgcatgatcgttgacgcagcaactgggattgcaacaagtttctttctcgccactcaacaaaatccgcagaaattcggattaattcccggagaagtttatccgctaattatcgatatgctcggtgctgacgcaaacttaagcattcaagttcatccaacagattcatatgctagagacaaaggatatctgtatggaaaatcggaatcctggtatttcattcagcagcccctggatcagcatgtttattctggcctatcagatacttcgatgttaaatgagattaccagttatccttcattgactgaacaaatagctggatgtgaatcagtaaccactggtgattacttgtttgtccccgcgggaaccttacatgctatcactgctggatcactggtttatgaaattcaacaagccacagacgtcacatatcgcttgtacgactatggacgtaagggattagacggtaagcctcgaaagttagatgtatctgacggtctaagcactcttaacccagaacaaacggttcagaaacaaccgttcacgataaaccaaagtattcaagaacgtgcttatcaactgcggctaattaaacttgttcatgatctggttgttacaaactttagcgctatcgcttccgctttgacccttataaaaggaaccgcaacagccgaccatcatactcttcatctaggtcaaagtctcctactactaccaaatgaatctgtcaatttagagggaaacggtgaattaatccaggcaacaccaaacccttactggaggtaacttgcaatttaaagacaggagttagctgatctactgatatagctgactcttattttgttatctaatgaagtgttgtggtctcactataccaacaggtcacccacagaaagcggcattataatataccctgtattacaatgcttagcatgtggacaacacaagaaggatttgccgatagacattttcaaaccattgtctattaaggagcacatcttaactaaaaacatttcctaacataccgactcttgatggcaattaacgcttgggaaaagcgtaagttggcaagcttagtgcattttattggaactgggaaaagcacatttacattgcacccaagtaaagacaaaattttccgttttcctgttttgggatcaacttctatcataggctatgactcgagttacgatgtagaaggaaagatgattctgacggcgcgtgtaggggcaaatgctggaaatctatatatttattctgggaaggctaaaattactgacaacactgtttttttggtcacggatacacctagcttcttaaaagctttgctagatcattttgatttaaaaaaaatcaaatttggcaccggtcaaccattaattaaagccagtgaactaaagaggcttaagctttttgtaccatgtgaccctacagaattggactcaatacaagattgcgttttgaatatcaataaccttatcgctgcaactcaaggtaaacttgatcaacttgaaatggttaaaaaggctctattacagcatctgtttgaccagtcaatgcggttcaaaggctactctgacccgtgggaaaagcgtaagttgggtgatttgggacaggtcgccatgaataaacgaatttataaggatcaaacctcgtcaactggagatgtccctttttataaaattggaacttttggtaaagaagcggactctttcatttcgcgtgaactttttgaaaaatataaaaaaatgtatccatttcctgaagctggagatattttaatttcagcatcagggagtattggcagaaagcttgtttatgacggggaggatgcctattttcaggattcgaatattatttggattaagcatgacgaacgccttgctaattcatttttgaatcagtttttaagtatcgttcactggaatggaacagagggtacaaccattaaaaggctgtacaacaagaatgttctaacaacaaaaataaacattccgtcaagaaaggaacaggacacaataggcagttgtctaactatatttgacaaccttatcgctgcaactcaatccaaactttctggcctcgaatcattaaaaaaagccctgttacaaggacttttcatttgaaaggggtcgcctaacgcggtaaagctgcgtgaagcgatccttttatgtcacatcaatgaggtgaggtagcgcataatcttatcgttgtcttggttttctaattcttggatgatatggaggtaggtcttctgggtcgtgctcatattggcgtgaccgaggcgtcttgccaccgaaccaaccgaaacacccgcatacagaagcagtgatgcgtgcgtgtggcgaagaccatgaatgctgatgacagggatgcgtgcgcgcttgcatttgcgctctaggatgtcattagcggtttcgttgtacacgcgctgtccagcggcgacgaagattggttgatcttgaggcagatgcttgatcagggtagcgaactgcatcgcaacttgccagtcaagtggcaccttgcgaacagaggcagtgttcttggtttcggcgaagctgcctgtagcgctcttataatcccaagttttgttgatggttaaggtcaacttagccatatcaaagtccgctggtgtcactccaagtgcttcgccaaatcgcaagcctgttttcgcaatcagcaggaggaagtagtcccatcccaaaccgccatccagatcaagcagcgccaatagcttcgtgagttcatgctggttcaaaaatttgaccttatgaatgcgagaaacggtgcctttgatcacgactttgcgcgttggatcctgttcaagcagcccttcatcaagcccgtcaagaatggccgctttcaggtggtgatggaagtccaatgtcgtctgcttttcgtgatttgcggcgaactcattgattagctcttgataggttcgtcgcttcagctcgtccatgtgcaagtccggcgcaagtgtcactagatgcttgtgtgacatctgatacttttggtaagtaacaggacgaactgccccttctttgtaaagctcgatccattgtttgaaatacatgtggaacttctgcgtgcgttgtttcattccgcacctcctggatttagttaccctgttgggcaattaaatctttatcatacggaatgggaaaagtcagccaaacgcactgtggagaggtgacagtagagaaatttgaaccagaaaatattccgccttaattttgtgcttgcttttgatccacatatgcccttgcctgttcatcaaaattgactttactggtaagtgtatgcccttcgaaatcagtactgaatgccttaagaagtacagtcccatcaacattcaatgtgtatggtataaccttggttggtaccgcactgttacttagtttgagaacaatattgtggttgtcaaccgtgtaatttgcactgtaagagcctacgtatgctccgagaccagtgagccttgcagtgttggcgtctttaaaataaccatacaaaaccccatcgtgtacgctgttttgtggtgccttattctcggtcattgcttgattaacgtcttctccgtcgtaaagttcaggaacgatactgaaccctttaccgataatatatgaatgtgccagcgatacaggatcttgatcctgtacttgttgctgggaagctttggagggactacttgtcgtgaagctctctggtttgctttgtttcgactgttgtgatgacttggtagaggattgactcgatgcccttgaaatctgactttgattctgaatcgatgttgcatatcgacttccaacatagaagctcgcaccaattattgttaagaggactatcacaattccaacagttttccagtgacttttctttcgcctttctcgtctcataacaatctcctatctaagtttatgaactctttcttcatacaaagagctcttgtagcaaagacttctttaattgccggtaaccgacaagtttggactgagctgcagcaataaggccatcgagtgtttgtaaggatgaagcaatgtgttgttgctctgcaacagacggaataagaattggcattgtcacaaatacagaatctttgattgcaaaacggtcagagcgtgctccagtgtcgccatttcgtgtcataaaacggtgccagacattagctaagaaatattgctctaagaacccatgattcacaccgtgcacccgaaaaacaaaatacaacggagacataattcctatacgttttaacctgttacgcttgatcgggccaacaggagccgagttagatattctcggattgtagacaaagtcatctggccgcactacgtaatagccacttaaactttctttgttcgcgatgtccttatcgaaaaagtcccgctggctaacaataccgttctccgccgaattagttagtacttctttaaattcaccagatttgttcttctcagtaactttttcagctatatcccccaacttacatttttcccacgggtcagagtaccccttgaaccgcattgactggtcaaagaaatgttgtaatagcgcctttttgaccatttgaagttgatcaagtttaccttgagttgcagcgataaggttgttgactttcgaaaatagttttgcgattgttctttgttcatctaaacatggccagtctatgtgtaaacttgcaacttgagtcagtgaaatgttaggttgtgctccagtggttgggttccttttaatatattcattaacggccgttcctgatagataagtagcgacaaactttacgtcgccggagccaaggcgaatgattgctaaagcttgattagtattggctggtaacagggatttggaaattattgcagtacgtccaagtgagccggcaatagagaagagaatatcattttcttgtagaactgacctagctaaataaccttgatgttcctcaaaagaaattttgttggtaactgatatatttccgccttttgaaatattttcgaccttaataaaattgatagtcccctgtccattttgctttcttggagttgtaccctttgttattagttttgtgacatctcccaacttacgcttttcccaagcgtccgaaaaccccttaaaccgcagtgcgggaacattattagcatccttactcatttttaaacagctccttcaaagcggttagttgtttggcagcttcgtcgttattagcaaccaaatcatcaaaatccttggctaaagcctgacttaattcggcaatttgttcatccgctttcttaatgttagctactaccttaaccacatcaacaggcttttctggctcagttgtgtctacatatcggggaatgttcaggttaaattcgttttctttgatttcatcgaaggaagcaacatgagcatatttgtcgacgtctttgcgtttgtcgtaggtttccacgattcgcttaatctgatcatctgtaatggaattctgattcttccccttttcaaaatccttggacgcatcaataaatagcacatcatgaacattgcgcgcgtcgcgatcttttttgaagatcaaaataaccgtgggaatacttgtcccatagaagagattcgcaggtagaccaatgacggcatctagaacattgtcctgttccaacataaattggcgaatggcgccttctgccgcgccacggaaaagtacgccgtggggtagaacaacacccataatgcctgtttcattcaagtgatagagcatgtgttcaacaaaggcaaaatcagcctttgactttggcgctgttcggccatacttgcggaaccgttcgtcgtctatcttatcggttggatcccagttagccgaatatggtgggttagctacaacagcgtcaaactgtttgtcaccaaccttatcgttttcgagggtgtctccttggaataattggaattggctaaagttcacaccatgcatcagaagattcatgcgtgccaaattataagttgtcgtgttaagttcttgaccgtaatactcgccaattcgatcaacatagttacctacctgcagcagcaaggaaccagatcccatcgtcgggtcataaactgatcgtaattcgtgcttatgcaaagtgacaatctgcgccagaatcttagaaacctgttgtggcgtataaaattcaccggccttcttacctgcactggcagcaaattggccaatgaggtattcataagcatcacccagaacatcaatctgcatgtcctgactgcgaaaattaatgtcagccaatgccaacatgactttagcaatcattttgccacgttccgagaccgttgcaccaagtttattcgatccaagatccatatcggcaaagagtccacggaaatcattttctgattcatggcccacagttgatagctgaacctcgttaatcgcattttggagcttttcagtgtcaaaattgccggccttaatatccttgattaagctgtcaaataaatacttcggttcgataaagaaaccaatgtattcgatgaccgcttgtttaatatcctcctggtcatctgggttctgataagctgtctcaaaatcaactgggtcattcttgaacagctcttcgccttcgtcgctgacctgatcgctaaggaagcggtaaaagatgagccctaatatataatttcggtactcactggcatccatgttgccacgaaggtcgttagcaatgctccaaaggcgcttttgtaattctgcttgttgctgtgcttgtgtgttgtgcgtgttatccaagactatttctccatttcagcgttaagataatgaatatttttcgctaacattttccaataactgctgcatctcagcactaagtttacgcttctcacgaaaaccaaagccaagatcattgaattccttctgcattgattgtaaattggcgcgacccgtaaagttataatcagacagttgatccttgacaacagaaatcggcaagttgtgatttttagagaagccaactaatgcattttcgcgcgagtctgctaagaatttgtccaattcattaccaatgtctgacttagcgttgagctttggcacattctcatctaagaaccgtttcaacagctccgccttcgacttcaggtgatcgtctgtggcattgttcaaaaatcgctgaatctttgcaatgtcagaattacgactcttgtcatcatcaagattaatcgacttaatcagattaacgatataagttacgtcaatcgtatccgtttgaactaatgtcatatcgaaatcaatgtcgtcaagaatatcagccttttcgccagggttgtccggtttgaggcgtttatatgccgtgtaatacttccccttgaaatcttcaaaatcctgattcgtaaagatgttcttgaactgttcccaatcaaattcatcgtaaacgcgaactttattgtaaatccgcaagacgctgcgaaatgcgaggacaaacttttcaagggcttcgtcgccttgattgtataacggatcaacatcatctttagttggtgtgacgacctgcaacgcttgaatcgctttaatgaactgattctttaactcaggatatggcggcgcaaagaatgcctgctgatcgccatcagaatacaatgctacagcgtcatcagtcgcccttttaagattacgatagcaaacaatgttcccaaaaggcttattgttcgtatcaatccgattagttcgtgagaaggcctgaataagcccctgccaacgcaacttcttatcaacataaagcgttgacagccgcttcgagtcaaatcccgtcaagaacatgtttacaacaatcaacacatcgatgttttcctcaggagttgcatcgttgtgcgctttcatccgtttagacacgtctttaaaataatcgctaaaatgatccgtcgaaaagtcggtatgatagcgcttgttgtagtcttcaatgactttgtctagtccctgacgcgacgtaacatcgtcttgcccctgatgagcttcgttgtcaacctcattggcttgccaagtgaagatcgtcgtcacgtttaggcgatgatttgtatccagccgtttgaataagtcatagtaagcaagagcttgacgggtactcggaactgtgaaaattgcgttatagtgctttagctttgtaaattgtgcgtgcttattaataatatgattgactatattcgccatgcgttctggcgcttcaaatacagatgcctgatcgatccccttaaccaactcaccatcatcgttcacaatgctttttccttgaaacgtctggatatattgcacagtaaagcctaatacattgtgatcacgaattgcgtctttaataagatacttgtggagcagttgatcataaagatcagcagtggtgcgtccatcaataccggtgttttccttgaagattggtgttccggtaaagccaaaatgctgagaattttggaaccagcgattcacgtttttacgcatgtcgccgaactgactgcggtgagcctcatcctcgataaacacaactttgcgatcgtgatacggtgttaattcttttttgtatttattgttctgtactgcattgtttaacttctgaatggtacttacaattagtggactatcattggacacaagctgtcggacgagttcacgtgtattgttagtccgatccaacgcactttggccgttaacatctgctggcaaatacgcagcaaagttccgcgccgtttgttcatctaggtcagcacgatcaattaagaagataaccttctctgccttcgtcaaacgcgccaagagctggctagccttaaaacttgttatagtcttgccggacccggtagtgtgccagacatacccgtttttatgactatccttctgagcatgatcaaggattgcttccgcagcgtagatctggtaaggccgcatgatcatcatcttttgctccacccgatcaaagatcgtgtaccgcgcaatcaaactatgaaacctggcttgatcaaaaaaagaagcagtaaaagcatcaatgtcatttaaccaattgttctctttgtctgtccaatagaacatgaagttcgagttcagctggccatcgccatttgcaaaatagcgcgtttcacttccattcgagataacatacatctggattaacgaaagcaaccgcgcgtatttctcgctttcacttcggtaacgaatgatttgattaaatgcttcgctgaaatcgacacctcgacgttttagttcaaactgtgtcactggcaacccattaatcagtattagaacgtcatagcgattttcgtgtcgaccataaatagtcatctgatgagtgacttcaaaaatattattctttgggtctgtgccatcaaataattgtagaaacactttagagttgtcatcacgttggatttcaattttcccataaggctgaatatcagagccgcgcaaaatttcggcgatttgataatgggttcgtgcgccaatcagtgcgttcaaggccgcagtaaactcacgatcactcaaagacttccccttcaggttctcgctattacgttgattcaacacatcgcgaaaatgttgatctaatgtcttaacatcaggtattgaaattttgcgatatcctagcccctctagacggcgaatcagctgattctccagctcagcctcgctttgatacccaactgccatgctgtttcccctctttaacctcacatattatttcttttattgtatcaggaattctgactgttcgctgatctttggtaaaactgttaaaccgacctcacgatagtcgtttcaaaacttaaaggatgaccttcctaactttgtgagagttatgtccaaagctatgatctgagagccaaaattctttagtcagtcttgaagttctgaatcaaacttaagagactcttctcattcttgattacatcaaaaattatgccagtttttaaggaacggaaatgtgctcggccggatttaatttggagaagttcatgaccccgaagggcctcctcatctggattcgctttcgtgtccgcaacaaagtatagacgaaccccgtcttctcgcttataaataactgcccagtctggattataagtaccaaggggtgtcggcactttgaaccaagctggcatttttatatagaacaaaacattatcatcttgttcacagtcacgcgcaaactgcttttctgtttcggagtcagtcactatataattatagatagtcttattactgcttacttttactgcattacctcttaagtctccatgatccaagtatgcataaagtgtttccgtagaaaagaggctttgctcgaatactgcaccattttctttatattcaatccccgccaccattaattgttgcttttcccagttgattaattttgccgcttgtgttatacaactctgcggatttgtttgaaaagcagtcaaatcatcaacttgcctaaggatcttggctaaagttcttctagttaaatgagtctcattctgtaagaaagtcaagatgtcgggcagttcataaggaagcatatcgttattagaagtatagcggccatgtgggttctgaacttcaaagccagctatcgtatttacgatttgtgcctttgtgtaagtgaaatttccttgatgtgttgtaatattctgaagctttcttactgaatgatctattaatttatcagtatcaaagtttacgcgatacgttgtttttgatttaatccgatcccacaaccctttaaagtcttcgctaggctggcctttattgatagaaactagcttcctgtccgcacgattgtatatttgcaaagacttaacatactttgtggcaattgcaagtatctgatcttgatattcactgaattcgtttggcaatactatgctttgactttgtaaagccaatactagcttgtttgttgctttgcgttcagcagttaggtaaccacttgcaatgaggctttggattaatctacgagataggcctttccccaaaggcttttgttcccccgtatcatcgtctacactggtaactacggcagcaaacacgtcatccgtaaagatgccaaacttcacaccagcatcagcgtactccgtctgtagtgtctcagcaaaattcttgtagctttcatttgccatgatagtcaaagtattaatctcaaagccgggaacgcgatggccgtcctggtccacagcaatacgtaatccacgaccgatcttttggcgtttcgtcatggtatcttgtgtgtctactagtgtgcagatttggaagatattaggattatcccatccttcacgtaaagcagagtgagagaagataaatcgcaatttattcactgaatctgtattccccttacccggatcgtatgatgtcagtaatccctctttatcgcgcataatcatgctataagtcgattcatcagccattgtattgccacgggtatttttaaaatgattcttcccatcacgagaaaaatagccgtcatgaacctcattgactgggacacttgcatcacgtaacccctgatacctgctggacttaattagttttctgtattcatcttcaaacatatgcgcatatcttccgcggtggtattttccgttttcatcatacttgcgatagttctcaactttatctaagaagaacaagcttaatacttttacgggaatttgcgctttttgaaatcgaagttctttttccaaatgttcccgaattgtctgctttatttgttcgcgttttaccgcctcatcctcttcatctgaataagatagtgttaattttctaggttcaccagtaaaataaactgcttctaaacccggtgttgtatcgatatctgttacaaaaccgactctactgtatatttgtagctttgtcttagatacgatgtcagaattctgctgaactgtaataactttcttatcagcaccttccttagtctttttatagacttcaatacgagctgatattctaccctttctatttgcaacacttattaagcgcaagtatgctcggttaccatcttcatcattttgaagagctgcaacttccacttgtttcacaagctgttgatcataggcctcaacaggtcccagacgataaatagtcgaatagttctctttatgggtggcagagtagcagaaggcgacgcttgggttcaaactattgatggctttttttgctaaatctgtagcatctacagattgaggctcatcgacgattaaaataggacgggtttcagccaagaagtcaattggtcgctccccatcaagttgatctcgctgttgattcataacatttgagtctttattaaatgcctgaattgtagtgatcatgatctgcaatgtattggcaatagcaaactcacgaatacgattcaagtcagaactcgaatagacaaacgcttcgtatacttcaccatcgtattgaccagagaaatatccacgagtcatttgaattgatttaatgacaccttcgcggattgctacagaaggaacaacaacgatgaactttagatacccgtattgtttattcagttcgagaattgtcttcaagtaaacgaatgttttaccagttcccgtttccatttcaatgttaaactgtgggaaccgtttgttctcaccaaccaatttgtcatctggggctatcccatttctaatttgaatttgttgcaaattttttaagagtctctctttagaaacactaatattatttccaatacctaccccgtcttttgcaaacaacgagctttggaaacccggctttccaaacaggtgattatttgaccgcaaagcttggcccttaaacaaatcaacggctgcattaacggcatcgttttggtattttaattcatcgaatcttatttgcaagatactctccccctgcgttgttaaatcttatattgatttgatgttagcatattgaaaacccgcatcattcaagatttttattgagttcagtttttcgctatcgctggcaaacccactgtcttgaaatatcactgttgagtgttccatcttcgacttgacatataaatttgcaatttcatcagcgactgtggacttgatgctttgatccccaagaacgatataaactgatccaccagatacagaataaattgttgctccctcgatctcacgagaaataacactagagttcaaatcaaggccttgttttagtataatctcaaacaaaatatcttctgacgatctatcagctttgaagttctcatccaataataacagctgattccttttcagatcgtcccactgaactaaattggacgtatccaatcgaaacacccgaaaaccagcatctatagatcgattggagtcactcgcccgtaattcatcacgcacacgacgaattcgttcctctccaatgtctgtaatagttttaaatccattggtcctggcgactgaatcctctggtgtcttttcaggcaactgaatcatgataaatcgacgatctccaccatctttgatattttgttgtagcaccgcctgtgccatcgttgcagatccactgaagaagtccattacaataccgtgtctgtccgtgcccatctcaactaataattgtaagagatcaacagattttggagactgaaatatcttatccgtggatccaaatagggaattaagaaccgcttgtcctttctctgtatgaaaagccttgtcagttaacagcgtctgcaccttggtcaatgtttgaccatcttgcttaacataatcttttcgataaatcttccaattttcttgctgtttctttgctatcagaagatttttctcctttaaaaacttgtcttttccccaagtccagcaaccttcgaatccgtcattccaaatgggcaataccgctatagacttattgtcttcttcttcaagaactttcccatctcggtcgatgtatattggataatataaatttggacgattgtattttccaaactccctatgcgtatttcttaattctattaaccgatactgtcccgcctgatccttgtatggatattgcttatcaattttatgatgtccttttgatatagaaattgctccactaggaagcactgtctttgagaatagtaatatatattctgaagaggtggctaagtacttatcttgggatcttccttttgggttgttaagatatgttatttgtcccaggaaattattttcgccaaatatttctttcgaaatcttacgtaaattttcgagttcgccatcgtcaatactcatggcaatcactccgtcttctcttagtaaatttcgcgccagttgaagacgaggatacatcatactaagccagtcagaatgaaatcgaccagaagtttccaaattggttgataacctatttccttcctgatccacctgtccagttatttcaagataattttgaatactatccctgaaatcatcgtgatatacaaaatcatgactagtattgtagggtggatcaatataaataaacttgatttttccagaataacttttttgtagcaatttaagcgattccaggttgtcgccttcaatgtaaagatttttagtcttatcccagagaagagacttctccctttggggacgaagcgttgcagtactcatcctttgtgccaagcgcattgcggcttgtttaccatgccaagtgaatttatatttttcctctgaatcatcgacagaatctccgagcagcactctaagttgattaaaatcaatctttccatcgctagcaatttcaggaaagagcttccttagggactcaatattttgcttgattaaattgactgaggtcccttctacttttttgaagggcatctttgaattatccatgatcttcactcctcggatctaaattaaatttctttttttgcaataactacatctgaattttctaaatgattgacctagaagagactctctgctaactactttacaattacagtctctttacagctataccatacattgttctcgtaaccttaaatttaccctacaacctgtctaaccgccacccaaatcaacccagcagccatcagccccatcgaaacattcaccacccgcgacgcaatccgccgctcgcgctcatccatgtcttctaacatgccaagggtatagtcattatacggcccggcgtcccaataaccgacatagtagctcaggatacctttttcgcggaaggttaacggttcgctaccgtcgtgtagaagcagcttatcgtcgaatagcgcgtatagatcgtcgctgaacatggcggcgcggcggttgtgttcggcttctgccttgacgcgttccagaagttcgtgaaatctgtccttttcgcgttggtcggcgtcgtcttgcggggtccattcgtctaactttttctggaagatgcggaggacgtcgtcgaagtggcggcgttggtagtggttggcgaaggttaggtagcggttgtcttcgttgaggtgtttggtttgccaggtttggaacaggaaaaggcctagcagtccgagggttgtgatagcgtttaagaggttgctgaagttccattgtgccatgaggtgttggaggctgctgatgacccagaaggtggcgatgagcagcgtgacggcgatggagagtagctgcttttggcggatttgcggatttttttgcatttcttcgtagatggtttgccggtattttaagtacatgatgatgtagtctaacaggttcagtgagcggacttgccggtatgtcttgacgatagcaaataacaaaacgaccaggctgacgaggttgatgacctggttgatcgcatcaatttgcgccatagcataactcctttgcaaaagtatcgggcacacatttttccagccagaaaaattggccactgttgcccgctgactttccattttgcccctgtgtgccagcatagttcgattttaaacggaatcccattaaattgcgaggttaacgaaagtgtcctgactaacttattttaacgaaaaagttgtgaccgacctgcaatgacgtgcaagttgccttttccccttcgcgctggatgtgctacagttaggttttgtatagaagtaacattaagaatctttggggagcagaaaaaattgaccaaacaaacacatcacattgtcattcctgacgctatcatggacgatttggatattaaggatggcgaacaagtcgaggtgacgttaaaagataaggaagcagtgattcggccgaagcgggcggatacggggacgcagacgatttcgctgcggttctttctgattcctactgttctggcggggatcgtttttctggcgtatttcttctactttaacatcttgcaagtgccgatgacgggcaagaattcgatcgcgcagatggtgattgtccttggcgagttgagtggcatgggcacgtttgcggtgacatatattcgcaatcaccggcagattcatgggcgtgatcatcgacgccgctattggcggattttcccgacgttgctactgtcgtttgcgattattcttgcattcgtggcgtcggtgtttttctgggcaattggctatatgtttgaaggcgtcagttttgatatttacacggcgaccggactgttcctgatttttatcagtattgtgaactatctgatgatttattcggcgttgtcgatttcgacgtcgtttattactacgctgtttctgtcaacgtttgtcggcggcgtggtgggcgcgattgtgaccaacagttcgcgtcagtggtggcagcacaatgttagctttttaggcaccagcaaggccttgaacgcgtggcagttcaatctgaccatcgcggtgtcggccttgctgtggatcgccttggtggactacctattcgtaccattgatggcgcatcgcaaaaacgactggcggctgatcacgctccgcattttactaaccgtcgcggccatcgccttgctgggcgtcggcctgtttccgaataatcgcggcatcctgcatgtcctgcacacccaaagcgcgtggttcctgaactacttcctgatcggcatgatcatcgccgtgcgctggctgctgccgggcgtctcgcgcgaatttctcagcaccagctacaccatcggcggcatcatcgtcctcgccgccatcctgttccaattcgtgcactacctgtcgctgaccgcgttcgagatgatcgcctttgcgctggccatgtcatggatcatgctactgctgcaaaacatccaccggctttatcaaaaagatgagtccacctttgtcgtgacagtgacgagtggaaaagagaaatcacctaaaaaatcggcctagaaaagacatcaaatggtgaacctcagcgcataaactgaagttcaccattttattttgctccaatcatcgacatcttgaactgccatacccatcccaattgacctccattagcgtaaccaaacactccatgactgaatcgtgaccgccttctatgtaaaaaacaacctcaccagcaaatcgccagtcaggttgccttttgtcggtcatcaaacgacctaatttcgtgaaaccgttatccctagcacctcaacatcattcaataatttttgacctccgagtaatgctgtgcattttctcaatccacgggtgaatgggttccttcaagaagaggcccaacaagaagaagctaatgccgaatgcagccagaacggcgaggtcaagccagagattaggccagtagatgccgccgaccgtttcccgtaagagattgacggcgtaagtgaatggcagccacgggttgatcatctggaagaatttgccagaaagtacgaccgggaagttcccgccggctccggaaatggataggaccagaatgatgatgccgatgccctttccgatgttgccgaatagcgagatcagcatgtagagaatcgaaacgaagaccacgcttagcatcatggagaatagcaggtagagcggcttgtcgacgacgtaagtgccaatcagaaaaagattgcccagtgccgcaatgagaccttgcaacatccccagcccgacgaacgtcagccagcgcgcaacgtacatttgtttgaccgtggcatcgctgagtgttgccggcaactggtattcggtgatcaaaatcgcgccaagtaataacgcaccgacccaaatacacaaggccagatagaacggcgcactttgcgaaccatacgttggaatcgcgtagaagctttgttgcttgagttcgaccggtttagccaagaacccggcctcttttgtcgcgtcccgccgcaagagtttgatcagctgcgataagtcaaccgacttttcaccttttttgatggcagcggcgcctttttgaatggcatcttttagtgtcggccagtcgtttttgatgaaggtatgcgcatcatccagcccactctgcaactgtggcattttttcgtttgccagtgccaaggtattggtcagatccttttcaatgcccggcagatcctggttaataaagtcggtcgccttggtcaatttggcttcaagactaggaaaatcgttttggtacaaatcggcaacggtcgtcacgccactggtgatgaggttcatgtgcccattcagtagggtgttggcatcggttagttcctgcttcagcgctggcaattgctgctgagccttgaccaaaaagctatgcgcctgcgtgagcaaatctttggtgccactgagaagcgatggcagttctggcaggatctgattgttgatggtggcaagcgtggtgctggcgtccccaagcgcggctttaaagtcgtttaacacttgtttgacactggtgctgatatcaagtgctttgagcgcagcagcagcggcagcaaactgatcagccgttttggctaacgcttccaagcgtgcctggatctcactggtgctcagattaggcacgcccttggctagcgcttcggcactgtctttcaccgcggttgccgttgctgcgacttcttttagttgagcaatggcaccggccaagacctggtcgtcttgactggtaagtttgttaaggctggcctgcacccgttcaagcatttcggccaaactggtggcattgtccgccaccttgccctgccgctttgccaaggccgtcagtcgttcgaccatagcctgcttgacggcggccgtatcctgactattgtcaagttgctgaagctgattctgcaaggtcgtcaaatccgcacttaggctggtattggctgccgcaatcagcgtcaaaccggcatcggtggcattttgcacgacatccagagcggtactgattttcggcagcacctcatctttcgtggttcccactgccgcctgcgctttttggccgaaatccgtcagcgctggtaaggtgccgtcaacctgattaatcaccgtgatgccctgatcggttaccttcaccgcttgactgacgccgctttccagttggtcaaaattggtgaccaccgtgttcagctgggcgccggcttgctgaacttccggcaacttgcctttcaccgcggttgccagttcgccagcatcttgaaccatgggcaaataaccattcgcggcggttagcttctgcgccatttgattgacttctgggagatacccagcgatttcatttgccgtttgtaacttcgcccgaattgccggcatttttccttgcaagtcatccacttcggttaagtacttttcaatggtcggcaactgctcattggtattcgtgaccagactggcgaatcgccgaatcattggcaggttttgatccagcttgatgccggctttattaaacgtcttgaccagcgttttggcgacggttgcgccgaattcatccgaaatggtgttttgcagcgtgcttgcgccggtgctggtaattttcggggcaatcgcattgattttctcgtttacataataatctagcttaggcttatggatcttcccgtcaacaaagctcagcaaatcagtggaaaaatgctttggcaccacgacaccggcgtaatacttgccgcttttgacaccttcttggacggcctttttagaatccacaaaccgccagccaagctgtttgttgtgcttcagctgatccatcagctcgtccccgaccgcaattttctgatcccgaaaagtcgccggctgatcagccgagtataccgcgaccgtcagatcctgggtattgctgtaaggatcccacagcgcccaaacgttaaaccagcaataaaggctgggaataatgaccagggctgcgatcagcagaaaagcgaacggacttttcacaatccgtttccagtccaaagcaactagtttaccaatgttacgcataacttcctccgaatgtcagattgaaatattggtcgattatatcacaggtgtttgcttgtgccattggacaaaatgcgggatgtgttgggtttaaaagcgattatgtcgttaacaagcgctatctaagaccgtgccaaagccaaaaatcaggggagaaatatttgggcataatatttcaagatacttaaaaggtttaaaaaattaaattcataattttctttcacttttggttgaatatgataaacgtaaagccttagtatattaattataataaaaataatttcaaataaatcatcctgcgttttaacctcaatttatatcctccctcaattattatttgtattaattaatagaatttaatatcataaagtgcttgattgtatgcgctttctcgtgatattatttattacaacgtataattgcaataaacattggaggaaaacaaatgaaactgggtttttacaaaaatggagggctgaaaggggctatcaggttcctcatactctttaccgttgctttagtactaggagggccccttgtaacagctggctctgctgtatatgcatcagaagacacactcgatattacaaaagaagaaattgatcaagctacagataatctctctaccattttggcagaggcatactctactgaccctaatatgtcagaagagacagttgcccagaatgtgatgctatacagtttttcagaagcacccgatacttctgaaagaactaaacgctcgctttccagttttagtcagtgtatggtgattaaaatggggcttggtgaattaagagacgttgctaaaatggtctttaatgaacaggtagttaggtaccttaaatcccaagcttggaaaaaagcctcggcaatgattgtccaaagaattacgagatttgctggcaagaaaatcgcaagctttgctgtaaagagactcgctcattttgcgcttcccggaattggctggggatctctagcaattatgggtgctcagtgcggttgggccgaaattcattaggataagcggtggtctcaagtgccaagaaacaagttgtctaaaaataaaaaggggtccgtcattgtctccttattgctaacaaatatcgttgcgttaattctcatcggcctagaatttggctactatgactttggcccttactttattggtgctgtttctttcgagcacgctttaaaaggcttcctacgaaccgaaatcgttctcggcggcggctttctcatcttgtttaacggctatgttatcatttggaatctttttctgaaaaagaaagagagatcatctgagaataaacggtccacaaaacacactaaccgcaaaaagtgacctgtgacagcaattatatgttgacctaaacagtccgtttacgcggactgtttttgattttttctgaaaccagcattcaaacaacataaaaaagccttaaccctaccttatcaggcatccaaacacccaaggtagcattaaggcttatttcaatgcaattttccttacaacgacgccggcgaaaccgactcaaccttcacatcttcccgctgaaccgcgagaagatcagcgccggcttgaacggttgtgtccgcaaccggctcgatacgcgcgtaggatttgctgttcgtgatcagtacaatggtggtcggatcaagtccggccttttttatcgccgcttggtcaaaggtgccgagtaagtcgcctttgttgacatactggccggctttgaccgccaccgtgaaaggcgcgcctttcaagttaacggtgtcgatacctagatggaccagaatttccatgccatcgtcggtcgtcatgccatacgcatggccggtatcggcaaccaccgataacgtgccggtttgcggagcatagacgttgttgacgcctttttctgccggttgaatcgccagtccgtcgcccatcatgccggaagcgaaaaccggatcgctgaccttggccaaggccacggtttctccgctgactggcgcgtagactttgtcgtcgctgacggtggaggaaatcaaggcattggccgtctcgacgttttcgtcaggcttcaaaacttctttagggattgcgaaggcgttcgtggcgacgaaggcaaccaccactgtccccagcgacaccaccgtgtaccataacaatgcatggccgttatagatgtacatcaggtaagacggcaccaccgcaagtccgtatgagttggccgcgacgttgagcatgctgagaatggccgccccgatcccggacgtcagcaccgtaacgatcagtggccggaagttgtaacgaatcagaaccccgaacaatgtcggttccgaaacaccgaacagttgtgacgtgaacgcccccatcgacgtggcttttgccttactggaacgggcccgcaggaaaatggcgagcgccacgcctaagttcgcgaatccatacatagcttccaacgtgatcaacgggttcaacccggttgacgccagcaaagatgtttcgatggcaatcatggtctgatgaatcccgatcaggaccatcagcggatatgcggccccgatcaggaaaccgccaatcccaaatggcaagtggatcaccgcttcaacgccgaccaacatcccgctttcaatcgcatggacaatgggaccgacacccaggatcataatggcaaacgtgaccagcatggtgagaaacggcgtcaggatctgttccaacacattcggcatgtgccgccggaaaaagagttccaattttgccccgataaagccagccaccagtgcagttaacaccgacccttgactgccttcgaccggtaaccagccaaacagcataatcgccttggcactgccgtctgccaccgaataggcattcggcaaaatcggcgacaccagcatcaagccaatgacgatcccgataatcggcgtccctttaaaatatcggaacgttgaccagacgatcagcgcaggcaggaacgcgaaaaccgtgtcggtcaaaaccgaaatcaccgaggttaggctcgcggggatatcgctgggaaccgcaccgaaaagtttcaagacctgagcgttcgtggcggcactttttaaccctaaaaacagacctgttgcagcaatgaccggaataatcggaatgaaaatgccagatagcatcgccatcaagcgttgcacgagcgttttgtgctcacctgttgccgccgcagtcgtatcggcgtcgtccttgccataaatggcattcaccgtgcccagcttggcgatggctgcatacacatcgttgacaacgccagtgccgataatgacttgatactggccggagccgtaaaacacccctttgacttccggcaatttttccagtgccttgtcgtcaattgccttgcgatccttgaccacaaagcgcagccgggtttggcaatgggtcacggaatcaatgttgctctccccaaccagcttcagaattgcttttgcttcttgttcataattttttgccatcttaattcacctcaatgagaatcgcttggtaaggttgcaacgttggtgtggcatctgggtagttattaagccagatccggccggccggtaaatcgatcttagctgtttgtgcgcttaagtttacaaaaacctgcacgtgctgcccgcgggcataggcgataacatgatcgtctgcgaccttgatcggagcatagtcaccttcgatcagatccggccgcaatggcgaatcgttgcgcaaccggcaaagcttttggtaaaagtgccagaccgagtttggatccgcatgctcgtcctgccagttgacaccaggggcctgctgggcgatcggcagccacggttgatgggtgctgaagccgccattagcctgattgttccagggatacggtgtgcgcgcattatcccgcgaccgccgattaacacacgccagcgcctccgcttgggaatagccttccgtaagcgcccgctgatagttatcatgtgtcggcagatcgtcaaactgatcgatactggttcgcgtcgcattgaccatccctaattcctgcccttgatagatgaacggacatccccgcaagcagaaatacaacaacgccagcgctttggccccgatggcattgcgataagccggatccttaatatacttactcaagctccgcggctggtcgtgattttccaaaaagttcgcgccccagccaactttttgaatcgccagctggcttttagtaatggcatcacctaacatttttggcgtccagtccgtttgcttgaaccactcggaaccggaagccacatcgatatcggcgtaatgaaaatcaaaaatcatggaaaagtagccgttgggaccgatgaaatcagccagctgatcgtaagctactccggaagcctcgccgatggtaacggcattggccgggccaaaagtcgcggcatttaattctttgaggaatcgacccagacccgggcgattttctgccttacgcttgaccttgccgagcccgtcactgccatcaggggtcaacgccgcgaagtcctgatcctttttgataaacgtgatcgcatcgatgcggaagccggccaacccttttgccagccaccaattgatcatctggtaaatggcttgccgcagtttgggattctcccaattgagatccggttgttgcggcgaaaagacgtgcaggtagtatgtgttcggttcacccggtagcgcggtccaggccgagccggcgccgaagttcgagcgccagttattcggcggctgaccgtcgtggccttggcgaaaaatataaaactgccgatacggcgagtttggatctttcaacgccgcctggaaccatgggtgctgatccgatgtgtgattcaccactagatccatcacgactttaatgccgagcgccttggccgttgccatgagccggtcaaaatcggccatggtgccaaactgcggattgatggcttgataatccgagatatcatagccgttgtccaccatcggacttttataaatcggcgacagccaaatcgccgtcacgcctaattccttgagttttggcaattcttcaatgatgccaggcaagtcaccaatgccatcgtcgttactgtctttgaatgacgccggataaatttgataaaagatttcctgttgccaccaggtgcggctggttggattcgtcacgactgtttcctcctgctgattgatacgtcgatgttcaaaatgtggtatcgattccatattgcgtaaaaataaaactcaggcgctttgcctgatttttaacgataacgctaatgttgccggatccttttggtggtcgacgcggccaagtccgtgcagcaacatatcggtggcaacctgggccatctcggtcaccggttgatgaacggtggtcagtggcacgcgggcgaacggcgcaaacggctggtcatcatagcccatcaccgcgatgtcgtccggtacctttaaatccgccgccagcaaactgtccagcacgccaactgccacttcatccgagttggtaaaaatggcgtcaggccgcttgactggtgctaatgcggctaattgcttgccaatcacttgaccctctgcagcggtatgcacatgatcgaaaagtaataccggatcaactgcaagcttatttgccgccataaagtcaaagaacgcttgggtacgggtcttcccgtgccgcgcgctttgaatggcaccacctgtcacataggcaaatcggcgatgccccttttcatacaagtagtcgagtgcatccctcgttgcctgataatgcggcagcactaaggaagtcgcatgtggaatctgcacatcggcattcaccactacaacgcggccgggaaaagctttggcaacggctgcaacccgctccggtgcttcaactgaggccaaaatgatgccatccagtttccgacttttcaattgatccaaaaaccgctcctcggcatccggatcatcatatgtctgcgaaatcatcacttgatagccttgctcatgcagcgtccgctcaatcgcatcgaacaacccagcgaaaaacggattcgtcacccgcgaaaccaaaacgccgatattgccagtagcctgagcccttagcgaagtcgccgcagcactcggcgtgtagccaagcgtctgaatcgccgcttcgatccgcgccttcttgtccgcggaaatatacggatgatgatttaagtaccgtgacacggttgtcacgccaacccccgctgctgtcgcaatttcccgaatcgtcgccatggacctgttctcctttttatggaatcgatttcataaaacgagtatacagcgctttcagagaatgtcaagttgtcatcctgaaattttacacgtactgtcgacgggaattccccacacctcttgcgtacagccaccctcactaaacgcggtgcttagacaaacaaaaactccagctacaagaccaattaaggccacataactggagcaaggacatgacttcttttaatcaggcattcgccggtctcacaacccgccgttatccttccgcaagttccacgcctgcaccgcgctgaccgcagctgccggggtgacgcgcacggcactgggacaggtatcgccaaagaaccggccggaaaccacgcgatagccatcgtcaataaacagctcgaaaacggaaacgtcaatgaacaaccgaatcgtcacgttcttacctgctggaaaaccgaattgccgcagactaccgccattgttgcgattctcccgctgcaccatgccttgcccgctatcggaatcaaggttaatcagcagctgatcatgatcgccatcgggaatatgcagcgttgtcttctgcccggctgccagcgtcatcgtgagttcgaaggcaccggttaagtctgccactgaccagttatcatcagttttcgtcacagttggcaagctatcatctgcagtctcacgcaacgtctcaacgtttggatgcggcacaaggcaaacatgcccatcgcggagatccaacttccgcacgtaactcaaaacgccttcccagccatcgtcatcagttggataactcgtgtccggcaagcctaaccacgaaatcgcaagcgtgccatctttttccgtatttgccagccgcgttgcgtaaaaatcgaatcccttgtcaatattctgcaatcgctgatgcgtcagcgtgcccgtttccggatcgaaactgtcacccaccagcgcaatgttaggataaacattttcatattcgaaaaagtcctgatccaagccttgcggacaataaaccaacacgaccttaccgttgatgaacgcaatgttaggacactcgaccatgtagccacagaattcgtccggaatgctgagcggcgcaacgaaacgccaggtcttatccgttagcttttcgtataacaaaatagcgccggtatgatcagcccgctggccgcccactaggacataggttttgtcttgatatttgaaaagaaacggatcacgaaactcttgggtatacccagctggtggcgcggcaatcaacggcttaggatccttaaacagccgactatccgcacccagcaccgcacccaattgagtcgcatgccgatgccattgttcgtcacggacattgccagtgtacatgatccgtagcgtgccatgcgtcaccagcgcagagccagtataagccccttgcgcatcatgctcgtcctccggcaaaagatctccgggaacccgccgccagttaaataaatcttttgagaccacatgcgcccacgacttcaggccatgcaccggcccaaatggaaactgctggtagtaaagatgccacttaccattgaaaaagttcagactacacggatcattgatcaagccggtgtctggttgaacatgggttttggtccgccacttacttgcggcgacttgagctttcaagctagccacgtattccggtgtccaagctgaatacggctgataacgctttgccatatgctcaattgaatcggtcatgtacttaccaccttgtgtttgaaataatacccttatcttatctgagttaatggcaatgtcaatgaaagcgcgaacaaaataactttagttttttcgtcatgcttgatgtgctgggatttagcggcaaagatgtgactgcttgtcaacattcactaaagtagaaatttgcttatagtttgaagggagttagtgcggctctccataacaagtttacagtggcaaaagaaatccttcgtcaggcatattgagatcttagtgccaaagcggagcaatcggaggccagatggggatcagccgtggaattgttgtaggtggggcgctctttgccccacctacaacaaggccgagcttagagactctgccggttttgcagaggctctaagtcgtgccctccgctctagcttcgcgtcgccaccccagctggccggagattgcggagtttggcacggctcggaacatcataccccctaagagatcattcgtaatataactcaataactcgcactgacaaacaaaaaccctcacaactgcttgctgcgagggttcgggcttggccaatcggatggagtccgatcggcgacttcactttggaggagtagaaatgaaaaagttggttggggtttaggaatgagtgggtggctcacttctatgctgttaatactaccgaccatgtttgaacattttgtgacgctaagttgttctttgtgttaagcatcattccagctttcagatcgcccatgtccggccaaaaaagtcgctacaaccgactcattaatcgtacatatagtcacgggtcgccggcagatccttgcctgaagggcctttactgatcaaatactgcatgacgtcgatattgccggcctcaaaactggcagctgcggcctgcaagtagacatcccacatccgggtgaactcgtaaccgaacttttgctgaatcggattccggtgattgttgaaattcgtgtcccagatttcgagcgtacgctgataatgacgccgcaacggttcaagatcatccagctgcatccctgcatcgataatatgacccagattttccgtcatgcccggaatatagccatccgggaaaatgtacttatcaatccaggcatttgatgcgccgccttgttgccgcgtgatgccatggatcaaggcaacaccatcatttttaagtagtttagcaacatctttgaagtagccttccagattttccttgccgacgtgttcgaacatgccgacagacgtaatgtaatcaaacggctcgcgatcgagttcgcgatagtccatgtacagcacttcagctacatcggtcagatgctcggcttcaatgcgatcggaaaccagcttgaattgttccttgctcaaggtaatgccgacgacatgcaggtggtaaatcttggccgcccgcaacatcagcgttccccagccacagccgatgtccagcaaagtgcgcccgggctgcggattcagtttacgcagaatatggtcgattttattcagttgggcagtttccagatcgtcatcccagttttcaaaataggcgcaggaatacgtcagcgtcggatccagccataatttataaaagtcattgccgagatcgtaatgcgaatgaatatcttccttcgacttacgctcggtgtggctttgtttaggcagaaagtgtctgagtttgctgctgcgcataaaactgccggcattggcataagccgacgcaatcaagcgctgcaacggtcggttactacccagcacctcaatgtcaccacgcatatagccttcacccaaagccagcgaagcattcttgatcagctgacggacgggaatggcttttttcattttaatcgtaatcgttggctcgccggtgccaaaggtctcttcggtatggtcccaatattcaacccggaccggaatattaaaagattgactgaacatggtatggtagaactttttttcgagcatgatggcctccgtttcgaaaagttacaaaagtaattataaaactttttaaccaaagaaaaaacaccgccgtaaaaatggacggtgtggtgccgttttcattagaattgtcggaaccgcgcctggcgtttggcaaccagactttgcggatccatggccgtcagctcggccagtttgggcttcactgcggctttgagcgctgccggaaaatccgcaccagtatcgggaacgatccgatcacagaccccttttgccaataaatcctgcggtgtcagctgcatcacttctgctgcttctttcgcgcgactggcatctttccacaaaatcgcggcaaagccttccggtgacaaaatgctatacatactcttatcggtcatccagacttcatccccaaacgccaaggcaagcgcgccacctgaaccaccttcgccgactaaaatagccagaatcggcgtcggtaaatccgcacaggccacaagcaagtcagcaatcgctgctccttgcccgttggcttcggcttctttaccagggtaggcacccggcgtattgatcagcgtgacaatcggccggtgaaacttagcagcctgtttcatgaggcgcaacgctttccggtatccccaaggttcaggactgccaaaatgcgtctgcagccgctctgtcaaatcattgcctttgtcggtcgcaatgacagtcacagcctgctgatccagccagccgatgccgccgatcactgccgggtcatcatggctctgccgatcaccgtggaattcatgaaaattggtgaccagaccattgatgagctcacgagtttgatacggccgcggcgcccgggccgcttgaacggttgcgtaggctgaagtttctttttttggcatgcgaaaagggcctccttgtttcgattggtgcttgggtgggaataggtggtgcgggatgttcgatgatataaacacgttcactgatgcatcgctaacaattctccaacataagcttcctgctcactccgctgtacaatagcatcaatgaaaccactttgcagcaaagtttcggcgcgttggaagttttgcgggagtttttggttaatggtctgttcgatgacgcgacggcccgcgaaaccgattaagctgtggggttcagccaaggtgatgtcgccttgcatggcaaagctggcagtcacgccacccatggttgggtcagtgagaacactgatgtatagcaggccggcattgctgtggtttttaacggccgcactgaccttagccatctgcatcagtgaatgaatgccttcctgcatccgggcaccgccgcttgcgcaatacaagacaaccggcaagttggcttccgtggctttttcaaataaacgagttaaacgctcgccagtcacggtccccagagagcccatcataaacttaggatccatgatgcctaggccacagacttgtccgccaatgttagcttggccagtccagacgctatcttttaagccggtcgcctgccgtcccgctgcgagtttcttgtcgtagccgggaaaatcaagcggatcggtggtcaccagatcggcgtcccattcagttgtctcggttgccaccagcgctaaccgcttcttagccgtgatgcgaaagccatagtggcaatgcggacagacttgagcatcgcctaaactttctcgatagctgccttgcttacaatatggacattgaatccacagattttcgggcaaggccgcttcacgagcaagtgcttcttgggttagttgtggttggaacatgcagcatccttcctttcatcctgccattgcggcaaaaagtcgcggttaagataagcggtatcggctttaccggccaatacaacgggtgcctggaaaagtgccagcgcaaagtcgcggttggttttaacgccttgaacatccagttcggtcaatgcgcggtgcatttttgccaatgcttcttggcgggtttgcccatggacgatgatcttagcaatcatcgcgtcgtagtatggactgattttatcgccaggcgcaacgccggtgtcaacccgtaaacctaagccgccggtcgggaaccgcaattgattcagcgtgccaacatcgggcatgaattgatggtcgggatcttcggcgttaaggcggcattcaatcgcaacaccagatggctccggtgtcgtcaattcgacgttttcgccagcagcaatctgcaactgcgcgcgaaccaaatcgacgccggtcaccatttcggtaatcggatgttcgacttgaatccgcgtgttcatttccatgaaataaaaatgatgctgtttgtccatcaagaattcaatggtcccggcattgagataatcaacgccattggcaatggtttctgccaactgcaacaacttggaccgctcggttgaatttaataccgggcacggactttcttcgatcattttttgactgtggcgttgtaagctgcaatcacgttccgggaacacgctcacatggccttgctgatcgcgcagcacctgcacttcgacgtgtttcgctggcacgatcaccttttccagatacatggtcgggtcgccgaacgcggcttgcgcttctgcctgggcaccggcaaattcggcagtcagcgcatcggcgtcggtcagtttacggatccctttaccgccaccgccagcactggctttaagcatcaatggataaccgattgcctgagccgctgccaatgccgtatcgacatcctgtagcggacggctccccggaataactggcacgccaagatcaatcatggtctggcgggcaaccgctttatcacccatttgctcaatcgcggttggcttagggccgataaaagccaggccggcatcggtcaccaacttagcaaactcggcattttcggataagaaaccgaaacccggatgcacagcttcagccccgcttaaaatggcggcgctgacaacattgcgcatattcagataagagtcggttgcccgcggaccgccgatgcaaatcgcttcatctgccagcgagacatgtaggctgtggcgatcggcattcgaaaataccgccaccgaggtgatacccatttcccgcaaggtttggatgatgcggaccgcaatctcgccacggttggcaacgagtacttttttgaacacagttccacttccttacacgagtctgaatccggcgaatttagccaatggcaaaaacgagttcggcactgcaggccatatcttcgccgacgtataccttgcctttacctaagccagcgtggtcaatcagtttttccaaggtgacttcgatccgcaaaacgtcgcctggacgaaccatgtggcggaacttggcttttttaatgccgccaagatatgcggttttgcctttgaagtctggcattgacaacaaagcaattgccccggcctgcgccatggcttcgatttgtaagacgcccgggaaaatcggattgcccggaaaatgaccttggaaaatctgttcgttgatggaaacattcttttgggccacaactgattcgccgggtttaagatccaacacccgatcgatcatgagcatcggatagcgatgcggtaaaatttgctgaatttcttgtgcttcaagtgttttcttggtttcgagcatggaataaaattcctccttaaaacgcgtttgttaggtttgcgggattattaagcgcttttctaaacacagctagggccgttccatagttttgccagcacagaaggatttaggcaatgtattctgtgccgtgccaaactacgcaatctccggcgttttggagctggaacgtggtgggcacgactttgagcctcagcaaacccggctgagtctcaaagctcggccttgtactacgccgggaagaacgcccggctagtacaatttcaccactgagctccaaaacgcctacgattgctccgccttggcactaagatcttaaggttcctgataattgcctgtgacgaaccaaagagtgaacaacgcttctatcttcgaaattaacgttcacttttgcatcgtgatcatgaactacgcccttgcctataccgcttattcttcgaccgtaaacagcggttggtcgtattcaaccaagctctcgttgtcaacttcgacagccttgagcgtgccactcacggtgcttttgatttcgttcatcattttcatcgattcgatgatgcagacaacttcaccttttttgacgtgatcgccgactttgacatacggatcggcgcctggtttgggtgccaggtaaacgataccgactagcggagccttgatggcggtgccggcgggttgttcaggttgggcagccggtgtcgggttgaccggtgtggctggcaccggattggaagccggagcaaccggtgccggtgcgaccggacccgctttgacgagatgcagggaatcctcgccgagcgtcagttccagctcgttcaaagaactttgctccaactgcttaatcaaggattcgatcattttggtgtccatgacactcaccaccttttgaaggccaagaccgcattatggccgccaaagccaaaggaattgctcaaggcataatcaactgtggtatcacgattgtcttggttgaccaaggtgacggggcagtcttcatcttgtgccgcgtccacgacgttcatcggtaaccgaccatcctgcaacgcgctcaaagtcataattgcttcaatggcaccggctgcacccaacagatggccggtcaatgctttagtcgaactgaccagcacgttgtcgccgaaaagatcatgaatggctttactttccatcgcatcattggctttggtagccgtaccgtgggcattgatgtagcccacttcacttggcttaatgccggcctcttcgacagccagttgcatcgcacgtgaagcctgagtaccactcggatcaggtgcggtcatgtgataggcatcacttgtcgaaccgtatccaacgatttcgcctaaaattttggcccctcgttgctgtgcatgctcaaggctttccaaaatcaatgcaccgccgccttcgccaagcacaaaaccgttacgatcggcggaaaacggcaaactggctttggtcggatccgtggacttggataaagccgttaatgccgcaaaccctgcaatgccgatttcgttaaccgatgcttcagcaccaccggtaatagcaacatcaacgttaccggtttgaatccgcatcgctgcttcaccaatggcgttggtggctgatgcacaagccgtgacgaccacataactaggaccatgggcgccaaagtattgggaaatggttccggcaaccatgttactgatggcttcaggcacaaacagtggactaacccgatccgggcctttcacatacatcttcgtcacttgttcctgaatggttgtcaaaccaccaatgcctgacccgaaaataaccgccatccgatcggcgtcaacgttgtctttggtcagccctgattgttcataagcttcaatagcgctgtaaaggccatattgggtaaacaaatccatccgcttgctgaggcgcttttgcatgcgcgcttcaggcttgaaatctttgacttcaccagcgactgtgattccggttttttcggcatcaaatttggtaataggttgaatcccgactttaccggcatccatcgtcgctacagtttcagcgactgaatggcccagcggattcacagtacccattccggttacgactactcgttgcaatgtcattcctccgttcatgtccttaacctaacccgccggcgactgtcaaagtctgtccggttatgtaggcattttcgaccagaaagcgggccgtgtgcgcaatttcttcgggctggccgaagcgcttcaacggaatttccgctaagatctggtcctgactggattggctcaatgctgcggtcatatccgtggcgatcatccctggcgcaatcgcattcacgcgcacaccacgcatcgccccttcacgtgccagtgttttggtcaagccgataatgccggctttgctggcggcgtaattcgcttgcccgatgttgccggtcagtccaaccacactggcaaggttaacgatgaccccggcacgcgccttcatcattttcttgaaggcaggttgagtcacataaaaagtgccatctaagttaacttggacgaccttggcaaaagtggccggtttcatccgcatcgccaacatgtcatcattgatgccggcattattgaccaaaatatccacactgccaaattgatccaaggccgctgctaccagctgctcaccggttgtcggatcgtcgacactacctaagacggtgacgaccccgtggccaaagccttctaattctttgatcaaagtttccggaaattcatggcgcgcattcagcaccaagttggcccctgcctgcgcaaaatttctggcaatcgcttcaccgatgccacgtgaggcacccgtgatgatcgcagttttatcagttaatttcaatctgccttcactccgttattcaaatcggcgacctcattgaggctcgctgcatcactaatcagatgggtcgtcatcttgcggtcaatccgcttgatcatcttgctaagcaccggtttgggacccaactcaacgatcgtatcgacgccttcagccttcagttgcgcgataaccgtcgcaaatttggttggttccgcaacctgggctgcaagcacggaacgcatattgcgagccgtaaacggcttgagcgcggtcgtgctgatcaccggaatgaccggttcaaacacattggcctgtttcaacgctgcctgcaactgtggttgggcacttgccatcaaggggctgtggaacccgccagccacatgcagcggaatggcgcgaacgccttgtgcttttagccatttttcgaccacggccaaagcatcatgggtgccggacagaaccgtttgcttgggaccgttgtaattagccggccaaacatccggtgcctgttcgcacgcttcctgaatgactgtctgatcagcgctcatgaccgccaacataccgccaggctgattctgacaagccgccgccatcgctttaccgcgcgccgcgactaatttaagcccgtcttccagactcaatccgccaccagcaatcaaagcactgtactcgcccagactcaatccagccaaggctgtttccggcggcaattcggctgacgctacttcatgcattgccacgctgtaagccaccaacgccggctgcaagtcatccggatgcgcagcaaaatcaccattggccaaaaactcaggcaagtcaaagtccaaaacggcgtcggcacggtcaataatctctttgaatatcaaagtattctggtaaaaatcgatccccattccggggacctcggcaccttggccgttaaacacataagcaaattgcaacagatggaaccctccttgtcatgtgtttactgacgtggaaatgcatccgcagtcgaactcgtgagaaggtcagccatttttgacccagccaaaatctctttcgcctgctgcatgacttcttcaacgatgtcctggctgctttcttcgcgcttgaccaaaccggaaatctgaccggccatgaatgaaccatgatcgcgatcgccttccagaacagctttacgcaaactgccattacctaattcttcaacagcggtaaagtcagtcgtaccggacaaggcgatttccttttccagtttcaggtagttacgactcatcgggtttttcagcacgcgggctgcatgaccgacatacatgccggtaaccagcgtatccacgtctttcgccttgatcaccgcattcttatagttttggtgaatccggcttgaagttgatgtcaggaagcgagtgcccatttgaacgccgatcgcaccaagactgagcgctgcggcaacaccgcggccatcgccaatcccaccagccgcaacgaccggaatatcaacggcatcaacgacttgcggcaccaaggccatggtcgtgatactgccaatgtgaccgccggattccatgccttcagcaatcacaccgtccacgccatcacgcgccatgcgcttggccatggcaacagacggcacgaccggcatcacaacggtaccgttttgctggagccgttccagataacggctaggatcgccagcgcctgtggtgaccaaggcaaccttggcatcaacgataacatcaatgacctgttcaacaaaaggcgataacagcatcacattcacaccgaatgccttgtccgtcattgattttgcaacttcgatctgttccttaacccacgaagcaggggcatgaccggagccaatgataccaagaccaccggcttcagaaaccgacgcagctaatttaccgtcagcaacccatgccatgccgccttgaaaaagcggatacttaacgcctaagcgttccattaatggactcattggcccactcctctccagttgtcttaagcttcggtcctttcagtgatgaagtttaccagatcagcaaccgtttcgatgctttcatcggtttcgatcttaacgtcgaattcgtcttcgatttcgttgatgatttcgaaaatgtccaggctatctgcatccagatcattcttgaagttcgtggtcaaagtcacatcttcagcgtttttgtccaattggtcagcaatgatgttttgtaccttaggcaatacttcttcgttagtcatgtttaaatgttctcctttaagttaaatggtttgaccgttttttcggtcagtctacagggaaattcgaattaatacgtcataatcagcgagccgactgataagccgccgccaaaaccgctgaggaccaatttctggcctcgtttcaggcgaccgctttcagctaattgtgccaacagaatcggcacgctggctgcgctggtgttgccatactcatcaatgttgatgggaaacttgtcggcagtaactttcagttttttgttcacggattgaacaatgcgggcatttgcctggtgaagcaggaaccaatcgatatcatccgtggtcatcgccgcttgatccagcgctcgctgaatcgaccgtgggacttcactgatggcaaattggtaaaccgcccggccgttcattttgaaataagctgaaggttcctcagttgcatccgcaaacggactttgattgccttgagccccagctgacagtaccatctcggtatcgccgaagcttttgaggtcgactgcctgcaccggcgcgccttgatcactgatcaaaacgccgccagcaccatctgcgaataacactgctgtgcgtcgatcatgccaatcaaccaatcgagaaagcacttcgcttccgatgaccaaaccttggtgaaccgttggactggtcatcagtcgatcggcaacgtgcaacgcatactcaaaaccggcgcaggcaacgttgagattaaacgcaaatgcatgatccgcattcagtgctgcttgcaggcgatttgcctcggccggggttgcatagtccgggctcatggtcgccacgatgatgaaatcaagctggtcggcagtggtagctgacttcgccaaaagttgctgggcaacatcatacgctagatcaaagttacgctgatcggtgaccacgtggcgggttttaatccccgtacgttctctgatccaactgtcggatgtatccataaattgacgtaactgctcattttcaacacgcgtggcaggtaccgaataagcactggccagaatctccaagacggggccttctttctaatgacgatattcgtcaataaattcattgagattatccagcgcgcgttcgattaactcgatttgcggctcggtaaatcctttaacaaaacttgcaaccattttctggtgaaaggcaaggtgggcgcgatacattaaacgccctttgcggctaagtcgcagattcacgactcgtttgtccgactcaagatgcagtcgttcgacataccctttgcgtgccagattgttaatggccacacttagggttccttgcgtcacatgcagctttttggccacatcacttgagctgggtgtcgcatgaataccaatcgcatcaatggtgtgcatttctttaatacctaaatcccggaactgacttttgcgcagttcctcttcttccattcgtaggatatctgaataaacgcgaatgagtttatcattaatccgcttgacgcttggcttttgggacattggtgtgcctccatgtacaactgatttgatattcaaagtatcagttgaaaaaaaaagcctgtcaagtgaactaagcatttgcttctaccacaaaatgcaattctgcgtggcagacgagctcatcaccgatactggcggtcgttgtgaccacccccatgttcgcccgaaccttgcccattttgactgctagcgtcaaaacgctgccagtcgggacaggcttcaggaattctgttttgccgatacttgccagataagcggttttaccagcaaactttggtgatttcaaaatcaggattgatgccgcttgggccagcgtctcaataatcaacgtcggcggcatggttagctcacccggcagataagcaaccagatgatcctctgccacgctaacatacttctccgcgacaatggattcatccggtactaattcggtgacccgatcgatataaaacaacggataacgattcggaatcagcgtctgtatggttgaggtatccaaagttgtcatagcctcgcctcctttaaccacgattgcaattgagcatttgcagaaaaaatcatctcatcgcgaaacgaaataaaaatttccgcttggatcaggtgctcacatgctttcgctcttttgtccaaccagattaattggatgttcaaagcatatgcagaactgttttgattgtcaaacctttttcgcctatattcttttgtgagaatataggcacaagcgaatgaaggcggtcccagataactttgttgcgggatttaaggcgtgccataaactgtgaacggatacaaaaaataatttttgaaaaattgagtttttgcgaccgctgttttaattgaaacaaaaaaatgcgatgaccgttggcaggcatccgatcatcgctaaaaatataatttttttgttggaactctggtacccgatcaattactgacggccaagagcggcgcgtaaccgactatcctttaacttcaagcggataatggtgcccactttttcgggttcgtcaatccacggctcgtggccagcaccattaatggtcaccagttcgccgcgctgcaccactgcggcaatttcctggccaagctccggtttggccaacgcgtcattcgtcccccaaataagcgtggtgggtacggaaagatgccgtagttgatcttcaccgaggccattatgctttttctctgagttcatgctgcgcaacagggacaaggtcgataccgtgtaattcggtaagtggtcaaaggcatagacgcacgcggcaaagctttgcggcaacttgctgaccgccactggatcagtgcccatgcggtgcagcggtccccaagcacgcttggcagatttggggatctggcgcttcataaaccactgccccaaacccggcatcatcgccattttgaggatgccaggcgttttggtcattaacatccgccctgggtttcccaaaagaatcaactgatcaacgcgttccggatgcgctaatgcaaaccaggttgcccaatgtgcgcccatggaatgcgcaatgatcggcgctgacttcagatcaagcttgtccatgatttggccgattaaatcaactgcaaattggtgcacgtccacctgttcatggtcaaatccgtcgcttaagccgccacctggccgtgctagcacaaacaagtgataaccggccaattgcggtaaaagcggtgcaaacgggtagggatcgccggtattgcccggaatgataagcacaggatccccatggccaaattcaagcaccctgactcgcaaattatctggtggcaatttaaaccaacgcgccttgggtttcaggttaaaatccgcccatagttggttctcggcgttacgcgctgcttgaaaagcgacggaatcatgttcaagaatcggttgcgtcacaaactttccccctcgtcaatcatcaaaaaatcactcaaaaccatcagctatgccgttaagccgtcagtcatagcggcttgatagatagccttgacatcttcttctgacaacggaacataagcacgcgtctcgagtctggcattagccacagcagccgtcgccatcgcatcaaagtggcgctcatctgtaatgccgacttccggcagtgtcatcggaaaacctaaatgctggatccagtcaaaggtctcgtcaattgccgcttgcgcaacggcatacgtttcgtccccttcaagatcccacacatggcggccaaagcgggcaaacatttcagccgttgttgaatccttggtcaatgcatattccatccaccgcggggtcaaaatgcccagaccgaccccatgcgtaatgtcataataagccgacagctcatgttcaaggctgtgcacagtccaaccgttttcgttggcaacgctcatcacgccgttaagcgccatcgtcgcactccacatcaaattagcccgcgcatcgaaattgtccggctctttaaccgcaatcggggcccacttaatcaccgttcgcatgaggccttccatcatgcctttgctagcgtcattattcttggaacgatcaaaatactgttcaagcaaatggctgagaatatccatcgaaccggctgcggtttggcgatgcggaacggtatatgtcagtgtcggatcaagaaacgacactgcgggcgtattcggtccgttcgtgcctagcttttcgtgggtttccggattagaaatgaccgaaccgctattcatttcactaccggttgcggccaaggtcaaaatgtccacgaccggtaactggggcaacttgtgccgggtcacgccgcgatctttcactaagtcccatggatcaccgtcataaaactttgcactggcgatgactttagctgcgtcaattaccgagccgccgccgactgccagcaccacttcaacatcgttacctttaaccagttgctggccttcacgaatcgaagcgattttaggattaggttcaatccccggcaattcggtaagctgcaaatctgcgagcaaaccttttaccgtatcgtaaagtccggattttttggttgagtgtccgccataaacaaaaagaactcgcgaaccaaattgactcacagcatcgtgcagttcaacgtcaagccgacccgtcccaaagcgtatatcagtgggattcttaaaccgaaagttcttcacagtgccatctccatttctttcacctgttatcaatttaattgtacctttattgtgattgaaatagaaatgttgatggcgctttttgtcgcctttattaaatgacgttatggtaacgcgttcagcggcgcaggagccgattcacgttcagctccccataaagtgctcccggcgcaaagccggagtgacttgcgctcacagaaaaaaagcccgaccaaatagtcggactcagaggtaaaactcgttttaatggctgactttgacggcataaaccacgtgtatcggcgttgaccggacacgtaatagtcgggctgcttcctggttgccgtgcgcggcacgaatacataacatgcgccgcgcctgtttggccactagcagtgtcggaaagtctttaggaaataatagtgcaaataacgcttcattcgacgcgccaatcaatgataagggacacctttctgcttgctgaatttgtgcatagtgtagcatgtttctttgcaagcgccaagggggtatttgagttttttgttatttaagttaatcacatactgctaacaacggtgtttcagtaggtacatcctgcaaatcttcaatatattgagcttcttaactttgttcaaagatttagaaacagcttccatcattcaaattcggttagcaactgtgacgtcattttaactgggtatttataacaacacctgtggcctagttgattcttattaacggtatacgcatcaacctgtagactatgtttacgacctagaaaaggactaatcacccattttcttggtctagcggattggatggcacacccctcaacacttttctagcagtggaggtgtcagctatgccaaattcaggagaggaaaggggttcgccgcgttggatgtggcgtcgattatcatcgcgctaagcctactgatcaccagtagtgctaaagcgtatgcgataatcaaaaaagctaaccgccaaagttagcttttacccttgtcatctgagccgtgtcgaggtcatcgggggtccatcccggtggcctcttttcaacccctaagttatacgttaaacctggccaattcgtcaacaagtctcttctcaaacaaagtagacaaataaacgctagctcgccttctagccccgtatctgatagttgtaattggccccttagtcggtctcactgtaaggctactaaaagttgctttagcgtctgcgtaagcgcctcagggtccttaacgttcgttgcaaaagccttctccagtacctgaaatagctcgtggacctctgccgccgcggctttgcctgcttcggttaaaaaaagctgccgctcacgatcactgtgcggcgccatgcgcttttccagtaagccttgttggatcaaccgtttcaccaagttggacacgctagccggcccgcggctcaagtcgatactgatttggcgttggttcgtgccaggatgggcggcaacaaacgtcaataccttggcttgatcactatttaagtctaaatcgcttaggtgctggtttaaaaagtacttctgtaactttgccagctgataaattaagccggaaatattcgattcggtttgcatacataacccccatgtctactaacatacgctttttggttttaaatgcaacagtttcattagcgctccttcagccgactttttagccaatttaaaatctaccttggttcaaggtaacaaaaaggcatttcacaagcagactttgcgaaacaccttcttaaaaactaatcatcatcgtcttgaatcagttcccacttaccagaatcgtcgtcgtatttgctcatctgatcatgaatttcgtcatagcggtatttgttatgcaactcaccatcatctttatcgtaaacatcaacttctttcatattggtcgccggtgacgttacttccacgcgatagtcatcaaggtcaaagtcgtcgagatccgcagccattttggcaacttggcgattgctcaagtcactaccgcccgttgttgtggtactttcgtgactctccgctgctgccgattcactcgcgttggcaagtgattcactggctgcttcttgcgaggccgcgagtgaacttgatgcagacgcttgcgaagttgacgcagacgctgaaacaaatgaggctgacgaagcattcgcggctgaggcgctggcggaacttgccgcagcctcttgcgtttgctgactttgattctggaaaaatagcaccgcgatgacaacgataacggccgcagccagaaccaaactgaccatcagccacgggcggcgcggtccatttggcgcactgccatgactgcgctgccgtcttgagtttggcggcacagcaccttgcccggttggctgtgacgttgggccgaccgaagatgcattggcattgcttgatccgttttccgggtccgttccctgatgttgtgaccggtactgagcgagattaaacccgcattgatgacaaaatgtttcatcggcactgacttgcgcgccgcaatttggacaaaacgccatgattgtttcccctttttgattgtgagcgtgagccggcgcgcttagaagccggagtataagtggccttgggcgtaatggcccgggcttaggccattgcgaccaaggtccttatacgcaggcttttgcgccggcgaacgcgttatggtgatcgatcaatcacctggttgatccaaaagaactattcagcttctgatgtcagtctcgtggcaacagacgggccgttacaaacatcactaaggcagccccgatcccaatcgaataaccgatacctggactcaataatccttgggtttgattactgccgctactcatcagcggcgcgtaagcaaagtaaagcgatgcatagccaagcaagcccaacatgccacccaaccgcatcatgccgcgtgaccggaagaaaccaaacaacaagcccaatgccgggcccaaacctgctaacaccaaggccagataaggcaaattagccttcgccgaactgacggtaccggcagctgcagcggtttctgctaacgtattcgcactgcgcaccaaatcatacaggctgccgccaactgcagtggttcccacaccgctggcaccaaatggccacacataggcagcaatcagagctacaaaagcagccagtaaataagcaatccaaatcacgccaccgcgtcgtcgcggttttccggctagccgtgtccaccagtgttgcggcgcattcgtcgtcatcccctgtggccacggcgaggttgtcgattgaccacccgctgctgcagtatagtttgcaccttgccccggcgcagcggattgaggcatcgtccaaatatcatcatcatctggcgactcattactgaatttgctttggtaaggtgtcaccactcgacgattggcgacgacataaactgcgaccgtgctaatgaccgccagtagccaaccaatccaaacggaaaaactgaagacgcaaaaaaggaccagcgccccaatcaaggtatacacgatatgtgttgccagccagtcgagaaaatgttgaaaactatcgtccgtcaacacaaggcttttcttaacgttcgccgttttctcctgttggcgccgtgatcggcctgctgtttcccgttgcgccgcacgtgtcgtatcgcttgccgtctgctgcattgtcggatggctttgcgtttgctgcgttgctgattgagcggctaagcgcgcatcaaattgcaccaaatccataccgcaattcggacaaaacttcaccccagccggtattctaaagccgcaatttggacagtaccgcattttttcagccaaatcggtgacctccattctgatatgtttaattccatattgcctgcttggggtgaaatagtaaagttcccgcaaaaggtttattaaaagttcaagtataagagcctcgttctcgaatgattcagaattttatcattctcaaaattaggttgtccatcactagagagattgatggcagtgtatgtttaccttaagtaactatcgcttctgttgacatacagttgcctgatatcgcaacgaatagtatcagttatcaccatccttgatcaactcccacttgccagtttcatcacgatactggcttatctgaccatgaatttcatcataacggtatttgccatagaggctgccattggttttatcgtaaacatcaacttctgtcatactgctggctggcacactgaatttaacccggtaatctcgcaagtcgaagccgccatactctgctatagtttgtgctatctggtcgttgtcaagatcgtgatctgttagatttgcatttccagattcactagcatctatggcagattcattagcctctacttctgaatttagagaattctctgccattgtggaagctttttcagcagagcgtgattgggcagaatccttgctagcctctttcatgaatgaagacacgtcaaaatactcgccgcttttagatgaatcagttgcgttgcttacacgatcaaggcgtttttgcgaataaaacacacctaataagagcaaaacaaaaataccaatcacgatagcacccatcacccatggacgattcttgttcggccgattagaccgctgtggcggaagcatttgacttgctgaatcctcgcttgtttgttgatgagttcgtgtcttcagctgtgattgccgctgcttttgttgattaactgatgtcgaagttcttctagctcgaaactgagccaaattaaaaccacaattatgacaaaaaagttcttcagaatcaacccgcaccccgcaatttggacagtatttcattttcaaataacccctccgttattttagctaatacttttccggcgttcttccagaagacttcgtaaatatctacagcttaatgtatcggcctaaaagatttggcaagacaatcttacaacaacttcgctcattgaaaacactaattatttcaagtgatgcttttagcttctacatttacactgataagcagttaaagtatttgtagatgtagtgtcccctaagattggcggatgcgcatacaaaaaaatcggctttagtgacaaaactcgcccttaaagtcgattcttcagcacaattaacgaaatacaatatcaagcacagtacgcttagcaaaatacaacagcggaatccttcttaaaccagtgatattaccatttgcaaaatttgatttttaaaaccgcggctcaaacccccgcggaccgccagcaccaaaactgcccggataaccacggcgagggccatgatgaccgtgatggaaccgttctgcccacgcacgcatgtcatcaaattgtttgccttctggccaggtaaggtcatcacgcgtggcaagatccgctgtcagtttatcgattaatttcagtaaatcagcctgttcctcttcagacagaccagcaaaaatctggtcaggtaaatccgtcttaagtttgccagtcgtttcgataaactttcggccatcatcggtgagggcgatcagttgaactcgcttatcagtttccgattcatgccgcgcgagcaatcctaattcttctaatttctgaaccagtgcagaaacagaactaggacgaatatccaaagcctcaaccaaatccgagttggttaactcgcccttatcgtctaataagcgcaacaatcgcaattgattgggttgccgttgccgatcgccaaatcgcaaactgctggtcacggcgccaataaacgcccgtttttgaagcaaactgccaaatgcttttaacaatgcttccgaagtctttgtcatattaaaactcctttttagttagaaaaccatatgccgaactaacatcttaacaatactccattagttagcccttgtcaacactacctatctttttagtcgccgactgctttttgcgcatttattggcacggcttgtccaaattggtcctgaacatattcgcgataaactgggtgcgtggcgactaattcgtcatgagtaccgctgccactaaccgatccattttcaataaaataaatgcgatcagcgttaacaatcgtgcttaatcgatgggcaatcacgatggtcgtgcgtccatgcatcaacttattcaaagctttttgtaccatcatttcggattcggcatccaagctggcagtcgcctcatccatgatcagaatcttgggatcccgcaagaacgcgcgggcaatggcgagccgctgtcgttgtccgccagaaagtttctcaccccgttcaccaacattggtatctaatccttggggcattgcgattacaaaatcctttgcataagccatgtccaacacgtgccataattcagcgtctgtgtaagttttggcggcaccgtacgctaaattatagcgaatcgttcctgccatcaccgttgcgtcctgtcccaccaagccaatctgttcgcgccaatcattaacatcaagctgcgcaatatcctgatctccgattaaaatgtggccactgtccggctcataaaagcgttccaaaagactgatgatggttgatttaccaccaccggaaggacctgcaaacgcaatgacctgattcggtgctgcctcaatcgacacatcctttaaaaccggcgtcttgtcgtcgtaactaaagttaacatggctcatggtcaaggccttgccgcttgcatctgccaatgggcgacctgatcttttttcttcttcttgttgcagcaattcttccagacgggcggtcgagccactcgccttagacgcttccgtggagaactgccccaacgttgaaaatggtccgataagctgtgtcagatacatcaggaaagcaaacaaggttcccaaattcatcgaacccgttgccacccgactagccccatacgccaatatgccaacaatcagtgccatcataaccgttgtcatcactggttgggcaatcgcgtcataaaccgcttctttcaagcctaaatgatacaatcgcttaatttgcgcatgtcctgtttgtttctccgctgcttctgcattagaacttttaaccaaccggattgcccctaaaacatcgcctgcttctccactgaaagcggccagattctcttgccgggaaaatgcgattttacgtgcttgcgtggccacgggtaaaaagatcacaatcatcaacggcaccgctgcaaacataatgatggtcattttccaatccatcatcaacatgaaaataagtgctcccagcaactgcatcaacgctgtcaccatttgcggtaaggaattagccaataaatctttgacttgggttgaatcgtttacgagtcgcgaagtgatttcgccagatttggttttgtcaaagtaactaaccggcaacaccagcaattttgtccacagtttctctcgcaacttagcaaccacgtcttcgccgaaaaagcccaataccgcgccagatccagcacttaacaatgctgatccgataaacagtcccagcatgcctataaccagcttggtatcaagcgaatggcccagcgtattgatcaaagatttagccattgtcggtacgagtaactgaccaagcgtcgcgacaatccctaacgtgaagccaaaagccagttgccaataatgcgggtgaatagcactaaaaaggttcaaaaagccttttaaattaagtccctttgatactgcggaatgttgactaatcattgtctcgtttgcagaacgttgcatgatcacgttgcctccttaatcaggattcatattagttagtcttttaaatttctaactaacaagatacacaataaacgctttgttagcccctgtcaataaaagctaataaaaaggccgaggcacgcctcagcccaatgttgctattcaaataaataaccgcggtacgcttactgctaagcctgtgtttgcaagtaatcccggacgcaatcgatcatgtcacgcgtttgctgactaaacaatggcggtaacgcatcaaaatcaaaataccgtaacgccaaagtttccttagggtcggcatcttccaaacttccgccaacaggattgaccagataaaaccggcagacaatctgcgcctgatcgccattcgggtaagtcgtaaacccgcgatcaaaggtatgcaggaccttgatcggctcaaccagcagaccggagtcttctttcatttcgcgtttcagcgtctcaagaaacgactcgccatattccatcatgccgccgggaacgctccagttgccggcatcggtccgctgctgcaacaataactgcccctgatcgttaacaaccgcaccagccactgcattgagaaaaatgggcatatgcccgaccttgctgcgaatttctttaatatagtttgccacttaactgcctcttttcacgaactgtttaaactgattatcagacagttgagcttcaggtgcaagattaggccacataccttcactgacgtttaagcattttgacgccatcttaatgcggacaaaataccgattaacgaaagtccgcccgcgccgaccatagccgcttgaaacccccttgaaaattcaagtgatgtgtctgcactgccaattgcatagaaaatcaaaactgaaatggtgaccccaatggcaccgccaaacaatcgaaacatattgtacaaacctgaagcttttcccagattctttgggctgacagcacccaagaccgctttttgcaatgctggccctgccattgaaagaccaatacctgccagaccaagcggcacgatcgttagactatatgtataaccatcgtgaacgattaagccaataagcaaataaccaagcccttgcagaaatagcccaaagatcgcaataagctgttctccaaaacgatccacggcgcgacccgcaaacggggcaacaagaaccagcatgcccgtccatggcagcatttccattcccgcaatcatggcattgacatgtccaaccacctggaaaaattgaggaaggaagaacacgactccgtacattgcggcatatagaagcgccgtcgcaagattagcaccggtaaattgccaccgctggaaaaagcttaaaggaatcaagggaaagtcttcgcgtttttgtcgccatacgagtaacaacgcaaacaaaatacttaaaactgccacaatgatagctgctgtggggattttgactgatttacttgccgaaagcgcccaaatcagacctgctgaagttaaaaccactaaaagtgagtcaagaatattgatcttttgggatccggctttggtttcaggaagcttctgttgtgataataagatgcaaattaaaccaattggcacattaatccagaagatccactgccacgcaatcttggcgacgatgataccacctaatgccggtccgacaataagcgccagtcccccaatgccgctccaaatacctagcgctttgccgcggctttccactggtacgtttgctgtcaagatggccattgacatcggcgtgataaccgatgcgccaacaccttcaacaacccgggcaacaatcaacgacataatattcccggacaaggcgcagagaatcgatccaataacaaagatgagcaaccccagttcataaactttgcgatgtcccagccgatcgcctatcgccacaccaaccagtaatacggcagcaatcgcaatattataggcatttaaagcccactgcaattgatcaacagaaatagaaaagtcacttctaatagccgttgaagcagtcgtcacaatcattgaatccatcattgacataaaaaagccaagcgatgtcaaaaataagatccagcctgtctttggttttgccttttcagcatttaacatacgagcacgctcctcaatatttaatagttaaacgattgttcaactattaaaccttaaagcttgctttcgtaaattgcaatacatagttcaaatctttttgaactattttgtataaaaatagccgatagacatctaccggccatctacaaatttttataaaaattcgttacatagagatcaaaattttcagcattaagcgaaacatacttctcgcgcgaagattttcgcgtcttcgtcaatccagcttcacgtaacaagcgaaaatgataggatcccgccgacttgctcattttaattgcctcaccgacttcgccacaggtgacctccttgttcaccttttttaaatagcgaataatagccagtctaactggatcagccaatgctttaaaaaccttaacctgaatttcatcaacttgcgcgctacttagttcaataatcatacaactattataacttatctttgccaaactacaaacttaatcagctttaaactcggttcgctagatactaaacaccaaaaaagacaggcatcctcgcacaaatacaaaatctgcacgaacaatgcccgtcttatacggattgtttagccaatcaagctagaattaatccaacttggtcttgctgttaacgttcaacttttcatcaaagtcataaacaaccggttcgccagttgccatttccaagttcatgatgtcagcgtcggaaatgttttcgatgtacttggtcaaagcgcgcagtgagttaccgtgtgccgcaatgacaacgttcttgccatccaacagatccggtgcgatatggtcttcccagaatgggataacccgttccagcgtgactttcaggttttcgccgccaggaatgatccgcggatcaaggttagcataacgacgatccttagcagcagagccttcgtcagttgctttcaacaatggtggcaaaacgtcatacgaacggcgccagatatgaacttggtcggcaccatatttatcagccgtttcctttttgttcaagccttgtaatgcgccatagtgacgttcgttcagacgccaggtcttcatttccggaatccacaattggccggattcttccaagacgtagtgcagggtcttgatcgcacgggttaaaactgaagtgtaagcctgatcgaattcaaggccggcctgcttgaccaattgcccagcatgctttgcttcttcgacacctttttcactcagatcaacatccacccagccggtgaattggttggacaggttccattcactttgcccgtgacggatcaatactaatttcgccatatcagagaatacctcgcttttatgatttgacagtcttctgtctgtttacagaatctcatgttacaccattttcagtaagttcgcacccgctttctctggtatattggaaacataagggaaaagaaaatgattgaggtcacctgaacggcgtgtaaaagtgggtcgcgctccggtggtgatgaccatcgtctagtgtgcccactgcatcgcggcaacaacccactacttggaggttatcttgaaaaaaatctggttaacgatcggcggcttctggctgatcagtgtgatttattttttggtctatgtaagcaccactgcctttcaagtggccgtgaatgaaaacggcttcttgtccttggttcacggggtcatggatttgatcttactcggcaccacctttgccttggttgccggtggtctttatcggctcttccatcgcaggtgattttttggtggtagcttaaggcattcgccaattcatttggtatgattaggtgacgggtgttttcataactggggattcggctcaatgcgtgaactgggtcggaccataacgcgttcaccggcgcagaagcctgcgtataaggaccttggtcgcaatggccaaaacccggccatcacgcccaaggccgcttatacttcggcttctaaccacgccggttcacgctcatcttaacgcgctcgccagcccagaaacctgcgtataagggcctcaggcgcaatggccagacccgggccatcacacctgtggccacttacactccggtttctaaccgggctggttcacgctcacttttactttggaggtaattctatgtttaaaatatgtcctaattgcggcgcccataatctggtaaccgccaacttctgtgtcaaatgtggtactaatttagctgacgttgcggtaacgcaagaacaagctgatacggcatctcacactgcacctgctgaaaagccggccacaagttcagccacaccaatttctgctgcaaaagaagcggtgaaggatgaaacggctaattcagcctcaacagcagcacaaagcgctactgccaatccttctcaagcgccacagaagccggcaacatcaacggcaaccgcatcaaccgatacaaatacaaattctggcgccgagaacagtcaaccggtcgcacaggcaccagcagcacccaagcagcctaatccaacggttgaagcaggcaaacagtatgctggcagttactggcgttatctagttgacagcatcaagcatccggcgcacattgatcagtcttatcacccttattttggctttaccagcttggccattaccattatcagtctggccttaacaatcgcgttgcgggttagcagtacgctatcgtcacttccaggtggcgttgccagtatcgttttaagcaccttcatcaaactgtttgtcatggtcgccattcttgcagttgctattattgcgatttattatctggcgatccgcggtattctgggcgatcggcggcgcaattttcttgagttcaccaccgactatgccttccacgctaactggatggtgttcttctcgcttttcacgctgctgatgcagatcgtgggccttatcaacgtcggatcggccatgctgctcacattgctcgtcgcgttaagtctcggactcttcctcttggccggaccctatatgctattcaccgcgcaaccaacaaatcagttcgataaaatctatgcatacttaattgccagcgcattactcttcctggtcttcatggtggttggcatgctcggactctcaagtatcattagcagtctttaccaaggcatcaacgatattggccgctctttcaactactagcagtttcatttaacgttgcaaaaaagacgacactggattttttcctctagtgtcgtctttttgtcgcactatcgaaccaatgcttccagattctgggctaacgtcaccgtatctgtagtcatggtgtgattgccaaacagcacaacgccactcgctgcattggcgcggaaataagctaacgtactgaagctttccggattgtcgttgtacatgccttgcaataaccgctgatcatctagccaggccaccccgctggcataccgattaccgtcggcataattggcgctgatcagctcgcggtaaactttaggcggaatgatcttcccggtttctgcagcaatgatgactttcgccaggtcagtcacactcatgtactcgctgccgctgccaagtaagctcgacaagagtgccgggctaagatcatctggctggtagtggtcatcatcttcggtgagatagccttgcgctacgggcatttttgcggttagttcatcaaaattgcgggtatgttgaagatttaacggcgtcaggatcgtttctcgcaatgtcgtcgcaaaacttttgccggttaccttgcgaatgatgccgaccaacagcgcatagttcgcatttgtatagaaaaagtcatgctgaccggtcgaccctagttgctgcaagttccaatccagggccttcgactccgatggcaaaatattgtctggcattaactcgtccatctgaatcccggaacggtgatcaagcagttggcgaaccgtgatgtccttgctatgggcaatctccggataaaacttcgccagcttcgtcgtcagcttcaactggtgattggccactaaccggccgatcagcaaggcggtcagatacttttcgaccgaggccaacggaaacatggtatcgccggtattggccaatttgcgatcgtgattcgcctcgccaacgccaccgctatacaccactcgcccctgtttgatcaatgcgatgctgcctctgaagtcagtctcgcgaatgagcttgcgggcacttttacctaactgtgcttggggaaccggatgtgccgtaatcttagtggcatcgcgttgatgttggatccacgccatcgtcaagccacctgctgcaagcaccgccacgagcaccccgatcacgatcaaccaacgttttttatgcgccatcgccgtcgtgctcctttggctgcgggatgctggcatatgtcgagtgactggatttcgttccggcaatctttttgacgcctaacacatcgaggaagaacgtaaaaatcggaataccgacaatcagaccccatgtgccaaaaagtcgttcggcaactagcaaaatcacgaacgtaaaaaataccggcagctgcgtccgactgctcataaatttcggattcaacacataagcttccagtacgtggatcacggcaatcatgatcaaaatggtaatcacatcctgccagccgccgacggtatagccgataatggtcagcggaattaacgatatgatcgccccggccaccggaatcagtgacaacagaaagaccataatggccaaactaggaatgttcggcattttcaggaataacaaggtaatcgtcgtaatgaccgtgttgactaccgcaataaaaatctgggcttccatcaccacgccaaaggtattgatgaacttcatggcaaaatagcgcaagtctttgaagtaccagccaaacggcgaatccaggaacagtttgccgaactcaggcaggctgtcgagctcgatcgtaaagaagaaacttaaaataaatgacagaaccagcgtcaaccccatggcgccaatattgccggcatattcgagaaccgtcgacagcccggttttaagctgttcggtcagattcaggctcttggtgctcgacaatatccactgcatcacttgattgttagcaaaggcatcactgttataaaaattctgcactgaattaaacagcgtgatggtttgcctgacaatcgccggtacataatgtacagccgcataaaccagccccaaaaggaccaatatgtaaaccggcaccacaatgataaacgggcgaatgtgaacacgccgttgcaccgcatgaaccaagcggctgaccaaaaaggcaaaaataaatgtcagcaaaatatcgctcataatactgcgggcgaaccataagactagaaataccgagaataaaacaacggtacgccgaaccggcacgttgttgataaatttttcgtaagctgacatagtctcccccatttaacattctttactcattaaactttagcctgccgcaaaaagaaaaaaagtgcaagcattcgctcacacttgcttaaattataagaaaattttcaaattatgactgttggcatctttaactgtttgcagctcgccttgaacaatgatccgatcgacttcgccttcagtcggtgacgcacatgtgaccaacgtgatcagtttcttgcccgccacatcatcgatccattggacttgggtctcattaacaatctgtttagtcgtcaccttatacgtgtagatgtgcttcatattcgtgataacaaccgtatcgccttttttaacgttctttaatggcgaaaagaggatgccttgattggtcatatagtgaccggctaacgcgtaattcccttcgcccatcttctgatcggccttcatcgttccggcaccggcactcaggttatcgttggataaacccttgagaatcggcagcttcaggttgacgctgctaatagcaattttgccgataggatgcagattacgcgtgatcgctgcattgccgaccgtattgatatccaacgccttgacgcctttaaaatcaaacgtcgcgtgcttcttttcatttttgtcaaccgtgtcccgatcaatatgcgccatcgttgtctgacttaaatgatcaaccacaaataacttaatcggttcattgaagaccagcgctaagccaagaaggataccgagcgtgaaaatcgtccgccaaagccaacgatgcttgcgcggcggttgttgcttactagattttgtcatcgtcaccctccttgggaaaaggataccctgaaatttgtcgagattcaagcacacctatcgtacaaaaataacgtttcaatgttgcttattaattgtaagtcatacccgtgcaaaagtgcaagtcacttgatcattcgccggctgacgcattcctgccttgcatggtatactgtgacgagttgccattattcgggcaggcatacgtgccaaacctaatactagaggagcacttccctttgaaaaccctgattcaactttacctccgctatgaaatgatcatcaactacttattcattggcggcctcacgacccttatcaactttgtcacttttttcgtgatgcgctactttggcatcggtttagtgttaaccaatactaccgcgaatattgtgagtgttatctttgcgttttttgccaataaaagtgtcgtcttccacagcgattattccagcaagaaaaagttttggttcgaactgactagctttctgattcttcgcggcgtgtcactgctgctggacaacttcatcatgatcgtcggcgttgactggctgcatggcaatgagattctggtcaaaattctcgatcaagttatcatcgtggtggccaattatctgttctcaaaattgatctttgtgcgcaagcgttaaccggctggcaagcccacaccaacagcaacttgagcaaatcgcaagtccccatcaacagtctgaaacatcgactgtcgatggggactttttagttggtcattggcaataagaacatctgtgtcgtttgccgcaacgtaaccgcaattggcgtcgtgtactcctcaccatccatttgaatcggcaccgtagccttcgtgacaaaatcaaattgatcggcctcgagatggtggatagcattatgaaccgatcggccgcttaaaatggcaaccgcgacttgaagcaaggtgccaagcttttcccggcgcacttgaaccagtgataaccgctggcgttgatccattgcgtccggaaaaaggcgaataccgccgccgagaaatggatggttggtaaaaacattcaaataggcgttatcagcgtgtttctcagagtgcccggcgacttgccacgttgccgcgaaacctttctgcacccgcagcgcttttaaaatgctggcgccgtaagcaaattggcccaacttgagggcatttagcgtccctttgtgcagcgaatgattggtttggtaaacaatctgcgcgtccatgccaatcccaaaattattgatgaaatactgagtcccatatttggcggaagtcgcaaccccgatccgcaccggtcgcggcatagcggtgaccagtgccgccgcggcctttttcggatccaagggtatctgctgggcgcgcgcaaagtcatcgcccgtgcccgtcggaacatagccaatggccacttcgggatgaccgcgacgttgtaagccattcacaacgtcatgcaacgtgccatcaccaccgataacaatcagttgcagttcatcaaggtgatcatgataggctttaagcaatttctcgatcacaatctgcgcgtcacccggctgttgggtccggttcacccgcaacggcgcaaagtgcgatttaagcagcgccaacaacgccggcaactccttcttccagcgtgcattacccgcacttggattcataataatttcagcagaaaacatccggttaggccatcctgtcatttaagtcacgagacaattcatgccatagacgaattgcccggttaagtcacatgataccattttcgggcggcgcaaccattgattgtgctttgcgttcgtcgtgacattaaaattgagcagcaggcaacagccccgcaacataaaaaagaacgtgcaaccattacggcgcacgttgatttacaatttacgttcaaatgatttgtctgactgttcaatcactagttccaaagcggagcaatcggaggcctgatggggctcagacttgcaaacaacacagcgaccgatcttgtcgctgatgttgttaggcgactttgagacagcggttttctggctcaaagcgccgtctccgctctagcttcgcttcgccaccccagctggccggaaattgcggagtttggcacggcacgaaactcattgcctgagtttttccctactcacacacaattattcaaccggaacgtgatgcgcctgcaggaactcactgaacggcaccaacttatccgcatagtaacgcttcttgaacgctgcaatggtcgcggcatcgaagcggtcaggatccagttgcaggtgctcaaccggaattggccgttcattggtaattttggcatcaatcagcgtcggtttgccggcaatgcgattagcctcggcttcatcaaacgcgtcagcaagttccgatacctgcgtcaccgtgatgcccgtcatccccatgcctttagcgaccgtcgcaaaatcaatcggcggcatgtcaataccgaaccactcatgaccgtcatcttcctgctcgtcttcgatataacctaaagcattattggagaacaccacattaataatcggcaaatggtaccgcacttcggtatcgagatcctgcatgaccattgctgccgcgccgtcgccagtcaaattgaatacctgccgcttagggaaactcaactgtcccgccaaagctgctggcaagccagcgcccatggtggcaaacaaaccactggtagtccaagcttgacggcccgtgactttcagcagccgcacggcattctgcgttacatcgccgacatcaatggcaaaaatcgcatcatccgtcgctaaccggttaatttgaccgaagactggttcaaaccgcatgtcaccagtggtccgctgcatcatgtcatcgttgtattgatgccagtttttcacgttgtcgacgttcgcctgataccagccgctgcttggggcatcatcgctgcgggcaatcattttctccagcgttgccggtgcatctgccaaaatggccacatcggtgtgatgacgcttgccaagcgtttttggatccgcttcaatctgaatgaactttgctttaggcgagaacatcacttcggaaaatggatagttggagccgacgaacatgatgaggtccgcaactcgtaacgcttcattagccggcttcgacgcaacccgagcagccgatcccagcaacgcttcaaactcatacggaatgatcggtttaccgagtgcggtggtaatgactggcatctgtaactttttggctagcgtcatgacggtatcggccgcaccgcgaactccttggccgacatacaacacgggccgggaaaccgcaccgattagccgcaaagctgcatcaacctgctcatcactgccggccgccaaaaccggcgttgcatgcgtttcagcggcgctataatacccgtcagccgggattgattctgctggcaagtcgttggggatgatcaccacggcagcaccacgaccggcataagcgcggcgaatggcctcatcgatcacgtggggtagactgcgcgcggtagtcacggtgcgagcataaacagcgccgtcttgaaacatcggatcttcgtccaattcctggaagaaatcggcattcataaaccgttgttcgacctgccccaccaagaatagcgttggcactttatccattttggcatcatagattccttggaaaaggtgcgtcgctccggggccagctgatccaaatgccacgccaatatgaccggtgagcttaccatcggcaacggctgccagtgccccgacctcttcatgccggacatgaatatatttgatccgcgcctgctcttcgtccagcgcatacatcatgttattaaacgtaccgccgggaatgccgtatagatgggtcacgccccaactttccaaagtccgcaatgcagcaattccggcttttatcgtctcagccatcagaaaccctcctcatttaagtgagcgtgaaccggtgcgtatatgaaactgcgccgatgaacgcgttatggtgaacacttcaagaaaaactgttacgaatgagttaacttttcataacattagatacttcttcgcggttatcgtagtcattaaaagcctagaaggcaagccatctgctcattaacccgcccaacaaaaaaacaaggaggtcatccgcaatcttgcgagcgactcccttggcgttaacgatcttctatttcttcaaatcttcaatactgttaatgttcttcatatacctcggcacagccaacccaacgcgggcaccgtccatgttgacgccaagatcaacgacttggttcttgtaatcggcgtataacttggccgccgtgttcggcaaccacgcggaaacctgtgcgtctgcggccttggtggccaccgatgcccagactggctgcggctccatcgccctaatcgtgaccttatagccaacttggcgcaagaccgttgccacgacattggtggaggcaatttccgaatcccaggcaatgtacgttaacgtcaacttaggatgtccgttgacatgactcgcaccttttgtccattcagcaacctgcttgggatgcttcttgacgaagtctttggcagcatcagccggatcctgaccattgttgacggcgagcatcacgctggaaatttcttttggcgtccagtggaattgatccaatacctgataggcttgcgggtcatcctgcttgagtcctttacgcacaatcgtatggatctgctcggttttaccataaacatttttaggatccttcagaaacttcaacggaaacttcgtgaacatccagtgcggcgtccagccggtgaccacaatcggccgtttgtcggcaatcgcctttttcaacgtactggtcatggctgcggttgaactcggctgcagctgccaatttttatctgccaggccgtatgctttcagcgccttatccgtgctggtcataatcccggcaccggcatcaatccccgtaatcgtatagttgatctgcggccctaatggcttgttggcatcgtacttaggctgggtgctgctgcaagccgccagcagcaaaacacttgccatcatcgccaaggttgcgatgatctttttataaaaacgcaaacgaccacctcctagcgcgtgcgattgaggctttgggtgatccggtccaaaatgatcgccaaaatgacaatcgcaaggccggcgacaaagccaccgccagcatcattacgtccaacggcaaaatagactttggttcccaggcccatcgccccgatcatggacgcaatgacgaccatcgacagcgccagcatcatgctttggttgatgccggccataatcgtcccgcgggcaaacggcagctgcaccttgatgagctgctgccaactagttgcgccaaacgcaacggctgcttcgttcagatcggccggtacctgatcaatgccaagctgggtcatccgaacggttggcggcatggcaaaaatcaccgaggcaaccactccgggcaccatcccgatgccaaagaacgcaaccgccggaatcaaataaacaaaggctggcatggtctgcatgaagtccatcagcggtttcacgatggcagacaccgttttgctttccgcggcccagataccgaggggaataccgatcacaatggctaacagactggctgttaacacaagggtgagcgtttgggtcatgtcgcgccagaaaccgagattccagatcagcagtaagcccagcagttcaaaaatcaacagactccgatacttctgatcccgtttcaaataccatgtcaacgccataatcagcacgatgaacagccaaatcggaatcaaatcaaacaccgcctgaaaagcgttcacaatgctgccgatgaagttcgtcagcaccccgaagaacccggaaaactgggttaaccaggccacgaacgaatcgatccagtgggccaacggtaaagtcggaatattcatgaaaagattaaacattgacattgacctcctgtcctgccagtgcccctaacacggcaccgcgaatgatgatgccgcgtaacctgtcacgatcgtcgataacggcatacggaaccgaagtcgtggaaaccgcgtcaagcagatcggccagtggcgtatccattttggttgtcggcacatcggttttaacgatatccttcagatccttcttgccggcatcaatcgccgctcgtacatcatccgcatccagaatcccgaccagtttccgttgggtattcaccacacacaaactggaaatctcgttatcccgcatgcgccgtgccgccaaccgcggaccatccttgtcaatgttgaccgtattggcccgaatcatgacattagccgccgtgtaaacctgactgcggtccacgccttcgataaatttctcaacgtaatcgtcagctggctgactcaggatttcttcaggggtaccgatctggacgatttcgccgtccttcatgatcataatgtgatcgccaatccgcaacgcctcgttcaggtcgtgcgaaataaacacaatcgtcttatgcatgtcttcctgcaaatccagcagttcatcttgcatatcccgccgattcaacggatcaagcgcggaaaaggcttcgtccatcagcaagatctcggcatcactggccaaggcacgcgccaaaccaacccgttgctgcatcccgccagatagttggtccggatattgatcggcaaaaccgtttaggccaaccaagtcgagggctttattggctttggtttcgcgttcatctttatccataccttgaatttccaaaccaaaggcggcattttgcaacacggttcgattcggcaagagtgcaaacccttggaacaccatgctgagtttcttacgccgaatctcgcgaataccttgtttgtccattttggcaatatcgtcaccgtcaatcagcacctgaccggcagtcggttcaattaaccgattcaacatccgcaaagtcgttgatttcccggatccggaaagtcccataatcacgaagatttcgccggttttaatcgaaaagtccgcccgatcaacgccgaccgttgcgccggttgcttttaaaatttccggcttggttttgccatttttcagcatttccttagcgcggttaattcgtttaccaaaaatcttggtcaacccgcggacttcgattttggtttctgcatcactttcaattttgtgttgcatccgttcacttctcctctcggggtcaccgctttttgacaagcgtgtacccagtactgtttgcttaaagctatttgctatgccttgtgttacttggcgtcttatttaagaaacagttgtcatcgaattgaaacaatgctaaccattgtaaagatcatttgtgtgtgattcaaatcacggaatctcattttcatttttcgccaagaactcagtgtcttcgagtccacgatttttccgccatcaaaaaagccctcatctgcataggattgagggctagggacgattaatgacccggtagcaatgcctaaataaaattgtcaagtcaaaatgaaatttttatgaacgagttttcatttttcacaaactcgccaagtcgatttctgtaaacggaagctgttcatcaaaggcaattttgtgtcctaacgtaatggcatcgggaccggttaccgtatcatatgccaacacccgaacgccggcttgcttagcgttggtgatcgcggtgaccagctcgggaaaacgatcccgataaatggtcatctcctgaatatctggcaactgtacgatgaacaccaaaaacgcctggtagccttctgcctgcgccatcatcaaggtatggacatgcttcaatgcgcgagtcgtcggggcatcgggaaatgcggctaacgagccattcgctaacgtcacgcctttggtttcgacaaaccatggctgcccatctgcagctgtgccggcaaaatccagtcgggaatcccgccaagtcgtctccggatgaaccgtatacggcaacgtcaaccccggcagtatcaaggttcctgtttccaagcattccttggccacatggttcggtgccagactgtcaatattgatccagcgattttgccgctgcacggctaaaagatcgtagtgcgttttgcggttaggattggccacatggcgaacactggcaagcgaaccgggaatcagaatttccttattgcggccggtattgttcatgtgaactggcgtcgtcacgccctctaattcaatttcgaccgtgaaacggctaacccggcgaataagtttgccgacgctgacgttttgataatgcatgggatgcctcgtttctgttagttaaggggtggtcttccagcaattgcgtcgagcgtacgctggactgtttgcttgctatccgtcgccagtctgcgctcaaaaagcagccccgaactcttttttggagtcgcgacggctgcttgttgtgatgcttttacaatattagcgaacgataatgacagataccgacgcatcacgtgccacttcacttgccacgtgtccgagacgtaaccgaccacggcgcacgtgcgaacccataataaccaggtccggcttgaaagcaggaatcacttcatcaaggatagcagcagccggacgaccttctgccacaattggctgcgctttttgaacgccgaagtcgcgggccttttcaacataagtattcaggtttttggccatcttttcccgtgctgcatcaacatcgtcaggtgtcaatgactggaaaatattcaaatcgccggtttccagaaccgaaacaatccccagcggaatatcgtaaatcttggcgaccgtgcaggcgtagttcaatgccttgcgcgaggagtcgtcgtcatcatcatcgaccgccaacagcagtcgattataatgcacggattcaatcgttaaatcattttcagtaaccaacagaaatgcccccttgcaagtttaggtatccctaacaaaactattctatcacacattacctttgttttccgaaaaatactgcttaaaccggccgacataattgtgaaacatgtacttaagcaatatccaacgcttgaaggtcatatccggcttgtaaaagaccgtcgtcccgtaacgcttttctttgataagctgcaatgcttcccgcttggcctcattatcggcagaatattgcttgaaaacccgctccggcacgcccagccatagcttgtatttgctgcggtcagcattaccgaaaactgttggagcatccttgagatcgccgacgatataatcacgaaccggccagctggcaagattgtagccatttaacgtgacaaagaaactgctgcgtccctggcggatgttgatttcaaacaacttaaaggtgttgtcgcggtgatcatatttcatatcaaagttggcaaaacccgtaaacttgatggcttccagaaaatccttgatctgatcgtatagcttctgatcaaatgccggcataatggcgacataattaccgattgaagccggcgtcggatcttccagcagcgggtggcccaaacacatcattttaacgtgatgatattgatccacgtaacagttcatggtgcgcatgttgctatcatcgccgggaacaaaatcctgcaagatcagatccgacgtgtagccattgtcataaattttggcaatcgtgttggtcagctcaacctgtgagtggatcgtgaacgccttcttacgtccttcaaaatggatgttcaaccactccaccgaatcagtcggtttaagcgccaccggaaattcaaacggtgcggtgatggtggcgttgctttcgtacatcgacttggtgacaattttggtcgccggatatggcagatgatattcctcgcaaacctgatagaagctttccttgctattcaggcgcttcagcaaatcatagtcaacataagggcagatgaaccactgactcaattcgtctttatgtttggataccagttgcgcatatgtatcgccgcacgcaattaagagtagtcgacctgccgaagccgcatgcaggtgcgcgatttcacgcattttttcgatgaacgtggggtcggaatcaaactgcttaatcagatggacattcacgatacgcgaaaaacgcgtcggcgcaagctgttcacgtgcataaacatcaatcgcaccgccgatcatctcgtggaacgaacgcgccatcccgtacacgttcatatcactgccaagcagaatgggggtaaaactgggtgcatctttcatctggatgataatctcctcgttcgataggttcaggctcgttacgcctgcgccttgaaattttcattgaaaatgcagcggcgatcagtgacgttgttgttgccggctgcatatgacatttccgaagcgatggttgaagcggttcaacttttcgctcgtcgctctcgaattataccatactggcaatatgcattcatgaagatactggtagtgtggttcaaaactatttcagctgcgccatatcgaccgtgatgtacacaatgctctgattagctgccaacgaccaattcgacggatcttgaactggtggataaggttcaccatccagcatggttgcgatggcatccacagcctctatggccgcttcttcacgcgttgttccttcagtcaccattcctttaatatttggactggtgactgtaaagtaatggccgtcttcatcattaaattcggtgaaaatggttggatagactagaaccgatgatttgataggctcttgtttcatggctgtactcctttaatcggagatctctgcttggctcgccttctcagccagatacgcagcaatctcttcttccgtgggtggatgcttactgacccaccccatgtgaacggctaattgttcttccttcgggacagttgttaattccgtgatacaggcaagcgcgcgctgccgatacgaggcccttaccgcgatgatttgcccgactttcaattcacctctaagccgcccaggaatactaaaacggtgcggtttgccttttagacccaccgcaaccgctgtgttataaggactgatcatattgagcttttcttcttttggcaaaccggttgcaaacacttccaggatagttcgaattgaaaagtcaagcgacccatcgccgtgccacaattgtaaagtttctggcgtcgtcaggcgttttatcacaccctcgcctagcgcagtgacagcggtggcccccgtttcttccgccgtgatcaatttcagttgttttagctggtccagcagcatagacagacgctttagagacaaactgatgacttgatcaccaaccgctatttgaacgttgtgctgcacgtcttccatcacctcggcatgcttgacaagcaaaagcatgtaagcaaggccacccactcgcagcgtattgttggggctggctagacagctccgaatcatttcacggagttcgccgaagttagcagtatttcgcagatcaaagttgaaaccttggtaaccggcttggcgatgatcgctaattctcaagtgccaaagccgtttgccatcagtaatcaggctgtaccggctgttggtggtaaacgaatagacgaataacaattcatgctgatcaggccccaacgccgctttaatcgtgtcatgaataacctgcgacaggcgactcgcggtcgtgtaataccagtgctggccgatgttgatcagtacccgctcgttagacttaatccgctccatccgttccgtcctttctggtcttgatcatgacagttgtctgcctttatattaccaaaaatagccgtcaaacgagacgatgatatcttgttgcctgccctctaacgatctttctcgccatataaccacatttggcgtagaaaaaacaatcatggcgcgtaaaaaagccaagcttcaatgctcggccttttttgaaagttcccccgtttttaccacctgtacgccttgttcactcggcgtcacgattctaacttgccattccggccaccgttgcgcggctgccttttgcagttgttcggctccggcagcatcgccaacaatggccagcatggtcgatcccgaaccggaaatcaataagaccccgtcgtgtgcggccgtctcttggcgcgctgcctgataatctggaatcagcgtggcgcgatacggctcgtgcattcgatcctgagccaccaggcgtaacagcgataaatcaccgtccgccaatacgcgggtcatcaaaacgcagcggcccatttgataagtcgcatccgcataactcatggttgccggcaaaatattgcgagcttcttcagtgctaaccgcgtatggcggaatcaacacaacaaagtgcagctgctgactgacgggatactgtcggacaatcggctcgtcacctaccaaaatagtcgcacaaacctgtccataaatggccggcgccgcattatccgggtgcccttccaactgagtcgccaacttcaaaagtgcggcctgatcccagccggcgtgaaaccaggcattcgccgcagcaagaccgccgaccacacacgttgccgaactgcctaatccccgcgcactaggaacatccgaatcaacggtgatgcgtaaattgggaaccggttgatgaatggcatccgcaaacgtgacaaaggcgcgataaattaaattttccggggtagcgaaagcgggctcatcaccgatgatctcaagcttttgggtgctcggttcaaaagtaaaccgagctttgagatcaagggccatccccaacacatcgtaaccaacgcctaaattagcggttgttgccggaacggacacgcgaatcatcgtcaaaaacctcctttgccgcatcgagaatggcggcacccattgctgctggtgcaaccacgtgtttcggttgcggtgtcatcgctgccagacgggccagatttgccggaatcgcaacgccactcagctgttgcaattgtgccatcaacgaaaaatcgtcgcctgacaccggcaagtcaagtgccttagccaccgcgcgcggaaacttatagggactcgccgttgccaacaagacattcggcgtggcatctcccgtggcacgatactgttgcatgacactataaccgaccgctgtatgcggatccatcaggtaaccatcttgctgccagactttggcaatcgctcctgctacctgttcgtcagtcgcaaagccaccggcaaaatcggcttgaatcgtcgccagtacatcagaacggacttgatagcgtcccgtttttgccaaatctttcatcagcatggccacataggcactatcttcgccgctcttataatacagcaggcgttccagattacttgaaatctgaatatccatacttggagcaacggtttttaaaaacggccggttacgatcatagatgccggtatccaggaagtctgcgatctcgcgattggcattggccgcagcgatcagtttatgaatcggcaagcccagtgccttggcataaaaaccagccagcacatcgccaaagtttccggtcggcactgtgaaattaaccggttcccctaactggattgcatggctgttaaccagttgcagataagcggcaaaataataaaccacttgcgggatcaaccgaccaatattaatggaattggctgccgacaacgtaacctgctcagcctgcaaccgcgcagcaaaacccgtatcggtaaacaacgccttgacagcactctgcgcctggtcaaagttaccggcaatcgggaacacccgcgtattggcgcctgtcgttgtcagcatctgccgttcctgaatcgggctaaccccatgatcgggataaaaaaccgtaatgcccgtttgcggcacatttttgaacccttgcaaggctgcggtgccggtgtccccactggttgccgccagaatcataatgcgatcttccggatcaagggccaaccgcatcaactggggcaataattgcagtcccacgtctttgaacgcactggtcggtccgtgaaacaattcaagcacgtggaaatcgccgacttttcgaatcggtgtgatgcgtttgtcggaaaaattttgccgatatgctaaatggatcgcttttttcagtgaagcagtgttaaaatcaggcaacagggtcatgagaacatgctgagcgatcgtttcataatctgctcccagtaaatcctgaagcgcaatccgataatccgttaaatgcggcaaaacgaataaaccgccttcttcggaaatacctcgcttaatggcttgctgactcgttttggttactcgttgatcccgtgtgctcgtgtatcgcatgtgaacgattctcctatctgatccgacttgtttttacgatatggatatgataatctgttcgcattagaaaaacaagtgtctatattttataaacaaggagctgagaaatatgaatattgccatcttaggttttggtactgtcggtagcggcgtttacgatattgttgcgaatggtgatcgccgaatgcgggtcactgcgattttcattcgcccaacccaccctgccaccatgcctgagatgacaactgatttcgatgccattcttgcggatccttctatcgatgtggtggttgaggcaatcggcgggctacatcccgcttacgattatattcttcgggccttgcgccatggcaagcatgttgtgacggccaataaagcggttgttgcccgttatctgcctgaatttattgccactgccgaacagcatcatgttcgcttctattttgaagcaacaactggcggtgggattccctggatccgtaatttggagcgggcggcgcggattgatcaggttgatacgatcgaagggatctttaatggcaccagcaattacattttagaccagatgcaacgcgcccacctcgatttcgatcctgtccttttggcggccaaggatatgggctatgccgaagccgacccgagtgccgacattgacggcgatgatattgtcaacaagctcaaaatttctgcagctttagcttacaacatggtaccgccgcgtgatgtgcctaagtttggtatccgtcacgtcagcaaggccgacatcgactttttcgccaaacaccatcaagtgctgcgtttaatcggtaaaagtaagcgaatcggtgatcattatagtatggtcgttgagccgcggctttatccagccaccgctttggctgcgaatacctttgaaaacttcaacctcattcgcttgcacggccaaaccattggcgatttgcaattttatggccagggcgcaggtaaatatccgacggccaacgccattgtccaagatctttttgatattctggaaaacgtcacccatctaaaacgagacttcaaacaaaccttacaatttgatcctgacctcagtgttgccgactatctgttgcgcgctgatccattgacctttgccatgtttaacgacaagcaaaccgaagtgatcgatcaccggctgctgattaagcaaatcccagtcggcgaaatgcatcgactcatgcgcggtgttttggcaattgacgcccatgcattcatggcggcgattggcgatagcgaactcgtcgcgcgcgatgtcaaacagcaattagatcaggaggtcatcggatgaaagtcgcaaaatttggcggcagttccgttgccacagccgatcaatttcaaaaagtcaaagccattatcgatcaggatccccagcgtcagcttgtggtcgtcagcgccgccggtaaatatggcccggccagccaaaaactcacagacaccctctaccttattgcggacggcatggaagccggccgcgatgtgacgcagatgttcgctcaggtagaggccagattggaagccatcaatcacgcattacagttacacgtgcctttaattaaattaatgaacacgatccgtcatcggcttgccacgcgttactcgcgcgattatctggtatctcgcggcgaatttttgaccgctcggctgatggcggcgtatctgggttatacctttgtggatgccaccgacttattcttctttgatcaaagcggcgccattgacgaagccaaaactcaggcggcttatcgtcagcttcctaagcatcatggcttggtcatccccgggttttacggacagaatcaagccggacatgttcaactcatgccccggggcggctccgatatctctggcgcatggctagcacggctagctcaggcagatttatatgaaaactggactgatgtgtctggcattaaaatggcggatccgcgcattatcaaggatgccgacagtattgacgtgatgagctatgatgagttgcgcgaattgacctatatgggctttagcgtgtttcaggaagaagccgtccagccggttcgtgaatgtaaaattccaacccgcattctcaataccaatgccccacaggatccaggaacgttgatcattcatgatgacgaccccagcgatgagctgcgcattatcaccggcattgctgggcgaaaacattatcttgtcattactattcgtcaataccagcttgctttacacttggaagtcattcaacgcgcactgggcgtcattgctgcccatcacttggtcgtagactacctgccaaccggtatcgacagcttcagcttgttgattcgggaaccccgccaccaaatctcggttcgtgagttaacagcagcgattaaaactgcctgtcaaccagataaactggaagtcacagaaaatgtcgccttaattgcgatggtttcccgccagctgcggaaacgaccggcgattgccggaaaagtgctcgcttatttggatgacaacctgttaaatgttcagctggtcagtcaaaccaacgacgatatcaacttactgatcggcgtcaatgataaggattacgacaaagccgtccgcgtcatatacagcagtatccaccagaactttcaccggccagcaccttatattgaaggcattgcttgaggtatatggtgtttgctgatctatcaaaaaaggctcctgcttcccagttcaatgactgagaagcgggagccttttttacgtgacgcagccgctaatgacaccggcgcatcactatttcttccacggcttatctgcctcttttgttggtgcacttgctgccgattgactggtagcggctggcttagcggctgaggttgccggtgctgctggtgctgccggttgcttttgcggtgcttccgactgtttttgcggcgccttttcggcagtgtctgcgtgtcgacccttgatggcatcgaccactggctgattgccagcttgatgcatgagggcgccatttaacatcccgcgaatgtcaatgcctgctacttcctgaagcatgtccagctccttcaccaaactgccactggtttgcttggtgaggtcgccgtcgccatagagcttaatcgaatcaacgttggcgtatggactcatggcagcttcaatgatcttcggcattgcctcgatggtcatcttgaagcgaccggattcatccaattggcgagccgcttcagcctgcttcgcgatcgcttccgcttgggccaacccgattgcccgggtcttgccggcttcggcttccccaattgccttcgtagcattggcattcgcttcagcagccaattcgacttgcttagctgacgcttcggctgcagcaatctgggtcgccttctgcgcttcagccgcgcgctgagctttatacaagtcagcatccgcctgcttacgcacggtggcattcagttcctgttcctgcagttccgcattcttctgggccagttcaatatctttttccttttgaacctgcttggccttcatctgctcaacaatcgctgcctgatcggcttgggcctgagcaatttcctgttgcttcttgaagtcagccattttgacttgttgctcgcgttcggcatccgccacctgcgtctgccgctcgatttcctgctgtttggcttcctgatcggcctgggcttgctgaatccgcgtgtcacggttagccgccgcttcagcaactgccgcgttttttttgacctcggcaatctgcttcttacctaatgaatcaagatagccgttcttgtcggcaatatctttgatcgtaaatgagataatctgcaggcccattttggctaaatcggaactcgccacgtcctggactttctcggcgaacgcatcccggttttggtaagtatcctcaaccgttaacgttcctaaaatagcccgcagatggccttcaagaatctcggtcgcttcggcattgatctgctcgtcatttttgcctaaaaattgttcggcagcggtcgcgacttcttcctgactggagccgattttcaaaataaccgttccgttgacgataatcggaacgccctgctgcgtgtagacttccggggtcgcaacctcaatcgtacgcgtgttgaggctcaaaacatcccagcgctgcagaatcggcaggataaatgatccgccattcgtgatcagcttcacccgattcccgttaatatcccgaaagctatgcttaccggatatcaaggcaccggaaatgatcaggacttcgttaggtagtgcagttttgcggtgcgttgccaagaaaataaaaagtagcagtaagacaacgatgacaatgatccatggcatataatcagctaaaatttccattcgtcccctccttagggttggttatgtgcggcgactgcatcaacatatgcgacgccttgtgtgagttcgataatcacgactttggtgccctgttcaagtggacgatgcgtgcctgaccacaatttagccgggtaagtttgccgcgcccggccgccccccgtcaccatgacttcgcctgtatgatcaggggcaaccgccagtgtcaacgtgcccagcagataatcctgagtgctcatggacgttgtgttctccaccgatgacaaaacgcgctgtaaaaccgccaacagcggtaacaacaccaacgacagcaacatccataaaagaccggcaacgatcaccaacgcaaccacgcccaccaccaactgcaaacccaatccttgttgggtccaccaagtaaccattccgatcgcctcgctttcaacaggtacaaacgtctcttttattctaccatgcaaacgattcccaacctataccaatcgaaacgaaacgagcgttttattttgcgcaatcgattttatcaaaatgatcagtcataatgcagtgcgtaatcttctggcacctgataccgcagcgtcttagtgaacaataaataactgatgtaagctaatccaattggcaagacaaagaacagcagcgtcagttccaaaatattgcctactgtcacggtcttcatcgcatccaacgccgccaatggccccaccagcccggaaaaaccgaagccggcactggccggggtgccttgaatgttcaacgctgccccaaccccaccaagaatgccggcattgatcgccattggtaagaacagcttgggtttagacaaaatattggccatctgcattttaggcgatcccaggaaatgggccaaagacgtgccaagcggattcgccttccaaccgtaaactgccagcgcaaagcttgccccgacaatccccagattcgccgaaccggcaccgatcccgcttaacgaaatagccgtggcgattcccaccgtgctgatcggagtcacaatcaaaaccgcaaaaatgatgcccatcaaaacgcccatgacgatcggttgcaaggcggtaatgtcatgcacgagcaccccgatgtacttggtaatcccggaaaccggccccagcgtcaacatgccagctccgcctgcaatgagtaaaaccagcgacggaatcagcagaatcgtataggctttcaacgcattccccagcaataaaatcaccaaatagccaatcgcaagcgtaattgccagattgataacatctccggttccggcaaccgttaagccggttttggtcaaatggtaattcccggcgccaataattgcggccaacgctaacgaactcgtttgaatcggtgtaaacttcgcgatcatccccacacaaaccgccgacaatgccggcaacagcgtcatggcggccgtggtcatatacgtcaccaccgccagttgcggaaagctcggcaaaagcaacttcacaatggcgttcaaaatagcgccaggcaccagcgccacgatgatccccacagacaaaccattcaaaatgttcatcgtcaccgttttcgcgtcttgtttcatgcattttcctccaatttagttaacttgatgcggtgaatgaccgccttccaaaatgagcttgacatcgtccaacgaaatatcaatcatgtttttcactgccgcatcggtataaaagccgatgtgcggcgtcacctcaacgttcggcattgccttcaacgtctcaagttcaggattgtcgaccaaggtctgactgcggtcttcaccaaaaataccggcttccccttcgatcgtatccaacgctgctccggcaatgacatgatccttcaacgcctgaatcaagtcaccggtatcaacaatcggaccgcgggcagcattaatgagataagcgcttggcttcatttttttcagtgcatctgcatcaatcagatgggtggtgattgcatccaacggtgtatgcacggtcacaatatcagctgtcgtcagcaacgtgtccaaatctacatagctaaccgtatccgccagctcaggccgcttcaccgggtcactgacaatgaccgttgaccccagcgcgcggaaaattcgcgccaccgcactgccgattttgccggcaccaataatgccgacggtcagattgtgaatttccgcagcttccaaaccaccccagctgtaatcatctttcgcttcgcgggcacttgcttctcctaagtgacggatcagccgcatcacttgcgccaacaccagttcggaaaccgaccgcggcgaatacgccggcacgttggtcacagccaacccattggcggtagcggcttcaaggttcacaatgtcaaagccggtaatccgcaacgtcagctgcttgaggccaaatgccttcagcttttgatacacaacgtcatcaggaatggccgcgtgttgctgaatcacaatgccgtcataacccttagccaagtcaaccgtcttgggcccaagttcaaccgtgttcgtatctacctcaatgtgattagcggccacccagtcatcaatggcagcttgctcatcgggacgaacggaatacatcagaatttttgtcatctttgcctccatgttgtttgtcgttacttttcctatctagccattaatgactcgccatgtactttgcaatgcgatctgtcgctagtttgagatcttccattgacgccgcataagaaatccgcacataaccttcgccgccgggaccaaaactggcacccggaataaccgccacttttgcctcgcgcgccaacgcataaacaaacttccagctatcatgcatgcgctccggtaatttagcaaaaatgtagaaggccccatccggatgcggcaccgtcaatccggcatcggtcaaggctttgatcaaaaagtcccgccgcttcatgtaagcttccttcatcggctgcgcatcattcataccatttttcagtgcttcttcagcggcacgttgcgcgttcgtggtcacgctggtgattgtgaattcgctgactttcccgacttgggcaatgacatccgctggccccgccgtgatacccacgcgccaaccggtcatcgcgtgggacttcgacaccccgttcagaacgatcgcctgatccggcaaaacttcacccagcgaaacgtgggtgccggtgtaagttaattcggaataaatctcgtcgctaagtacaaaaatctcatactgcttaatcaccgctgccagcgcttcgaggtcggcgcgactataagttaccccggttggattcgtggggtaattcaacaccacggctttcaccgtatctttatttgcctcaatcgccgcctgtagcttttccggtttcaaaatgaagccgtctgccgaggtgtcaataaaaatcggcttggcaccattcaacatcacaatcggaatatacaacgggaaaatcggtgtcggaataatcacggtatcgcccttgttcaacatcgccgtcaaactcgaataaatcccgccagtcgcgccagctgtgattagaatctgggtctcgggatcatacttcgtgttgtactttgtcgccagatagtgactagctgcagcccgcaatcctggcagccctttactctgggtatagtggctttcattattttcaatcgagcggatacccgcagccttgacatgttctggcgtgggaaaatccggctcacctaacgtcagcttgacaatgccgtcgattttgctgatttccgcattaaactgtaaaatatcgctcggctgaagctgtagaacttcctgattcatacgatcaactaatgccatatctcttacctccagtattttttgccagtattcttagcaattaacccgatagacgcaaaaacccgcagtcgatatgactgcgggcaaggaattgggaatgattctcctgatttcagccacacagtcaattgcttgatctgtgtgaccgctcactcaaaggtaactggtctcacagatcgcgtctgaaaaaccagaaataaaatgattgtgcgctttgagtcagcttcatcgtcatcatgagaacctcctaagaattggattagctaaagattaccggttacttgtgcatttgtcaactaattcgagttaaattatttgacttgtttcaagtctccactgacttttccgaggataaatgccgcacttcaacggttgaatacgttacaattaaattaattaagaagggagcttttatcgatgaaatataccatcacggccaacaatactttcccggttgtggatattgccatggaacaggatgaaacgatccagatcgaatcaggttccatgatttatcacaacggcttagtggaactaagcggccatatgaacagcaatggcaagaaaggactcggcggtctcatgagcgcgattggccggtcggtgacaagcggcgaaagctttttcatcaccaccgctaccggcaccgcacccaatgccgaattggccatcgcacccggcaatcccggggtcattaaagaattaacgcttgatgacggccatcaatatcgcctgaataccggtgcttttctggccatggacagctcgaccagctatcacatggccagtcaaaaggtcggcggcgctttgttcggcggcactggcggtttctttattatggaaacagccggcacaggcactatgctggtttcggcgtatggcgatattattccgatccaactcgacgggagccacgaatacgtcgttgacaatagccatgtggtggcgtgggatagtcagctggattacaacattcagccagccagcggcgtcatcggcttcacaaccggcgaaggcctagtcaaccgcttcaccggaacaggaacggtttacatccagacacgtaacattcaagctttggctaacctgattaagccatttatcccgactaagagcgactgatcattaaccagtaaggagacattgatgccagaaaaattcggattgcactatcaaacgtttggaaacggccaaccgattgtctttttacatggcatgggattggatggtcacagcatggcagccttttatgaaccgcggttaacggcggatgaaaaagccggctatatgcggatttatcctgatttgcccggcatgggtagttcgcctgccgcggcaacattacgcaatgcagacgatgtgttagcgcaactccaccatttcattcaagctgccaatcaaggtaaaagttacctcgtgggccattcttacggcggctacttggcattaggcttgctcgcacgtttcccgacggattttctcggtgcttttttaaccgcaccggttgtcattgcggataaagcaagccgccacgttgcaaagctgaagcatgtcgtgaaggatgatgtgacaagtgaggacgtcgattttgctgactacctcaatatgaacgtggtcatcagtcacgctacctggcaacaatatcaacaactggtccgaccggctgtggcccattttgatcggccattctgggatgcgatgaaaatgcggcatgactaccgtttttctttcgaatctcatttagccagtatgcttcaggaacctgtcaccatgttactgggccaaaatgataatgaagtcggctatcaagatcaacttgattttgccaaggagcacgacaatattcacacgacgttgattcaaaacgccgggcataatttgatgatggatgcgcctgatcaggtgatgcaagcttatcaccggttcatgcaggaatcgaaaaaggacgatataaccgaatagtatctcagcaaaaacaagggatggtgatggcagcgatttgggcggcggaaccattcctctttcttgatacaaacaccaaaagacggctaatcctttcgctgattggccgtcttttggtgtttcagatgttatcccatagttatattgaagacattggcttacgcttcaaaaagcttgcctgccttaggaccgggatccaatgtccagatcttatcaatggtaatcacgccggctcctttgggcacggggaacttgccttcagcccactttgccgcttgatcatagtaagggccgtccgtgtacagcttggcggtgccgccaaagcggaagcctttcaacgccttggcattagcgaccgcgacgattgctttcccattgtcgttaatgttggcttgggtctggccacctgtcatttcattgtaaataaggtgctcatcgtccaacacccgcattgagatcttaggcccaacatccgggttgccatctgcatcaacggttgaaatataggacaactcaccagcaatcatgtctttcatcgcttgattcaattttgccactatgacacatcccctattcatttcagtacagccattttaaggccatgaaaggtttcaagcaattattgtgtctcgatggatgccatgttcatatagatgaatacagttgaatataacgattcaatcaaacttctagtgcagaggcatgattcaatctgcggaatgtttatgctttttcttccgttgtccgaaccagtaatcaactatcagacttccaaacgcgccagcaacaaagacccaccatcgaaatgggcctctcacccagattgaaataataaacgccagtaacattgcaacgccaaacgttaagaagaaactccgccagtattccatgcctttcccccgttcatcggtttgccgccttagagatcagaatttgaaagctgatgatgccacgccctgcaaatagacgacatgaatgttctgcgttaccgagtctatcaataattgttacttaatctgccgcgtcagttcttctggcgttagcattcgggtttggcgaaaaatacgataagcatcttccggaggcaaaaccggtaattgattcaaccaatagacaatgatatccaagacaccctgacttacaatttcctgcgcataatcactcggcacctgttttgattgttcaactgagtcccctgcgccttggcgtaaaaccgccacaatcaattgtttgaccttggtgaccagttgcgtgccaccttcatttaagagcaaggctgccaactcgcgctggtgataaagatatttaaacaactggaaaaacgcatcattttcatgagtcgtttttgaccggtcgttttgggtaaacggtttgggaaaacgttcgaagatgctgttgacatggctgacaatttcatcttcgtaatgattcagtaagtcatacttatcaaaatagtgcaggtaaaaagtgccgcgactgataccggcaagtttgaccaattgttgcacgctgatttttccaaaaccctcttgctgcaatagttgaataaacgccttttgaatcttaacctctgtttcaagcatctttgtatttgttgccacgctagctcgcctccattgacaggttgtcaatttccaacttcatttaacaataaatattaaatatttacaattgacaaattcgtctcaaatgttcatacaaacaatattgttctggtcacatttttagaagaacttgcccacaacaaagcgatttttgactgaacaaattcaccagattgtcgcttgcttgaggtctaataagcccctatgatcgctaatgaacaggatgtcaatttgaaaggcggtcataaaatgttaaaaagcgaatggcgctatctgtttcaacacaagatgatgctggttgtgttgattgcaattgcattaattccagcaatctactgttttatctacctgtcctcaatgtgggacacctatggcaaaatggacgacatcccagttgcaatcgttaatcacgatcaatctgtgacttatcacggcaaccacatcactatcggcaaaactttgacccaaaacttggataagtcaaactcgcttgactttcatcatgtttcagccaaaacagctgatcggcgattacggcaaggaaaatattacatggttttaacgatccccaagaatttctcgaaaatggcaaccacgattttgactgctaaaccccaaaaaatgaatctttatttttgctttaactccggacagaatttcattgtctccaaaatgacaaccggcgcggcaacggcaattaaggcaaaggtctcagcgcaggtcactaagctggatgcgactgttgttctaaacgcattgcaccaggcagctaaagggatgacgaaagcagcaaatggcagtcaagcgctggccagcggagcacaaaaattaacaacaggtgagtcgcaactactgacagggacgacagctttatctgcgggcgtcgataacctcgcggctggtaataccaagctcatcgccggcaacacaacgatgacaaacggattcaatcagttagaagatcacgccgcaactcttaccactggtcttgatcaaatccaaaacggtttaaatcagttggcacagaaatcacctgccttagcacaagggactatcaaactgaagcagttagctcaaaatatgcaaaaacagctagcatccggaaacactgaccaaaagcaacttgctgcagaatcttccgcacttacgagtggccttcaatccatgacaagtggttcgcaagcaattgacagcggcagctcaaagctagccacaggcgccgcaacgttgaacaatgggctaaccgtgtacacgaatggagttagtgcactcgcaactggtaatcaggcaattgcccagggacttgcaactgtacaaaccaatcttcctgctttgcaatccggcactgaaaaactgaatacggcgtgtcgtccttgttgagtggctcacagcaacttggtcaaggcagccaaacacttgcagagagcctcaccgccgcagttcaaaaactaagcgtcattcatacgaaggcaggaaatgcatcggctttagcaacaccagtccatgaagtcacaagtgatattgccaaaatcccaaacaatggtactggcatggcgccatttgcgattgcaattggcctttatgttggtggcatcgcactaggaaccatgtacgaaggcttcctaccacacaaaaagcctcgccatgcattgacctggtgggctagtaaggcatcggttgtcggatcagttggcttattacaagcaatcctgctttattggacattgacttcaggcaatcatttacatgtcacttcgcaaggcgcgtttttcggaacgattttgcttggatcagttctgtttctatcgcttattttctgtcttcgtttgctactgggcggttttggcacctggctggtttctattgttctagtcttgcagttggccggctccggtggcttatatccgacttatttagtcaacagttttgctaaagccatcaatgcttggttgccaatgacttatctaatcgatgctttgagaagtctgatttcaacccaccaagccatcacgactaacatttgggttatgatagccctcatcgttggctttaatcttgcgatgattcttcgcttccagatcggactccatcaaagctttattgaaattgaaactgccgccgaagataactgaagaaggtgtcgaatcatgttaaaaaacatcaaacccatcagtatctcgaacttgattacaaaagctagtcatcaacgaatcgagacttcgcgaagagtcctttttctaaatttaattgtctatatcctgattgccggggccgagttagcgatcggtacagccgatcattcaaccgcattgattgccgacggtcaaaacaacctaacaggtattgtgtccgtaacggctttaatcgtaggcttaaccttttcaaaaaggccttccgatggttttcatcttgaaggtcactggcagtttgaaagtctggctgtttttctagccgggctcgggatgttcttagtgggtctcgtctgtgtctggaaaggcatcacgcagacgttcggttttttggctggccactacacggcgccacttaaaggccaggcagcttatatggcagccatttccggtgtcacaatgctatcgctatgtgcgtttaatcattttatcgctcgcaaaactcaaagcagttccttagcagcatctgccagggattttctaagcgacgcgctcacctccactggcaccatgttggcgattatcggtgcatccttgtttcgcattcactggatcgatccagttgcagcactgtttctgggattctttatcatctggaatggatgccagattctcagcacaagcgccgaaaagctatctaatggcttcagtcccaagctgcgcacagacatcatcgacaaaatactcactgtcagtggtgtaatggatgttacttttgttgatggccgctattcaggcaataatattattatcgaagcagaaatcactttagctaatgatgacagcctgaccaagtcttaccgcgtttgcaagagcattgagcagatcctgcaagcttcttttccggtcctttactgctgtattcaggtcaaacccgctcccaaaagtgccagcgcacagcctcaagcgattatctggaagccattctagttcgatcaccgatttctgacaaagagtctaatcttcatcttcttcgcaaaagtttccggacaccgccagcaggattagggtcatcgccttgatatcttggtatcaaatgtatatggcagtgcatcaccgtttggccggcatattgcccaacgttagtcccgatattgtagccatcgggatgaaattgccgatcaatcagcttcttaccggcatgaataaggtcattaacggctagcaattcctcttggctgagttcaaagtagtcttgccgatgcgcccgtggaatgataagtaggtgacctcgactcacaggatgaatatcccaaaaagcaatcgccaaattgttcttgaggactaccttagacttaggaagctggcaaaagatacaatcggtgtgctgcatgatgacttcccctctcaaacaccctgaaaaaaaaataagcacaaggcacccacagcatgatgctgccagttgccttgtgcttattatttattaaaccggactaagcttcaatcttatctttattcgaatcggcaatgtaatgcggaatctcggtgtcgataaagtaaactttgtaccaaaccaagaaggtgtaaatggtccagactttccgccggtcgtcacgttctttgcgatacgtcttgtcgagaatgtccagaatcgcatcctgatcgaagaattccttgacccaatcctgttcaaaggttttgcgcacttctttgtagaatggttcgtcttcaagccattgcttgaccggaaccgggaagccgagcttttcccggctggcccattcttctggcaagtggcggttggccgcttcgcgcagcgcgtatttggagttatgggagttgatcagatacttggtcgggatacctgcggcgactttggcgacttctttatccaagaacggtacccgcaattccatcgagtttgccatcgagagcttgtcagccttcaacagaatatctttcggcatgaactgatggatatccaggtactgcatctttttcacttcatcgtcgtagtggcgaaccttcttgtaggattcggtgacaatgtcgcggacgctcttactttgccggaattcaggttgcagaatctcatcagcttgaccttcgtggaacacgagtgcttcgccgatgaagaattcttcagccggggctgtggattcatacaaatgcaggcggccgtggaagttaggcattttcttcaagccatgggcgattcgatacttcacgccacgcggcaacttccgcaaaccatccgcaaacacgcggatcgcgtggctacgggtgtggaacccgtagttggcgtaaccggcaaacagttcgtcagcaccttcgccagacaggataacggtgacgtctttatgcgccatccgcgtcaggaagtaaagcggcacgcaggatggattggaatccggctcgtccagatgatattggataagcgggaagttgtcgagcgcttctttttccgtcacgatatcgctggtgttgtctaagccgagtttgtcgctcaactctttggctgccgttccttcgtgatatttcttgttgtcaaaaccaatcgagaaagtatgctccggccgcaacagcgcggtgatatacgaagagtcaacgccggatgaaagcaaggatccgacttcaacatcagaaattcggtgcgcttcaaccgattcggagacactcttgtcaatcgcagccacggtctcgtcgaaactgagatgattggccttgaagtccatatcccagtacttcttgatcgtgagcttgttatccttcaacgtgaagtaatgaccttccggaatgcgatagacacccttgaagaacgtctcgtccaaagcggaatattggaaggtcaaatacggcttcaacgcttctttgtttaattgctttttaaacttaggatgcttcaaaaatgccttgatttcactgccaacgatgaacgtatcgccatcgtgatagtaatacattggcttgatgccaaagaagtcgcgggcaccgaacatttcttttttattgtcatcccaaatcaggaaggcaaacatgccgcgaatcttcttgagtaattcttccatgccatattcttcataaccatggagtagaacttcagtgtcactgtgggtcttaaatacatgtccggcagcgatcaaatctttgcgaatgctttggaagttatagatttcaccattgaagataatagcaaccgtgccatcttcgtttagaatcggttgtgagccaccctttaaatcaatgatggacaaccggcggaaccctaaggcgacatcatcattgatatattcaccgctagagtttggaccccggtgcttgatcatatccatcatgccattaataactggctttttgtttaaaattgtcttgtccgcaaacgcgatgattccgcacatacagttaaccccttttcacgtgaatgaccatcattacttgtttcagtataaagatttggcggcgcaagtcaattgaagcgcgccggtaaaagggagcctgagcgacatcggcagatcggcttaatcgggacatatggacaactgctgactggtaattgcgggcgcaaacaaaattcaaatctttcagacaatgtgatggcagtttctgaaaattaagaaaaaggcaaaaaaatagagatccagattcctacaggtgaacctggatctcctaagttaaggatttgaccgatgcagcagttttgttacatttactggtgctaattgtaaaaccctcttcaataaatctaatactgcgacacctctacaaaaaacttattcacttgtacggaacgacgagtgttgaaatgatgttgccagataacttggcgttgtttggtggtcctatgacacacccgattgaacatctatgggaagctcattgtcccgcttggattactgagtctgtttataagcctcatacctccatgtgtgttcatctttggatcttgtggaacatgaatcttacgataagtggcgcagatacttactgcaccagtgctctattcgcttttctcgtgctttgcgacacacactttcgagccggttcgtctttgtgctgctagacaaaggatcgtgattctcggttcctgcatcgacctttggttcttccttaacttcaaatacagtgtaccatgtaagcgttatcttgacaaccaaaatggccagatttttcggcaaaaatttctaaagatttagtaaacgaaccggcggacacggctcgctgctccatagccataaagactcagcagacgccgctgtacatcaacactgacaacatacccggcatattcgctcggcgtcccaaagcgccggtcataacggcgattgaatttagtggtgagcccatgatgccgtcccatcaaggcactggtattctgcaggctataatggatgccattcacttgataatcagcttccagatggtagtgtcccgccagataagcaatgattttgccagttgtttgggtaaaatcaaagcataactgcccgccgaactcaggcgttttgcctgtgtttagcaagccactggcatgtaaattgaacgcccgtagcaactcgtgcaccgcgcggccgttgaacttcaacgctggctgtccattttgcttcatggctggcgcatggctcatgactaagacatcgcggttttgagccccttttagcgctaagacaaaatcccgcaactgtgcaaacgagacggctaatgtctttttgacgtcataaattttacgtccgtcatgcaaaggcacgtctgccgtatttaaaacaatgatgcgcagtccgggaaagtcttgcacaagcaaaccttcacgcgaaaccgcaacatggcgttgggttgcgtcggccgcaaaaatcaactgctgcgccacatccggcaaaaagctgccacgatgacccggctgcttttcggcaaacttgtcattgtcatcgtgattgcctttggtgaccagaaatggcacttggccgcggcgataatcagccataatattgcgcagccgcaattttgtcagccacggcgattccgacccatcaaccaaatcgcctaagtgaacccgcagtgcaagcggtaactgggtactcagccacccttgttcccgcacgtgccaataaccggttggcccataataagtggtcgcaaatttagccttgtcgtgcgtatcagtgatcaaagcaaaattcaccgctgatgccggtaataatggcgccactgcgttaataaagcgaccgagatcctttttaacaaatggacgaatcgtgatactcatgacggcctcccctcaagaaccgagtgtgagcttcaaatatttaaaaagacacctaatgccaagaagatgacttgggccaaggtcgttacaaataaattcttgatcgcattgggaaaagtcaattttttcactggattagcagcaaagccccgcgcatttttaatcacaaatggaatggttatcaaggtgagtaacgtcagcttcggcaatagaccaagcagcaccgacgcaatgagcatcaggaaacccaccgtgtacaaaccatagaaaaaaatgatactgcgatcgagaccgagataatgcacgatcgttcgacgtttgagtgtctcgtcttcttcccgatccgcaatattgtttgccagtagcagcgccgaaatcgcacactgggccaaaccgctggccagataaaccgacaaaatcaacggccatgaaaagtccgcgacattaaagacattgacataaaccgcgatcagaaaaattacaaagcccatcgtaaacccggagaaaaactcgccataaggtgtcgccgaaatcggccgcggcccaccagcatagccgtaaccgaccgcaaagctaaacaaccccatcaccagcagcggccaaccggtacgactaaccatccacaaacccagaacggcgctggtggccatcatagcgaccaccatccagccaatcatgctaggatttaaatgatgcaccccgatgatgttggtcttttcgcgaaaatgcagtgcttccgtccgctccgatcgccgataatcctgataattgtcattagcatcgactgacatgttgaacaaaagcatcgcaacaaagaagaccagcaactctggaatatgtaacgtatgatagtgataccaggcatacaacgtccccaaaagaaaaggaaacaccgatgccgttttcgccttaatctcaaccaactcaagaaatacagataatgacataacccaacctccaataattgacttttaagaatcaggtacagtagagtaaatatgtctttaaggaaagagagaaaatgcatgattcatcccctgtggcaccgattccccacggtctatcaccaactcgaacaaatccaacaacgactggagcaggtcgccgttttgcgcgagccgcaagtacacaccctcattcagcaacaaatcaacgctggcggcaaaatgttacgcagcgggctaatgcttatgctagcgcgtttcggccaacctgacaacggtgatcttgtgacagctggtgcggcaattgaggcactgcatctggctacccttgtccatgatgatgttttggaccatgccgacattcgccggggcatggccaccgtctctgctgaatccggcaatcgcgaagccatctatgccggcgactttttgtttgccatttattttcagctgctcagcgaacaaaatccggaagttgtcgatcttggcgccaatgcccgcattatgaagcgcattttcatgggcgaagtggatcaaaatgggccaagcgcgccgttgattcccaccattgatgcataccttagtgccatcgctggcaaaaccgccgccttatttgctttagcgacttatacaggcgctgtcatcggccatctgtcacttgagcaaaaaaaggccgcctatcgttttggccgccaactcggcatggcttttcagatgatcgatgatttactggattacacgcagacaagctcaacgctcaacaaaccggcacttgaagacctacataatggtatcgtcacgctgccattaatctacgcttaccagatcgtcccggatcaactggcgccgctaacccaagatgccacccacattgcggccaacgcagagaaaatcgccgcgatcgtgcgcatccacggcttgccgcaagcccaacaaatggcagctacttatactaatcgcgccgttgcggcactggcgcctttcccgacatcagccactaaatcggcgctggtcaaactgactcagcaaatgttgaagcggagccattagtcgttgcgactgcggcatctcgccgagcaccgcacaccatattcaaattttcaaaaagcattaagtcttctttggctgcgttgtgcttttggatcgcccatgccaacattgatacctagccaattttaaaaattgaccattaaaacagaaaatgagctgtaacccgccacggttgagagacactttttggcgggttacagctcattgtttagtctttttaaacatgtgatatggaacgaagatgtatttaaaaaaccaaatttgcgtaatatttcacaaacataacacccgttcagtggtatgatactgatatagcaatcgtgaaagagtgatcaaacatggtaaaaatcctctctatcaatgccggcagctcgtcccttaaatggaaactgtttgacatgccaagtgaacgccaacttgcagaaggcgcgactgatattttacgaaactctactgttaaaattaagtatggcactgatcaggtgtacgaaagcacaacccctatccataattaccgggaggcagttgcaaacacgctgtccgaccttcaatcgcttggcctcgtgcatcaccttaatgaaattaccggcatcggtcatcgagttgtggctggcggcgaactcttttccgcgccaattgtaatcgataaccgggtgctggcgcagattcgggccttgcgcgattatgcgccgctgcataacccagtcgaagcggactgcatcgagattttccgcaccatgatgccgtgggcgcttgaagtggccgtttttgacacagccttccatcaaaccatgaaacccgttaattatctctacagcatcccctatgaatattaccaaaagttcggcgtccgtaaatacggtgcgcacggcaccagtgttcgctatgtcagtgcccatgcagccaaaatgcttggcaagccgcttgaatcaatgcgcatgattgtcatgcaccttggcgccggctcgagcattaccgccattcaaaatggaaaatccatcgacacgtcaatgggcttcactccggtctccggcgtcacaatgggtacacgctccggcgacgttgatgtttcgctgatcgcctacctgatgaaaaaattggccattcccgatgttgatcaaatgattgacattctgaatacccagtctggcctgcgtggcatttccggcattagccatgacgtgcgcgatcttgaagaagcggcgccacaacatccccgtgccaaacttgcactggatattttcgtcaatcgcattgtgaaatatgtcggtgcctatgccgctttgatggacggcgttgatacgctggtcttcactgccggcattggcgaacacagcagtgccgttcgcgctcgggtcatgcaatcactcgactacctcggcgcccgcattgacctgcaacgcaatgagcaaacctgtcatcaggctggcgacatcacggcgccaggcgcgcgagttaaaacgctggtcattccgactaatgaagaactgatgatcgtccgtgatgttatgtcactatcgcatgcggcacagcaagctgaatagtgattcaaggcctctactaaccaagtgtcaatgattttcgcctaaatgaacctgtccccaaaagttgagtctcggcttttggggatatttttgtataaaaaccaataagagcttgcattttatcagcccactgcctatactgtgcatatcatacatatacagtatagacacattaaaggagatgcgcgccatgctcaatgtcacgaacttaaccaaacattttggcaaaacgacggccgttcgcaacgtttcattgtccgttcgcccaggggaaattctgggtctgatcggtcaaaacggtgccggcaaaacaaccacttttcgaatgctgctaaatttattgcagccagatagcggcacggtgacctggcaagatcggccactgacacagctcagccgggaaatgatcggctatctccctgaggaacgcgggctttatccgaaaatgacagtggctgatcagattagcttcttcgccgaactgcatggcatgaaacgtactgaagcaatggctagcctcgatcagtggcttgaacagtttcaggtcaagggaaaaccgaccgatctcatcaaagatctgtctaaggggaatcagcaaaaggtccaactcattgctgccatgatccacatgccaaagttcatcattttagacgaaccattctcaggattggatcccgtgaatgctagcttactcgaagccgggattcggcggctgcgggatgccggcagtgccattatttattcaagtcatgatatgggcaacgtcgaggcaatatccgatcagctagtcatgttaaaaaatggtgaagtcgtcttatccggcaaacttgacgccattcgcgaacaatttggccaaacccggctacacatccaatcacccctgacgcagcaagaacttcaagcattcccgggcgttgtgtctgtcaccccgcaatcgcgcggcttcttggtgaaactcaatgatccgcaagttggccgggatattttcgccgctgcaacccatcaaggttacattccagagtttagccaacaagcaccttctctagacgaaattttccgcatgaaagtcgaggcctaagccatgaaaaaaatggatgttattttccgtcaagttttcttcaagaatctcaaaagtaaaacctggctctggatcgttcttggtccgctagttctggcagcagtttttggcggcgttttctggcttatgaaccaaaccaaccaaacgacccgtatcggcgtggtaacgtccagtcctgcgctgacacagacttttaaagccaacagcaatgacgatcaaaaatacatcagttacaagacccccagcgcggccaaaagtgccttagccgctgaaaaacttgacggggtgttaaccatcaccagccatccggccttggaagccagcctaatgaaacggacagacggggaaagtatcgatcgtacccagttgcagtcgatcctcgcccaggcacataccaaggaagtcgcgacgcagctgaacctaacgccttcccagttgcagcagctttttgccacaccgaaattcaccactaacaatgtcacgattgacaacggtaaattggtgacacgctcggctaaaagccaagcgtcaggctcggcagccggattcattgtcggtctcttgatttatacgttcgtgatcagctacgcctccatgatggcccaggaaatcggcactgaaaaaggctcgcgaattgaagagtcgattttaacggccattaccccgcaagcacaatttttcggtaagttgctgggaatcttgacgttaatggcaactcaaatcgcaatttacgcagtggtgggactcgccggcatggtcgtcttgcgccagttgccttcaaacccgctgtcttcactcatcggtcaaatgaacctaagtagcattactccgaacatgctgattttcagtcttgccttcttctttgtgggcacgctgacgtataccgtattagctgcactcaccggctcgctggtcgcgaatcaggaacaaatcggccaggcaacaacgccaattgtgatgcttggcatggtcggttacttcggtgccttaattgttagttccggcacctcacctatccttaatatcgccagctatgtcccgttcctttccaccatgatgatgccggtacgccttggcgcgggtcaagtcagtgcgctcgccgcatggtcggcattcggcattaatctgatctttttaatcatcttcacttggctgacggtcaagctttatcagacgaatgtgttaagctattcagatggcggcattttaaaagcgttcaagcgctcgctgcaattgcaacggaccgcccgcaaaaataatccgatcaagtcatgaaacgaggtcagccatgcggatcgtcatctcaaatcaatcgggcaagccgatctatgagcaaatcgaagatcaggttaaagccgcgatcctttctggtcagttaaaagtcaatgagcagctgccatccattcgcagccttgcacgggatttgcgtatcagcgtcatcaccaccacacgggcttatcacgaacttgaggcagccggctttatcaccaatgtccaaggaaaaggtgcttatgtattagggcaagacagtgcgctggttcgggaaaatgccctacgagatattgaagcttcactcaatcaggcaattgatactgccaacatggcgcatattgcccccagcgagctacacaccatgctggataccttattacaagcggaggagaccgatcatgggcgctgatttacttaccgtcacaaatctgaacaaacaatatgcagaatttcagctggccgatgttagctttcagcttcctgccggctatatcatggggttcatcggtcccaatggtgcggggaaaacaacgaccatcaaagccattctggatatggttcgtccggataccggacagattgatttgcttggtcagacaacaccgcaaggccgagaatccgttcgggatcaaatcgggattgttttagacggtccggtttatcctgactcatggcgcgcagaaaccgtgagccggtatgtcggtcctttctttcccagctgggatccagacaagtttaaggaactcctccaagattttgcgatccctaccaaacccaaatatcatgatttatccacgggtgccaaaatcaaactccaactagcggcagccttcgctcatcatcctcgcttactgatcctggatgagccgacttcggggctggatccgattgcccgcgatgaattaattggcattttgcaggatttcattagcgatgggcaacgaagtgtactgatctcgacccacgatgtccttgaacttgcaaaggtagcggactatgtcacttatttattagcgggtaaagtcacgtttaccggttcactagacgaactcctcgaccggtatgtcatgatcaaaggcgggcctaatgacttaacaccggccattcaagctaatattatcggctttcaacgcagcgtggtcggttttgctggtatctggcctaccgatcaaactgctgtcctgcctgccagcatcattcaggaaccggttgacttggagtccttgatgattgcctttggtaaaggaggtcggccgcatgcatgatctggtcaaacttgtctgcttagatttaagctcgttgtatggcagcaagcgtctatatttttgggctacgcttaattcaatcgttatttatttcataatctttttgaatggcaacctagccatgccatttgctggcggaaccattggcgccagtatcggcattttgatgatgccatttgtcgttgccgatcgtcatggtctcgaaaaggtatataccatgttgccggttcgacgtcaaaccattgtcgctagtcattatttgtttggtttgattatgatggtattgattgatctttccaacatactaacaattggcattggcctatttgcacgatccaatcccgtgcgtgattttcaagatgttgggtggttgatgctaatcggaactgcttttattatcttgcagatcaccttgtcatttccgatgatgattggcatgggatttcagcgcgcgccacttgcggcgtatcttccgatggtgtttgtcttagtcgttgccgtttttctcgataaaagcttaaatttcactttagacagtttgcgtccttggcttggcttaatagcactcgcgctcattttgttattcgcactttcctggtggttaagtatccaattgtatcaaaaaagggaattctaacggctaagtcagttaggaaatacgtccagaggtaccgagatctcgagttttaccttgagaccccggtacttttttgttgtgtgccaagtcaagatatgggacaaaaattcgcacacttgcgcttaaaaaaccggaaaatgagtcaaaaagacattatgagaatggttcaccattcgtgcacaagtgtcttctcaagattaaaaataaaacctatcgatgcccaccgctttctttcattcaataaatcacaatgttaccgacttttgagatttctgttttctttgttttaaatgccattatattgccgtctcattttgcttctttgattagcggttccgtcaccttgagttaaatttgttctctcagcaatcatcatccttggtttttcagttgaatatccaccattaattcggccaatctgcttcccactggctgtttttttattggcaccttctagcattccaattaagtgattcatgagattctccgcggaaattcgtaagcgctaacatttattttgtgagagttgtcacatagctgttgttttggtagctgtgaagtatttaacatatgagtgtaagagaaaggaaggatcatcatgcgtgttggggttgttaaggaacaaaaggctggcgaaggtcgtgttgctgtaacgcctgccaatgtgaagaaattgactgcggccggcgcagaggtttgggttgagcatgctgcggggatcggagccggattttcggatgcggattatgaagccgctggcggtaagctggttagccatgcggccagctgggatgccgacctagtggttaaggtaaaagaaccggatgctgaagaatatcagtatttcaagtccggtcaggtgatttggggttttcagcacttagcatctgcgccggaaaccgtccacgccatgcaagctgctggtgtcacggcaattggcggcgagacgattgtcaaagatggtgagctggctttgctaaagccgatgagtgcgattgccgggcggcgttcggtgatcatgggggcctattatcttgaagcgcaacatggtggcgaaggtattttgctccctggcacaccagaagtagcgcctggcaatgtcgtcatttttggcggcggcacggcagcgttcaatgcagctaccctagcattggctatgggttgccacgtcaccattatcgaattaaatccagagcggcgcacatggcttgagcaaaaatttgcggggcaagacctgactgtattggcttccacaccggaaaaccttgccgctgcgattaaaacggctgatgtgttcatttcgacgattttgatcccaggggctaaaccgccgaagcttgtgacaacagcgatggttcagtccatgaaaccgggcagcgtcttggttgatgttgccattgaccaaggtggcacggtcgaaaccattgacgcgccgacaacaattgaatcacctgtgtttaccaaatacggcgtcatccattacgctgttccgaatcagcctggtgcggtgccacgaactgcaacgctggcgctggcaagtggaaatatcccttacctactggcgattgctactcaaggcattgaccaagcaattgcggcagatcctgccttggcatccggcgtcaatctttaccatggcaagatcacgaatcagagtcttgccaactcgttgtcactacctttcacaccgttgacagaagtactggtcagaaattaggaggtggttttgatgctaaccatgaccccacccgtcacgataaaagatattcgggaagcaagtcagctgattcacaaggtcggccgcgtgacgccactgattcaatccatgtttctcagtcgcaccgtcacgcatggcgatgtttatctcaaacttgagaatatgcagctgaccggttcattcaagtttcgcggcgcctacaacaagatccaccacctcaccgatagcgaaaagcagcgaggcgtcatcactgccagcgccggtaatcatgcccaaggtgtcgcattgactgcacatttattgggaattaacgccaccgtcgtgatgccggagaccgcaccactcgccaagcaacaagcaaccagcggctatggagcccgcgtgatcctggctggtcaaacgtttgatgaagcgcgcgcgtttatggaaaaaaaggcggccgctgatggcctcacgattgtcgatccttacaacgatccgctcgtcattgctggccaaggctcaattggcctcgagctgttggaacaactgccaaccatcgatactgtcattgtgccagttggtggcggcggtttaatctccggcatcgccgtggcgctcaagcatgtcaatccgcaaattcacattatcggagtgcaatccgaaaacgttcacggcatgactgcctccttgcaggccggacacctgacacggcaatgcgccggctcgacattggctgatggaactgccgtggcaatgcctggtgacatcacctttggcctcgctagcgaccttgtcgacgagatggtattggtttcggaagaggaaattgccgaagccatgaaggatctcctgcaacgcgctaaaaccgttgccgaaggagctggcgcgttgccaaccgcggcgctcgaagcccacaaaatcgctgccaaatggctcaccgacaagcaagttgtcgctttggtatcaggcggcaatgttgatttggaacgggtcgcccaaaatatcgaacatttctttgaccatgatccaaccggccattttgtcggttaatgtttttatcaaggtgcctgctagcgtctgtcaaaaattagcctcgaactgaacgaacatcttttcatcacggctaatgtgcaattgttgcggcaccagaatatgcgttaattgggggtaacacaatggaaaagacgatctcgaagcgaaccgcggccaagacgaaatatgtgccgtatgccacggaacgcacacaggaaaatagcggcggaagtacggctattttcatcatcggtgccgttttggcgaccatctttgccgcttctacggcttattcaggcatgaaggctggcttgaccgttgccgccggaattcccgggtcgattatcggatcagggttggtcggcgttttcgctaagaaaaaaggactttttggcaagaacctgctgcaagggatgagttccggcggtgagtcgattgctagcgggatgatttatgtcttgccagccattatcatcattggcggccgggtcaacttttttgccggcattgttgtcggtgcgctggcggttttattcgcagtcggcatggccagccttgtcgagaattatttgttagttgaagaagacggtaaactcatgtatccggaatcgactgccatttccgaagcgctggatgccagtgaagccggtggcgatgcgctgaagcatatgggcatcggttttggcatcggcggcgtgatcacgttgctcaccacgcaggttttcgggtgggtcaacagtgtgatgacgtttgtgggtagtgcatcctaccgctggaaaatttcgaccgaagtcaatccgatgttggccggcattggttttgttgttggcttggacgtgtccttgaccatgtttgccggttcgatactggctaactttggcatcacgccattaattgcttacttcacgcaaatggctggcggccacgcccatgtctggaatgacgcccacatgttgatgtcacagatgaacatcgataccgtggccggttcctataccaagtacatcggcgccgggatgatgctctgcggcggtattatcggcgccatcaagttaattccggtcatcgtaacgtccatcaagaaaacgctcaatgcccgtaataacagtggcgaagaaaagaactcacttggcatcatggcacttttggttgctacaattgcgatcttcatagtcggtgcttttctgaccggcaacatggtgatcaccatcttggccggtatcatgtccctcgtcttggccctgttgtttgtcattgtttcagcccggctcgccggcacgatcggctgctcgaatgccccggtttccggcatgacgatcgccagtctggttgtcatgacgctggtgtttgcgctaatgggctggacgtccaacacccacaacgagattctcctgttgttcggcgttttcattgtcaccgcgatttctgtcggcggtgcctatatgcaaacccaaaaagtcaattaccttgtcggcggtcggcgctccgaaatgatgaagtattttctgctcgccgcacttatcggtgtcgtcgttgttgtcggcaccacggtgattctctccccgcaactagccgttaaaagtgccgatccgccattcggtctgccacaagcgaacctcattgccacgctgaccaccggcattttatccagtaacctgccgtggatcatgatcattgtcggcatcatcatggcgcttgtctgctggatgctgaatctgccgatcatgaccgttgccttaggattctatctaccgatttcaacgacttcgattattctggtcggtgcgttgttaaagcttttcatccaaaaaaccacgcaaaacaagaaacttcgcgaaacgcgcctatccgctggagtctcactttctagcggcctgattgccggcggttccatcattggcttgatcggcatcattttacacgtcaccggtgtcttgcaaaaccgggttcctgctggttttgccggcagcaacgccatggccgtcgtgttactcatcatcatggcagcagcgattattgtgccattgatggccatcaaacaccctgccgccaagaagcaggccgagtaggaggcgtttagacaatgacacagactgacatgctcaccaccgtcatttatcggaaaaattcccaggtgcagtacaccaaaaagaatggaaaggttaccattatccgtccgcaaaaccacgctattcagcgattttgtcggaaagtgctgcatatgaaaattcccgaagtcagctacctgcatcttgatgcttatggcagcttcgtttttagcaaaatcaatggccgccgaaccgctgccatgattggcaaagaactggctcagaagttcccggaagccgacgatcagcgtgacgcgcggttagccctttatctcaatcaaatcgctgaaaaggatcatttaattcaacggctggatcaccacccaaactttctataacgcgttccccggcgcaaaagcctgcgtataaggatcttggtcgcgatggcctaagcccgggccatctcgcccaaggccacttacactccgacttctaaccgcgccggctcacactcacattaacgcgttccccagcgcaaaagcctgcgtataaggaccttggtcgcgatggcctaagcccgggccatcacgcccaaggccacttatactccggcttctaaccgcgccggctcacactcactcaaaagatggaggaaataaaatgattgatcgaatcgaaatgtctgcttgtacttcaatgatggtcggcaaaaaagcttcacttgacggtgccacttatatctcccgcaacgaagatcggcttgttgccatctatcccaagcgtttcatcgtccagccagccgtcactggacgcaaagaaacttatgtctcaccatacaatcagctgacagttcctctgccggaaaccggctatcgctacaccgcaacgccggatgccgaccaaagtgccgggccaaacgaagaagacggctttaacgagaaaaatgtcggcgaaagtgccaccgaaagtgtttatgccaatgaacgcgttcttgcctatgatccctttgtcaaaaatggcttggctgaggactccatgacgaccctggttttgccttttatcaacagtgcacgtgaaggcgtccggtatctcggcgaactcgtgaaacaatatggctcagctgaaggtaacggcgtgcagtttaacgatcaaaatgaagtctggtacatggaaatcgtgaccggccatcaatgggtcgccgtccacatccccgatgattgttatgcggttgcggctaaccaagttgcgattcaaacgattgacttcaacgaccctgacaactacatgtgggcagacggcatccaggattttgttgatcgccataacttgaatcctgatgatgatcaatggaacttccgccacatcttcggcaccgataccgagaaagatcatcactacaacacgccgcgggtttggttcgcccaacgctacctcaatcccgaaactatccaagatccggaatcgccggagttgccttttatccgcaaagccaaccgcaagatttcgattgaagatattcaatatgtgctcaagtcacacttcaatgaaacccagttcgacccattaggaagcgacagcgaacatgaccgcaaaacatatcgcgccatttcgctatcccgcaccgccaactctcacattctacaaatgcgcccggccgatcagcaccccgctgccggtgtccagtgggtcggctttggcatccccgccttctgtccgcacgttcccttcttcaccgatgccaatgacaccgatgaaagttaccgcgaactaccggccaaaatggatctcaacgctgcatactggctttacgaagcgctagcgatggtcgtcgagtcccactacgccgactttatcgaagacgacttagcctaccaaaaagagctcaatgaatgggcccgccgcaaaatcgccgaagtcgatgacgccaccgccaaaatgagcggctcggatctaacccaatatctcaccgagcaaaaccatctgattgcgcaacattacaacgacgccacccgcgagttgttgtttaaactcatcacgatgggaaccggcttatcgaaactgacattcaaaatggatccgaatctctagcgctgtgtcctgcgcttaagttgcgatccagtatactgaaaaccgaaaatatgatctgttgcgaccaaaagtctgaaacataattaacagccacattataaaagtgagcatactcccaaaaatgatagacggagagtatgctcactttgttttctctagaataattcgttggcgttattacgatacgagtgccaaggcggagcaatcgtaggccagagggggttcagtggtgcccacccctctagcttcgcggtcgccagccccgacctggccggagattgcggagtttggcacggaacagaacccgttgcctaaattttcccaaaccgttcggaattaaaaaccaagtcaacaaagttatgactcaactcgcgcttttttctcgaagtcaccgaatcttatgccatgctgctgcaccctcagccgggaaaatgtgcgccatttgccacatctgatcacggcttaaatggtagacaatcgccggcaataacgtgttgatcgcatcttcggcttgagcactgtactccgtggcgccgacaagatgatgttcctgatcgaacaccaaaaggctatcacccaccgtttcctgatcggtttgatgataccagtcatccggaatgtggttgtgcacgactttgtaagtatcatccttgaccgcttcaggtgccacaccgactttggcaattcttggcgaggtgtaaaccgttgacggaatcgccggataatcaatcggcgcagttgtttggccgctcagtaacttgtaaaggtaataggactcaaacgtggctgttggcgtcaatttgggttgtggcttgtctaaaacatcgcccgacgcataaatattggtcacgttcgttcgcagatagtcgtccacgggaataccgtgctggttaaactcaacgccgacattttctaaccccagttgctcaacattcgggattcggccggttgcgtccagcacccaatcgacaaccagctgctccttgtcaccatagtgaatcacaatgccatcatcggttttctcaagcgaagtcaccaccgcattcggcgtgaattgaatgccccgtttcgtcatgtcagccatcacatcttcgacaaatggctggtggaattcccgcaaagcacggtcatgatgcatcaatacgtggacatcggcgccggccgcattggcaatcgttgcaaattccatgctgatgtagcctgatcccaaaataccgatccgcttcggcaagacatccaagtccataaaggcccgactgtcatgcgctaattcagttcccggcacatcaaggcgatgcgggcgctggccagtcgcaatgacaattttgtctgcggtataagtcttttcacccacaacaatcgtatgtgcatcctgaaattttccatagccatggatgatcgttacgccgttttgggttaatcccgtaccgatagcatccggtaacggcttaatcacagcttgtttgtgagcgactaacgccgaccagttgatcttgatattgccagacacaacaccctgcatccgttccgccagccgttgcaaaaccaccggcgtatcaagcgtaattttcgcgttacagccataattcgggcaagtgccgccgatcatgtcgccttcaaccacagctactctttttcccgaagctgccaatgggccggccccgtcaaacgcgccatgcccactacctaagtacaagacatcaaaatcatatggattcttcaaactatcatcctccttatgacactgcctactaacaacgaagtaagcataacagatggtatacaaattagtcacggacaatgcttagcggcggaaacatttttgcaccacttctatatgacgctttctacaaaaagtccgcttgatagcaaaaaagttccggtaagaacgactgttttcgcaatcacttaccgaaactcattaacgtgcatttgtggaactaaagatcacggctcacttggggctttttaacttggaaggcaacgatcaggccaaccacggcaagaattaagacgaacgcgaaaccatagtgcgaaccgactgtcagtcctgattgtccggctgcttgagcggaacccaaggcgagcatgcttgtggcaaccgccgttgaaaccgcaccgacaatttgctgcaaggtgttcagcaaggcactgccgtctgcactttcggcgccgctcaaactgtttaagccatatgtctgcgccggtgacatcgcaagcggcgctccaatcatcaaggtcacatgtcccaaaatgatccaccacaacggactttgtgccccactattcagcaatatcaggatcccgagaatggcaatcacaaatccgccacgggctaaccacttcgcaccatgactgtcatacattcgtccggcaatcgccgacaccgcggcgttgacaatcccacctggcaacatcacgagaccggtcatcgcgactggcaagccaataacgcgctgcaggtacattggcaacaaatacatcgaagccagaatcacgccaaaatcaagcatgaccagtaaggtaccaaccgtaaactgcttattggcgaagacccgcaagttcaacattggtttttccaacgtcaactgtcgtcgggtataaaatgccaaaccggcaataccgatcagcagtgaaaccgctactgtgagcgataaccaacccgaatcactcgccatggttgtgccaacgacaatcccggcaaaaccgatcgatgaggcaacaatcgagatccagtcgaccggtgttttggtttggtgatagacattttccattgacgtcaacgtaaaaataaatgccaataccaagaacgggacgaatagccagaaaatatcatgccaggtgaacttggctaggatgagtccggtaatggtcgggccaattgcaggcgcaaacatgattaccaacgccgccaatcccattaccgtgcccagtttatacggcgggaaaatctgcatcgctaccgaaaacatcagcggcagaatcaagccggtcccaataccctgaatgaggcgaccgattaagacaacggcaaaactggcgcccatcgcggaaacaacggatccaagaataaaggcgcctaatgcaaataaaataattcttttcgtattaaaccatttggacaaaagactggaaatcggcatgcagatcccgatgaccagcatatacccagtgacgagccattgaatcgtgccttgtgagacgttcagcgccgtcatcagactaggtaaggcgatattaagcgatgtttctgaaaacatgccgacaaatgccccgatcatcagcccaatcatggccaaggccggatgcgcgatatgaacgcgtgcttgtggcattgcttttgtttgtgataattgcatgaataacttccttttctactttcgaatcaatcaacagttgacaggcatcttcaagacgtcagtgcctgtttaatcaggtaagacaggtgagccgcggtttgccgtaacaagtcaggattcgctttggtagtcgcgatcataatggtgccttcgatcgttgcctgaacgaattgtcccagttgccgcgccgggaccactgacatccccgctgaaaccagtttgtcggtatataaatcttcaagttgcgtataaaccgcactgcaagctgcttgcagtttcggatcatcgcgtgtttctagtgcgatcaggctgattgaatggctgctgagccgaccatgctgttgcatctcctccgccatttccgccagctgtccggtcaaggcaatttccggcgccgcatcccgttcaagcgcttgtttaacccgcaccaaaatttgcgcacccgcatactcaatggcggcttcaatcagctgcactttgccttctgggaaataataataaagtgatcctttcggggtcccactgacggccagaatttttgataatcccgtcgccctgaccccttcttcctgaaaaagatctgcagccgtcgcgactaacttttcacgtgtgttcatcgtcaacctccaaattataacaaccggtctatataatactgctattttctggaaaaagtcaattttatttttggaaacatgaaaatcaatcatgcgttgcatcttccaccatctgctgttcaccggtgtagaagccgcgagcgctaacgaaaaaagccgcccattgaatgagcagcttaacgcaatcagcaccggtttatttgaaaagacatcattttttcccagccactgccaaccaagcctctttaatccccgaaagtacaagcgtaggaatcgccggcagcacagtgactagcaaatattgttgccaggtcagcatttgggtacccatcaccacgttgaaaaacggtaaagtagtgaccaacagcgaactcaccgccgcaaaactcaccgccgcaagcaacttaatattgctaaatggattgcgtcgatataacgtcgtcgtgctccgggcatcaaagacgtgccataattggccaaacaccagtgtcaggaacgcgatcgtctgggctgcagcagctggtaaaccggcactggccgcccagataaacgcaacatacaccgtgccacccatgacggttccgcgaacgaagatgcggcccaccatgccttttaagattgaagcactggtatcacgcggtttttgcttcatctggtctgcctgtggtttgtcatacgctaaagcaaagcttggcaacgcgtccgaaatcatgttcacccacaaaaccatgagtgcggtcagcgttggtgtggttacgctgacgtgaccaatgggaccggtcatcaagatgacgcctagcagtaacgccagcacttccgcaacgttggtcgtcaattcatggcgcatgaagttcttaatgtttccgaagatcgtccggccagctgccactgacttttcgatggtagtgaatttatcatcgagcaaaatcaaatcagccgcgtctttggtgacctcagtgccattgatgcccatagcgatgccaatatctgcggcccgcaacgccggtgcatcattgatcccgtcaccggtcatagcaaccacttggccgcgccgttgcaaggctttaacgatccgtagcttgtgctctggggacacgcgcgcataaacccgcgcttccaagaccacatcatctaactctgcatcaggcagtttgtctaacatggcaccttcaataacttgggcatcttttttctgaacaattcccagtttataggcaatggcacgcgcagttgctgcgtggtcgccggtaatcatgacgacattcaccccagccgcgtgtaatgtctggatcgaacgcttcacttccgggcgtggcggatcaatgatgccggcgatcccaagcagtgtcagatgttgctccagctcggccgtctcaccgtgcaacgccagcgattcatcaatagcccgttccgtgattgcaatggttcgcaacgcatcattggcaaagtccagaatcactttttccatcgtcgcccgcgcgtctgcaattggcaccagctgatcatgatccaccacctggtccgttttccgcaaaataacatccggcgcacctttggttaatactttgaattgaccattttctttaatgacaacgctcatcattttccgcgttgaatcaaacggcaatacccgtaaaatgtcaatgtcgcgttggtcggttttttccagtatagttgcccggtcaatgccaccttttgcgccagctacgaccaacgccacgtcggtcggattgccaaacggctggaagcgaccatcttcgtcttgcgtgacattagcttcgttgtttaacaccgctgcctgcaaaaaccgctcaactgcaggggtgtcctgttcatttaccggcaaaaagtcaccggttgtgtcgtatccattgccttcaacttcataatgcgcgccgttagcaaaaaagcgcgtcaccgtcatttcgtttttcgtcagggtgccggttttatctgacgcaatataattcgtggcgcctaaggtttcaaccgagttcagtgacttaatcaagccttgattcttggccaacttggtcgcaccaatggttaaaacaatcgacaaaacggcgggcaaagcatcaggtattgccgccacggcaagggcaatcgcggtggacagtgacgctgccagtatttcaaaggagaggttaccggtttgctgataagctttaaacaaggccaatcctaatgtcaggaaaacaatcccgatcgcaacgatcatcagctttttgctcaagctgtgaacgacgcgctcgatcggcgtcttttgcgtttgcacgtcattcattaacttggcgattttgccgagttcggtttccatccccgtagcaaccacaacgccatatccgtttccggcagttatcatcgaaccggaaaaacccatgttagtctgatcgcctaattcgactttttcggtcaaggcatgggactgcttgctcaccggttctgcttcgccggttaagtgcgcctcagatgtttgcaggttcgccacccgcagccaccgcacatcggcttccaaaaagtcaccggtctgcacccgaacgatatcgcctggtaccagctccgcaaccggcacatcttcccaaacttcatcgcgcaacacccgcgcctgatgatcggccatattccgtagcgcatccatcgactttttcgccgattgcgcctgccagtagcccaagccggaattaacgccgataagaattaagatcgcaatactttcataaatcgccgccatcccatgactacgattaccggttacaaaaaaatcatacgccgcactcaacaatgccaagccgactgcaacaaataaaataatgacaaggggttccttgagggtcagcaaaaattggcgccaggccgggatcgtcggtgctgctttcaatgcgttcgggccgaactttgccagtctcgcctcagcctctgcgctggttaagccatgtgtccgattcgttgtcagtgcggtcaaaacttcttctttgtgctttaaataaactttgttcatggtcatccctttcttgatataagttctcgaattcggttggcggcgcttttttgagcacgccataacgcgctcctcggcccagaaaccgggctggctcacgctcacgaaaaaagagcgtacgcctcaacgccctttcttccccaggaaaggcatcttgaagcatacgctcaaccgattcgttgctattcactatagctaatattaaaacataacaccgttaaccttgtcaagttggactcaggcaccctaacgccagccgtcaattaggaatctaaatcagctccgtttgacacaatcacctgccgataccagtcgaaggatttcttcttggaacgtttaagcgttccttggccggcatcgtcgagatcgacataaatgaaaccataacgtttcgacatctggccggttgacgcgctgaccaaatcgatgcatccccatggcgtatagcccatcacatcaacgccatcatgaatggctgcaccgatctgttcgatgtgctgctttagatagtcaatccggtaatcatcgttaatctcgccgtttgcatccggctggtctactgccccgaggccattttcaacgatgaacagcggcttgcgataacgatcgtataactgatttaaggcaatgcgtaagccggtcgggtcgatctgccagccccattcgctcgcatccagaaaaggattcttaatgccgcttaacaagttcccgccgacctcagcatgatccttctgaaccgtttcaacaacagcagacatgtaataactgaagccaatataatcaactggatgctgcttcaacattgccaactcggcagccgaaaagtccagatccgttaacttaatgccatattgatccagcaacgcatccgtgtaggctggatactcgccgcgcacctgaacatcgccgcagaagaaattgaacgcttgattttgttgcagcgtcgccagctgattgaccggattcgcgtcatagctgtaagtggtggcgtataacaacatacaaccgatctgaagatcctgattcaactggtgcccgattctgaccgcctcggctccagccacaaattgattgtgccaggcttggaaaatgttgcgcttatcggccgcaccgttactggtcaccaagccttggctcatcactggaaatgccagcgcactgttaatttcgttaaaagtcatccagtacttaacctgtttgaaataccgggtcaagacggtttcggcaaatcgcttgtaaaagccgataagctgcttattcttccaaccaccgtacttggtaactaggtgcagtggcatctcgtaatgggaaatcgtgataatcggttcaatcccatatttcaagcactctgcaatcaccgcatcatagaacgccaggccagccatgttaggtgtcttttcatcaccttctggaaagattcgtgaccaggcaatcgaaaagcgataacatttaaagcccatttcactaaacagcttgatgtcttctttaaaatggtggtaatgatcgatcccccgatgattcgggtaccgatagttgctttcatcgatggtccaatcaaaatccggctcattcaccagatcaaaccgtgcttttccttggggcaggacatcagcaatcgataatcccttgccgtcttcaagataggcgccttccagctgattggccgcggttgcaccgccccacataaattgtttggggaaattcaaataagtcatggttaaatgttcatcctttctaagctagcgtcattaacgcatcgtctgcggttgccccgtccgcccgagtttcaacctgataacggtcggaattcgtcacaatcatcatcacggtcggtgcatagcccgcagctttaatcgcttgatagtcaaattctaccagtggcgtgccgacatccaccttctgtccttgtttaatcaagggtttgaaatacttgccttttagattcactgtgtcgataccaatgtgaatcagaatctctgcgcctttttcagacgtgatcccaatagcgtgcgcggttggatacaccagactgatcgtccctgcgattggtgccttgaccaagttgtcttctggttcaatcgcgatgccttgccccatggtgcccgaggaaaaaacttcatctggcacttcactgagcggcaccaaggttcctttaaccggtgctgtcaacgtttctgcatgatccgctgcgatctgagttgcttgcggcttgtcttctttaacaccggcgttaattccgccaaacaccaaggtaagcgcaacgccgaggacgaatgccacaatatcgccgatcaccgaaattccgaaccctttaccgatataagtcggcaacgataagatgctggccaatgatgccacattcgagccggcgccggacatggccacaataatcccgccaactgcccccgcgacacatgcgcaataaaatggctttttcagttttaaggtgatcccgtaaatagtcggttccgtgacgccgaaaagtgccgtaatcgtgcttgaaccagccaggcttttcattttagcgtcacgggttttaagaaacaccgcaaacgccgcaccagcctgcgctaaaactgcaggcaaaagaatcggcatcatcggatccgtcccatactgggcaatgttgttcatcatgaccggcaccaacgcccagtgaacgccgaaaatcacaaacacctgccagaagccgccaagaaccatccccgctaaagccggtacactcttgttcagcgacacaattgcggtggccagaccattactgagaatggagctaaccggtccaaccaccaacatggtcagcggcacaatgatcactaacaagcataacggtgccaaaatgttccgaaccgactgatgccaaattttattgaaaaatggttccagaaacttctgaaccacgacgaccagcaaaatcggcaagaccgttgccgtgtaattagccgccaccaccggaataccaaagaaatcaatactcggtttgccaacgagtccgacgatgttgggataaaccatcgcggcagcaattgccatcgccacaaatggattcaccttcagatgtttcgcggccgtaaaggctaatgcgatcggtaaaaagtagaaaatgccgtccgccgctgcccaccaaatctgataggcgccgcttttggtcgttaaccagccaaccgccacggccagagatagtaagccttttagaatcccggcaccggccatcgctcccaaaaatggtgtgaaaacgccggaaataaaggtcaataagccattgaaagcgcgtttgaatgtcattttctccttcggctggtcattggccgcctgcgcactgtcacctaaactcggttcaagtttaataattgcctgataaacatcacttacgttattgccaataaccacttgatactggccgcttgcttccacgaccgtgatgaccccgtccaacgcctcgactttctgtttggccgcggtcgccttttgcggatccttcaatgtgaaacgcagccgcgtcgcacagtgccaaacctgttcaatattctgcttgccgccaaccaactgcaacagttgcttcgccagtgttgattctcccatttttctttcctccagactttgggcaataaaaaaaccagaaagacgaaacctagggtgtgcctaagtcaagtctttctggttttgcctaattcaatagtaacaagccagatggtactgtattcgctttcaataaccacatcttatctgattcattagccgtcgtcaactactttttaaattttgtccgtgactggcagctaaccgagaaatgtgcagcgttaaataaatctgctcgtttttggaaacaggtacgttgaccttctgctcgataaactgaacaacatcctccatacactgataagcctgcacataatcctcttgcaaatgtgcaaatagggcatggtcgtaagtcgcttcctgcttatctgtgtgcgcgtaaacccgttgaaggaaaaacttgagatggatcgccagtcgctggtactccggcgttttggtgttcatgtccagtcctaagcgatagaaaattattttcgtaacattcgccagcatctgcgtaaacgccagcgaatcaaccggctgctgatgattgagatcgttgctgacaaacttcagagcgatgaaaccggcctcatcttccggtaacgcttcacctaactgctcagccaccgcttccaacgcccacttgcccattcgatattcctgctcataggccatctgaatttcccacaacagtcggttatgcaataataaattgtcatgcaaccgcatcaccgcaaaatgcagatgatcagccaattcaatcagcaaataactgttaaatgttgtctgcaactgaacttctgcctcttgcacaatccgcgccgccagcgtcaaatactcgctcggtaagctggcaatcgtttccgccgcgattttcaacttggtttggtcttccggaacatacaccttcatgctgtcccgcaatgtcagtgtctccccttttttggcatgaaacccgataccgcgttcaacgataatcgtctcacgctgctcatgccgaaccacaacggcattattgttcagaatcgtttcaatgatcatcgcaagccctcctcgtatatttaaattacaaccaagttcttggatagctccgtacttggatgttgcgtgatattctctagttgttcattggatttg

SEQ ID NO: 322 - DNA, 84638 bp, Lactobacillus casei
aatccctgggctgggggaagtataccctctgaaaaatgaaacaagtctagataatttgaatcactcccttgacttcagaccacaagtctccaagacggtcagaccatttgctgatccgtgttcaaattcaggctatcaatctttggggaaaatgacaacggaaatgttttcgcgcgctctttttatcgaaaaatagcaacctaaagtgccgacaaattactcttcttccacaacctgccgattactgaagcgataaatccgatccgcgtaggctgctgattctgcgcggtgtgaaatcaaaatgacgatgccgtgataataggctttgatcgtatccagaatcagccgctcgttttcagtgtcgagattgctggtgggttcatctaacaccaagacgctgcttgaatgcagcaaggcgcgggccaattcgagccgttgctgttcgccactggaaaaaggcacatgtccggcagcaatctgcgtatccaggccatttgcaagctgttttaaccggtcacttagtttaacttgcgccaataccgtccaaatttgatcatccgtaatcgtcggatcatgtaacgtcagattatcacggaccgtttcggagaaaaatatcgcggtctgcggcaaataattaatttgtgcccgcagcgattggggattgatggttgcaagatccgtgccattgaccaaaatctgaccgctcgtgaccggataccaacccatgatcaatttagctaacgtacttttgcccgacccactggcacctacaaaaccggtgatctcgccagcctttaaggtcagcgtcacgtcgtttaaaacctcttcgggacgcgctggataactaaatgaaacctgcttcacctgaatctgcttaatcgcatcgactgtctgacttgcagttgcgggcgctgccattaacggctgctcctgcagtaagttgaatagatttttagccgccgcaaacccgttaagtaacgacccgggaagattgtttagtgcgagcaacgggccgaacgtcagcgggaagactgcaagaaccgcttgttgcaaggcggttgcctgctgccagccgcttatccagaccatgaccaaccacgttgcgaccatgacgaacgttgcagcgacattttttaataattgactgaattgggcttgttgaaacgcggcggcttcgcggtcaaagccgacattgccttgatccatgcgttcttttgcaatgcccagctggcgcactgcccccatcccgcggaccgattctagtaagtactgttggttggccgccttcagctgatcagccgcctgagttttagcggtcaattgctgatgccgcgcatacggaatcagcccgcccacggccacataaccgaccagcgcgaccactgccgccaaaatactgacacgactataaactgccgtcattaaaaggccatatgttaacccgattgcgactggcacaatggtatgggcataaaaaatttccatcgcttcgatatcactgccaattaacttgagcaacttgccgctcgattgcgtatccagttttgctggggccaagcgcaccagttgctgataaacggcgccgcgcaggtcagccagtacatgaaaagccacaaaatgtccggcatattgctcgccgaaacttccgagacctaagagaataaccgcgatgacgcccggcaacaataattctgttgcatgttgcggatcaaacagcatcatcgccgcaagaatcaagacaacggccttggccagttcggcgaccatgccaatcaagaaactaatcacaatggcgccagtcaaatgatgagtgtactttaataaccctctgatcatcagcgtgcaccctctttctgcatcgtctccggattatccaccaagcgccgatacgccggctgatcttggtaaagctgcgcgtgattggcgacaattaagtgatgatcatgaataaaccacaccacatcagcttgcgccattgcagcaaggtcgtgggaaatgaacaaaacaattttctcttggctcaacttcttaacggccgccaaaatcgccgcagcgttgactttatcaatactggacgtaatttcatctaacaggtaaacggtcttgtccgccagtaacatccgcgcaaacgctaactgttgccgctgccccggcgaaagcagccgaccgccttcgcccacctgtgtgtcgtaccctttttccagcttagggacaaactgcatcagccccaaatcatcaagtttctgttgccaagtgtcgccaactcgatttcctaacaacagattttcctgaacggtgccggaaaaaaggtattcatctgccgtgacgtacccaaatactgctgctttttgcgcgttgctcaacgcagtgacggccgtattgtcagccataatcgttccggataaaggttccaagcggcctaaaatggcttgaatgagcgtactcttaccggtgccattttcccctgccaagccgtataacttgcccggttccagcgtggcatcgattgccgtcacaagtggtttatccggcgcataaccgatcgtcacctgatcaagcgcgatttgtttgagcgggcggttatcggtaatccgaaccgtcgccggcgtcgctttggccttggcaattgttccgaggatcgccgccagtgacggaccgtttgatttgacaacatgcacgaaatagccgagttgccgggcattgaccatcatcatggccaatgtaaaccaggtagcgaatgcaccggcagctggtaactggccgccaatcaattgaagagcagtcacaaaaccgccaacgaacacagttaggtaaacaaaaccattgatgacaaacagcacctgcaactgggttttcaacagattcatcgtggcctggcgaaaatattcgctatcatccgcaaatttttgtccgtaatggtcggcagcattgtacatcactaaagtattcatcccgcgcaggtcgttgataaagcgtccgcccatttttaagaagccagccagatgggtcttattctgcgccgacatttgcttgccgagaaacatcatcgcaaagccaatcaacaaaacacaggcaagcggcagcaaagctaaccatgaacgataccaaatcgacagcgcgatcaacaacaggtaagtcatcatcgcctgcaaggaagtgggaaacaacgtgctataaaacatatccaaattgttaagtccgcccaaatcacgctgaatcaccgcattgtctgcaccggttgcggcacttgcatcattgcgttggtaaagcgcctcgaaataacgatcacgcagctcacgcttggcactcatggcccagtcatgacggtgatgccgttcgtaaatcgtaatataaagaagccaaaatatccccactaccccggccaccacgattgcttccatcgcacgatttgccgccaattcaagcgcaatgatgaccggcaagactgtcggtaaccaatcaaaaattgcttcaataaccccagccccaagcttgtcacgtccgtatttcaataatccaagcattataaaggcttgcctcttttctttcaatcagtctgcagcattgtgactgccatccgtgtcgcaaacgatctgctgaacaacagattgtttttccagtttaccatgagaaaatcacatttaagcagctatttttgaaatgctgcactacatttagcagcttgtaaacgtttaagccaactgattaagggtgtaccagtccgccatcatcgccgctagtgcctttatttccttgcgccggcttgatttcgatcagcaatttatgcggtaggcagatgctttgctgcccaatttggctaatccagcccgtatgcaccgcaatctgatccggcgaattatcttccttgtcgcgaatgcgggtgccatcaacttcgatgacattgtactgcccttttgccggatacagcgtaaactgctggtggcccgcatgcgcatccagcttaatgcgccgtttaacatggccattaatcgaaataacggccactttttgatccgtattcacatgcgcttcggtcattgaaaaaatgcccagcggaatgaagcatgctatgaataatagaacgacaataacgtaatccaacggccgtacatatttttttaaccagcgcattttgtttcgcctcgaatcggtcttcaggttcttattgtacacgttaacgactgagaatatgctgaaaacagccgtacccccaaatcccgggatacggctgttttgtgctcataagtttagatgcattttttactgctatgaatcaccgcaaccccgcatccagcgcatacagattctgataccgctgattctgttcagccagatgctgcggcgtgtcgttcatcgtcaaccggccatcttctaggaaaacaacgcgatcagtttgactgacaccttgcagatgatgggtgacccatagaattgtctttccttttagaacggagaacatcgtatccagcagcgcctgttcggtaatcggatccaagccaacggtaggttcgtccaggagtacgatcggtgcatcctgtaaaagaatccgcgctaacgataaccgctgacgctcaccaccggaaaaggcaaagccggcttcttcgacactgctgtccataccattgggcagttgggcaatgagcttgtccagcttgacggctttcaacgccgcagcgacttcttcatcgctggcattttcattgcccaaacggacgttattaataatcgacgtgctgaacagaaatgggctctgatccagcaccgcgaatagattcgtacgattttgctgataagtcagtacgtcctgcccgtcaatcaaaacttgaccggttgtcggtgttaagtcacccaagaccagttgcaacaaggtcgttttccccattccgctaggaccgagaatcgccatcttttcgccggcgtgaacagttaaatcgatatcggtaatcaattcaggatcggttggcgtgtaacggaagctgacctgctttagctgaatggttttaaaactagtcggtactggttgctgtttgggtaatgcgcgcgtcactgggtgcagatcattgagatgccggatcgcatctcgataagtcggccactcaccgacgccctgggcaatcccagaaaaggcttgatcaagcgggaaaacaaccaggacgaaggcaccgacccagttggcacttgactgactgccagtccattcaaggttggtccaaattagcatactgatcgtaatcaacacgaacagtaactgaccgacaaagtcccgtccccactggaaccgtttggattttgcggtcgaggcagccagctttttcggtgctgccaagctttgatccaaaaactcctgaccgcgatgggtgatgacccaatcggataggccaagcaccgagtctgtcaatgatacataggcatcatggttcagctgcttttgctcagccttgcggaagcgttcaaccactagcccccaccaaggaagaatcaggatctggaacagcaataacaagcagatccataacgcaaagccccagttgaaccagcctaatagtaacgtggcaattacggtcaggccagcgccaaccacggtcggaaaaatcatccgcaaatagaggttctgaatgtggccgatgtcatctgccaataatcccaaaatatcaccggtctggtggtgttccgagacaaatgccgcatcggtttccagtactttgtataacttgcgccgcatatggctggtaatccgcagcacccagttgtgactggttaaacgttcaacatattggaagaccgggcgcccaaccccaaaggcacgggtcaggacaacagtcacataaatcgccgcaaataacggtttggtagcacttttatcaatcaaaaagcctgaggtgaacattaacgcgccggcaaacacgaacgtcatgaccccaagaaccagcgaccaaaacagcagccaccggtagcgttttagatcaggccggacccagtgttcatttttccaccaatgcattgaattcacctcgcatttcgtgtacaagtgcctgatatggcttagagtgggctgctaactcgctcggtgttccttcagcaacgatccgtccgccatcaaccacaatcacgcgatccatttggttgagccagtgcagtcggtgcgtggcgaagatgaccagccggtttttaaaaagcggcaccagtgtctctttcagctcggcttcggtttcaatatccaaatgggccgttggctcgtcaaatagccaaatcgaccggttggtatcaaccaatgtccgcgccaacgcaattcgctgggcctggccgccagagattccccggccaccttcaccgatgcgggtcgcataaccatccggcagcgtttcgatccagtgactcaaacctgccgccgctgctgcttgccgaacttcgtcatctgaagcactcggccgataaaagcgaatgttagccgcaatggtatccgcaaataaatacggatcctgaggaatataactcaaatgatcctgccaggcagcctgcgtcaaatgcggcaccttggttccccggacagtgatcgttgcggattgcggttgcaaaaagccgccaatcaaatttaacaatgtcgacttacctgagccgctggcaccaatgatagccactttttccggaccagtgaattgcagattggcgtcctgaatccctgcgcgtttatcgttgtacgtgaaatcaagatgctgcatgctcaaagtatcttgatcctgccagccatcaaactcaggcagcaccttagtatcagtcggcaacggctggtcgattactttccagatcgcggccatcgcatttttaccgtttaacgttgcgtggtaatccgtgccaaaatcgcgaatcggcatgaaatactccggcgccagaatcaacgccaccatcgctgggtataaaggaatgccgccgtccatcagcttgatgccaagaaaaaccgcaacaaccgcaatcgataacgtagtaaagaagtccaacgcaaaagttgacaacatggcgatgcgcaaaacgcccatggtctgcttccggtaatcttccgaaacttcataaacgttattggcgtactggcggctaatgcccatcaattgcagcgttttgagtccccgcagcgaatcaatgaaatggttgctcattttttgaaaaccggcatattgactttccgacttgtcacgggctgccagtcccaaaatcaccatgaacaggatgatgatcggaaacataatcagcagggtaaagccagtcaaccaattttcgtaccagatataagcgaccaaaacccacggaataatgctcatgttgaggattttgtttaagatcagttcgatataattttcggcttcgggaatgccgtcgagcgccatggtgaccagattaccggtaccttcttttgccactgccgctggtcctaatgcatacaagtgctttagcaattgttcttgcaaccacgcagatccgttcatggcgaagcgggcaccgatgcgattacgcacccacacaatgagctgccgcacggtaaatgccagtgcaaacagccccaaaggcatccataacccggctaaactttgacgattccaggaatggacgatcccttctgcaagaaactttccttgcaataaaataacaaaagcttgcacgagcgcaaacccggcaagcattgtcattgttttcctcattcccgataagcgcatgagcgtcttatcgatcattcactaaccgccccttttgcttgaatacgtttgtggaagacaacgtaactccagatgaagtagattaaggcaattggcaacaggataactgccacgatggtcatgatcgtcagggtcaaggagctggcactggcatcttttgcaagaatggacattgctgcatcctgcccgatcatcacacgtgggaataagccattgaagatgacgccaacgacgccaaccaatccaatcgcgcttccgacaaaggaaagcacttcattatccttcaataccccgatatgggcagcgacagttgagccgacaatcacaaccaaaatcagcaacgtgctgataggacgctccttgaagaagtcggtcatgaagaatagcagaactgcgaatacaacttcaccggcatatagcagataatacagcttgctattccaatcgcgcgcacgcttgcgtaaatcgccggttgtcttcaggcgaatgaaattcaacccgtgcatcaacatcatcaatgtcactgcgacaccaccaacgatagtcaaaagattaatctgattgcccaacgtcggataaacatcgccggccttggtaattggcagcggctggataatcgcagtgaaaatcatccctaagacaaacggcggaatcaagctgccgcaagccaacgcccagcgccagatattacgaccggttttggtctcggcgtgtgccgcaaattcaaaggacacaccacgaacaatcagcccgaacaaaacgatgaagaacatgatgtaaaagccggagaacaagcttgcgtaccacattggataagaagcaaacatcgcaccgccagcggtgatcagccaaacttcattaccatcccaatgcggcccgatcgttgccaccagctgatcttcttcgctcgtgttgcgagctaacagcttggttgacatgccaacgccaaaatcgaatccttcaagtacgaagaaaccgctgaacaggacgaacaataaaaagaaccataaaatctgtaaccagctcattttgcgaacgcctccttagctaacggatcgctgttgaccccataatcggtgttcaaatcgccttctggtcctttcttcaaaacgcggtgtgaatagtaaatcatgacaccgccgagtaaggtgaagatcaggaagtagcaaatgttggtgaacagcaattgaccggctgtcgtggttggcgaaaccgcatcggcgatcgtgtacaatccgtaaacaacccacggataacgacctaactcggtgatgaaccaaccagccgtgttaatgatgaatggcagccatagtgcaaagccgagaatgtatagcagccaacgttgattcaacaacgtatccttcttcttgcgaccgaaccaaagacctagaacacctagcaggaatagcagaacaccgccaccggccatgacccggaagctccagaacaaagtcttaaccggtacatagtagtctttgtctttaccatacttagcttgaagttccttgttagctgtctccatacctttaaccgaaccgttcattttgtggtaggacaacaggctcagcaaatatggcacttcaatattgccactcgtcgtgtgatctttggtattgatcaactcaaccaatgtccacggtgccggatcactggtatctttgtaaatcccttcggtagccgcaaacttcattggctgatctttgataatgaattgcgtctgcaaatcaccaaagccgatcgcgcacgcagaagcgatcgtgccgacaaccaaaccgactttaagtgacttcttataaaagtcgacctgatccttcttcaataaccgccaagcagccatgccggcaacggcaaacccggctgtggtaaaggcaccaaagataacatgcggaaattcaacccacaattgcggattggtaatcacggccccaaagtcaaccagcttgacccgacccgtggtttgactgatcgcaaagccagttgggtgctgcataaaggcattcgctgaaagaatccagattgccgataacgtggtacctaaccaagtcatccaaataaagatagcatgtacagctggcttgaagcgatcccaagtgaacatccacaaaccgatgaacgtcgattccataaagaatgccaacaaggcttcaatcgccagtggcaccccgaagatgtcccccatgaatcgtgaatagttcgaccaattcatgccgaactgaaattcttgaataatgccggtaacgacccctacggcaaagctgagcaagaagatcttgccccagaacttggccatcttcttatatgtctcattctttttgcgcacatatagtgtttccataatggcggtcacaaggcccataccaatggaaaacggtacgaaaaagaaatggaaaacggtcgtcatcgcaaactgaaaacgtgcaagcgataatacgtccattgccattagcatatgtttctcctccttcaatagattcattacaatctaagtataccccgatatttattttttaaaaaccaaaaacccaaaaaacaagatggaaatcatgcttctcacattttttcaaatcacaagggtgttatgatattggccgacacgcccgtccgcaaacgcttcccagacgttctgttttctatctttttcacgactgtagcaataatccatctgtttgtgaaaataaatgtcacgggcgaataatttcatgaatgagcggtgactttttcggcgctgaggggccaatgtgataggctttttggactagtccaacaatatcgacgacatctttcgtatccgcatgcaacatcacaagcgtatcgcctttcgacaccggagttcccagtttcttgtgcaaaaccaatccgactgccaaattcaagacatcatcttttttggcacggccaccaccgagctgcatcgctgccaggcccagcgcattggtgtcaatttgatcgacaacgccgctttgatctgcagtcacgggaatccgatacttggcttgcggcaattttcgcggatcatcgacgacagtgggatcgccgccttgtgcttgaattaattgcttaaacgcattcagagcgcgcccatcacgcaaggcgtcttcggctaaaccgctagcaatctccaaactgggagccttgccgcccagtaccaacatttgtgctgctaaagcaacggtcaaatcatgcacatcgcgtggcccgcgattttttagcaccgcaatggattcggcaatttccaggctatttccgatcgtaatacccaatggttgattcatgtcggtcaataaggcaacgcttttgacgccggcggtcttgctgatgctgactaaagccttggctaaagcgtgcgcatctttgatggttttcatgaatgcgccattgccgactttgacatcgaagaccaaggcattagtgccactggccagttttttgctcatgatggagccggcaataagtggtatcgattccacagtgcccgtcacatcacgcaacgcataaatccggcgatccgctggtgcaacttcgcggctggcgctgacaatcgcttcgtgaattgttcgcacctgctttttgaattgtgcttcagactcattcacgttgaaaccgggaatgctttcaagtttatccagcgtcccgcctgtatggccaagcccgcgaccggaaatcatcggcacgggaacccctaagcaggccaccaacggcgctagtggaatactgatcttgtcacccacgcccccagtgctatgtttgtcgactttaatgccaggaatgtcgcttaaatcaagcacgtcaccggaatgtagcattgcaaacgcaaaatggttgcgttcggcatccgtcatgccattgaagtaaaccgccatcaaaaaggcactcatctgatagtccggaatattgtccgcggtgtattgttcaatcatccaggtcagctcttcattcgtcagctcacctcgatcgcgtttcttcgtgatcaaatcgaccatgcgcatcttttatcacccttacctttattcgcttcctataactattgtaacgcgttggctgccgcctatgttaaactcgaatcattctaagttttacaaaggagaaaatgatggacttcgacacgctacatgctttaggtaaaacggaattgcactgccatcttgacggctcattatcgctaagctgcattcgccaactcgccaaaatgatcaatcgccctttgccggcctccgatgacgccttgcgccaactcgttcaggcgccggccgattctgaaaatctggctgattatctcaaaacttttgactttgttgcgccactgctccagaccaaaaaggctttacaactggcggcttttgatgtcgtcgcccaggcagcagaagaaaacgttcgctatatcgaaatcagatttgctccggcgttctcaatcagcggcggtttatctttaagtgacgcaaccgaagctgtcattgaaggcctgcaccaagccatgaccaaattcgacattgttgctaaagcgctcgtctgtggcatgcgccagttgcctaatgctgataatcaagccatgtttcgtgccaatgctgcgctgctaggtaacgggttggtcggcggcgattttgccggcaacgaggctgattttcccaccagcgtgtgcgcccccgccatcaaaactgcgcaaagactcggagttccgttgacttttcatgccggcgaatgccattgtccccaaaacattgccgaagccatcttccttggcattccgcgaatcggccacgccacagcctgctttgaccaaccagacctcattcaaaaaatcgtccaaacccacaccacgatcgaactgtgcctgaccagcaacctgcaaaccaaagcggctcggtcgctagatgagttcccatatcaagcgctcaaagctgccggtgccgctatcaccatcaacaccgacaaccgcactgtttccaatacgaccctgacccacgagtacgaactgtatcaaacctactttaaaaccaccgctgcagacttcttggccttcaatttaaacgccattaacgccgcgttcatttccgaaccggccaagcaagcattgcgcaatcgcttgcatcaggattatgcggcttatctgtgagttatgtgagttaacagggcctttgtgctaatagcgcaaattctgccagcctagtcctgaaagcccttaaccattacttaagggaaaagccacaacttcatcatcaattttccccagattcatcccggttgattcgtgatatcaccacatggtctggttatgctggttttatcaacaaatgaaaggatgattcttatgttgattgaccaaactgactttattgcaacccagttgcagcaaattgtttaccctaacattaacgccatcactgaaaccggcgttcccattacgattacaacgaataaaaaacagcgcgacgaccctgcattttggcaaagcatcagcgctatcttaagagcccatctttgggttccggtttcgaaaaaatatcatgagctaaccgaccacgattggctagcaacgcctgcgtagtcctaagactcgtgatcagcaaacgcgttggctgccagcacaagcgtgagaacagcatctggcgataacgccttgctgaccgtctcaatgtgcccgctggttgccactgctccgatgacttccagaccatacttcacgatgttgagatcgcgttgaggtgcataaccaccatcgaaaaccggttcgtggttatatgtaaaattcagttgatcgtccgtaatggaaccatcaacgtgattgaccataatgcgatcatgggtagccgtcagtggtgattggtcatccggcaaattcaatttatgatccgattcagttgtgtaatagtcgacttgtttcatgtgcaggtatttctcagccggctttttgagcactttcaaataatccacaatggcatataccttcgtgggatccagttgggtggttttggccatcagctcatcgttatgcgcttcaagccagtctgctaaattactaatactaaactgatccatactgtgcctccatcttcattgctgattcatacgccagtatagcatggacgcgccatctaatgtaggtgattgtcataaacctgtgacatttcaagttatataatggagtcgggagatgagcacgatgctaagcaatcaaaaaccgtatccgatcattgattatttaggccgccctatccgactgcaattatttgtcacgtaccgattacgcattaaaaatggctatatcctggcattacggcgtaaccaacaccaacaggcactgccgaatctcctagtcaaacacgcaagttaaagttgtcgactggcgatatcgattcgtccaatcgccttcagatcaaacgaccctagaggcaaaacaagtctctagggtcgtttacgttttagccgctgttgatcaccaactgactctcaaaccaaaatagttcattcatcgggtcgtttttccagcttaggtccacgtggtgtcacaattgccatcatggcaactgtcaaaataatcagcaccccgcccagcacttcggcaaaccctagatgcatatgcaggaaggctaccgatacaagtgttgcgcccaacggctcgaacgcatccagtaaggttgctgctgttggcgaaataaactgtaggctggcaaggtacaccgaataagcgataatcgttccgaaaatcacaataaaccagtaaccggcccagccagcggcatcaagatgcggtatttgtttccaaaagggatcaaacgcatcaaccaggaatccgcccaacaattgcgcccaggctgtcaccacaattggtgagtgccgttttaaaagtcctgccggcaataacgtatacgcggctgcagccaaggcggccatgatgccccaaaagaaagctgacggggaaatcgccaaatgtgtcagccggcctttagtcacaactagtgctgtccccagcatagccatgccaatcgtcagtaaatcaatccgacgcggtttttctcgcaatcgaagtgcaagaaaaaccaagaccacgaccggtgaaagatactgtaaaatcgttgcggttgcggcattcgccacggcaacggccttaaaataaatatactgcatgccgatcatgccaaataacacaaaaataatcagctgcaacgcatcacgccgattgcgccacggtgccatgatggccgaccgatctttccaaaaggccaccgccatcaacacaacaccggcaatcagcattttcgagctaattaaccaagacaccttgatgcctttatcaaacagggactcgcttaccgggccggaaataccccagaagctcgaccccataatggccagaaaaatcccccacaagcggatgcgtttcaacgcccttgccccttcttgcgctgattggatcagtcttccataacaacatgatcgtcaattaatcctgcgccttgcaaataattatacacgattaccgggccgacgaaggcaaagccgtgttttttcatatctttggcaatcttcaccgacagtgcgctcttagtcgggatctccgccagtgatttcggacggttaaccaatggcttaccatcaacgaacgcccacaaataatcatttaagctgccatactcggtctgaatttttaaaatggcgcgggcattggtaatcgtcgcctcgattttcatgcgattgcgaatgatgtcggtgcgttttaacaaggcatcaacatccggctcatccatcgctgccacttgtttaatatcaaaatgatggaaagcatcattgaaggcagcccgcttgcgtaacacgagttcccagtttaaccctgcctgaaaaatttccaacgataacaactcaaatagtttttgatcatcgtgaaccggcacgccccattcatgatcatgataagcgcgtaattccggtgacattttggcaacccaatccgtatagcgtttgcgctcctgatagcggcgcaatgctgcttccgttttagcctctgcagtccgatcgcttgtatctgccatttcaatgacctccaaatctttgctggttggttatagatacattacgccgcgatcttgaagaatgccagcagtcgccctcaggttattagatttatttgtaacgctttccgaaatatgatgtgcatcaaaaaaggcaagaaccggcgatgtaatatcaccgattcttacctgacaaaaagcttatttagttttaacgatcagcacatcgcatggtgcggtgcggttaacgtattcggttaccgaaccaaccagcacccgctcaactgcattcaatccggttgcgccaatgacgatcagatcgttgtggtggtcgtgtggaaagtcggtggcgatgaccgtcttgggattaccaaaacgaatatggatatcgatgtcggttaatcccgtactcttggcttgttccttcaaattctctaagtattcctgcgcatcttgcgtcagctgataaaccgcatcaccggatatcataccgccatagctgccgataaactgcttggtgtcaagcacattcaaaacatccaagtgggcttggttggccatcgcaactttaacagccttactgaaagctaactcggcttcctttgacccatctacgggtacaagtaagcgatcatattcttggtccattccgctcacatcctaactttcttattaacttaagcatagaacggtgaggaaacgaatacaagaaataaatttggtcttaacatggtaatcgatcaccataccatgtaaaatatacatcagtaccaaccttgaggcgtcaacgtggctggtcatggaaccgtcaatcaaaatttatttaaatatattttgattttgcggttcaatgattgatttaatacgtaatgatgctatattatagtgagtaagcttgtattcttaatttttaagaattcggcgtcacacaagaaaaaaagaagcgtggtgaaatttatgattacaaatggtgttggcagtgtcttgcggcaaatccgtaagagtcgtggcgaatcaattgttgaagttgccaaggcaacgcacacgtcccctgcaagctttaccaagtgggagaacgatcagacaattccaagcgaacgcagtattcgaaagcttgctgaatactatgatgtcgatccgcttgatttgttaggcgttgcatatcctgacaagtacgcgaaacaaaaagagcaggaaaaagcagctgcagagggttcgaccattcggattgaagatctgatcggtaataactccgttttgacctacaatggttccccgcttagttccggaaccaagtcccttgtggcagccttcattaccggtttaattatttctcaaccggaagaatagttgctttgcgttacactaggagtcgtctgcgggcggctctttttatctagtcattatgaaaacgcttcagcccgttgccggtcaccatcaatgtcgcgtatactagggtcaaacgttttcacgatggaggaattaaatttggcaccttatgttcttaatattaaacacggcttaaattttcgcgagcttggcgggtatcgaaccaaatccggccaggtgattaaatctcacaaaattatccgctcggcaaaactaagtgaattatctgatgaggatttggattatttggccgattatggactgatttccgacgtggactttcgctcgcccgaggaacaagcggccgagcccgatcgctatccgaacgtcgctgaataccacttcgtccctgtcttcccaaccgacgaaaccaaaagcagcgaacaggctgatgccctgcaaaagagtttctcccgcgatccgcacgctggtttcgagaatatggtcaaaacttacgccgatattgtcaaaatgccatccgcccaaaaagcctatcgtcaattcttcgatattctgttaagtaacgacagcgaaagcggcgctgtgctgttccactgcacagcaggtaaagaccgtaccggtatgggcgctgtttatttactatcggctttgggggtcgatggtcatacgattcggcaagattatttggcaaccaacgacctgattcagccgatggtcgaaaagaatcttgctgcggcacgcaaacgcggcgcaacggatgcgttgctcgctaacattcgtgacctaggtaccgtttcgggtgcctttctcgacagtgcactggcgaccatcgacgaagagtacggcggtatgaaaaattatctgcaagacgctctgcaactcacgccggcggaaaagcgcgacctccgggaactctatcttcagtaattagcgataaattcgtcacaatctgttcacatttttccgatatgttagcagcgtcgtgaaaaagcgatgttccgcctcctgttcttttaacgaaaaacgttgtccggcaatggttggatgacgtttttttgtgagcgcgagccagcgcggttagaagccggagtgtaagtggccccagaccacaatggctgggctttggccattgtggtctggggtccttacatgtaggcttctgcgctggcgagcgcgttatagaaagcggaagcaaaccctcaccaggccctcaattttacgagtggcaaagaatggtctttggccatcacgcccgaagcctttacacgcaggcttctgtgccagtaaccgcgttaaaaggcagcggagcgttctgcaattttgctttcccgccaccgtttcgctaaaataatgacatcatcaatgttaggaggttggcggcatggatcttaaggaaacgatcaaaagccacgcgaaggatttggggatcgataaaatcggctttaccacagccgatgattttgctgcgttaaaacccagtttactagctcaaaaagccgctggacatacaaccggattcgaacaccagaatctggatgaacggctgtatccagacaagatctttgaccagccgcagagtatcattgccatcgcgctggcttatccttctaagattcatgaccgcccaccacgcaccggtcctaaacgcggtcgctttgcacgggctagttggggtcttgattatcacaccgtgttggatcgcaagatggacgcattaatgcaatttatcaaagacacggctgcgacggatacaaccatccgcttcaagccgatggtcgacactggagaattaatcgatgtcgccgtagctcagcgtgcagggcttggttttatcggcaaaaacggcctgttaatcacgccggaattcggttcatacgtttatttaggcgaaatcatcacgaatattaaattcgcaccggatgaaccgatggcttgtcaatgtgggacgtgtacccgctgtattgacttttgtccgcccaaggcactgctaggcgatgggcggatgaacggtcagcggtgcctgtcttaccaaactcaaacaaagggttacatggatccggaatttcggccgatgattcgcaatgtcttgtacggctgtgatatctgccaacaggtctgcccgtttaataaaggaaaagattttcatatacatcccgaaatggaacctgatcccgacaccgtgatgccggaattaattcccatgctaacgctaagcaataaaggctttaagacccgcttcggtaaactggccggggcatggcgcgggaaaaagccgctgcagcgtaacgccatcattgcattagttaaccttcatgatcgcagtgctgttccgcacctacttgaggtcattgaaaacgacccccgccccatgatcagggcaacggccgcgtgggctattagcgaactggccgcggctcccacagctgaactcacgacatttttgaaaaatgcccaggctaaggaaaccaccgaagaagctcgcaccgagtttcaaaacgcaattgatcgaatcgtccaacgctgagcatgttataataaagtataaggatgagaggtgcccacattgaaattatatcaaggactgacacaggtgcaggtcaacgaagagatggccgatgatgcgccagacttcaacattacaaccgatctggttaaaccgttacactattcgccatcggaattgtaccgttatttagatgctgttctaaaacctggcagccgtcacgatcaaaataatcttaaatatgtcacggatgccgcgttcatcggcgaaaactttgatttcaattcggtacccttcacggccaaattgaaagattttgagtctaaaatggcatttgcccgaaatctcgtgagtgacctcaatcgccacgtttcggttaatattaatacaaaagatcatgcctttgaactgttgtttgttgattaaatgcaaaaaacgtagctccgttcaaaataaaaaagtaccctgattcgccaccatgcaattgacacggtggtaatcaaggtacttttttgtactagcttactttgaattcaacgcaggcatcacagccgttaattgttgaaccaccaaaacgctgagcgccattttaagcagatcacctggaatatagatcaaaacactcaaaagtgccggaacaaatgtcatattcgtcgtcgcagccaaccacgcggcgcccaacaattccgtcagcagcacgccgcccaacgtcatcccaagggctttggtcacccaagaatcttgcttaaggtaatgggtaatgccggcataggccagcggcgttagcaaccaaccatacatgaaaccggcagtcggccccatgaaaacagcgatgccgccacgcccaccagttaatacgggcaagccaagcgcagccaatgccagcaacatgccaattgtgaccgttgccgaccgtttcggtaacaacatggccaccaacatgacgcccatgttctgcaaaacaatcggcacacctagaaaaccaactgtgatcggtggcgcaaatgccaatccgattaagactgccaataatagccccatacgtgttagaatttttgtttgcatgaagtcaccattcccgttctatattttacttagaataccataccgtaacggcatgcagcatcaaaattcgttcagagcatgtctcttttgtgttctttttcaagaaaagctgttttttagctaaaataatccgtgctacttttcatcggccaatttgccttcataagccaatttctcgttttcatagctaagcatgtgatcttcaaagtgatcgatcttgtagtctaggtaccgaagtgtcttgttaatattgtcacgctgcgccattaaatgatcgcgctgttcaacgaataaagactttctggcagcaattgtctgatcgccttcacgtaaaagtttgacaaattcagaaagtgcttcaatcgacatccctgctttacgaagaatcatgatgtaataaacccaattgagcgcatgttcatcatattggcgatagccactttcgttacgcgcaatgtctggtaataaaccaatacgctcccaataacgtaacgtgtctttcgtcagattaaatttcttactaacctcatcaatcctcatcagctcactcaccttatttaatacgcctgccaacaatcttcatttgcgcctcagggtcacggtgatcgaagaactggctttccttcatgtctaatccggcaattttcccaatgtcatcgtcgttcaatttaaaatcgaaaatgttgaagttctcgatcatccgatttttatgaacggatttagggattgccacaataccacgttgagtcagccagcgtaaaatgacttgcccaactgacttgttgtacttggcgccaattgccgctaatgtcggatttttgaagatatcgtgcttcccctccgcaaagggtgcccatgcctctggttggatgtcgttgttttgcataaatttgacaggttcaagttgttgattccaaggattaacctcaatttgattcagtgccggcgtcacatcgttgaaaattgcaatatcagtcaattgatccggctcaaaattagacacaccaattgctcgaattttgccttctttatacaactcctccatggagcgccacgatccgtgaacgtctccccaaggttgatggattaaatacaagtcaagataatccagctgcagtcgatcgagcgagtcttgaaacgccttcttggttgccacgtatcccgtatcagtcaaccaaagcttggttataataaaaagatcctgacgatcaataccactacgtttgatcgctcggccaactgcttcttcattaccgtatgcttgagcagtgtcgatcaaccgataacctgattcaatcgcatccaaaactgcctgttcagcaacattgagatctgtaacctgaaagacgccaaagccgaggatcggcatatcgataccgttgtttaatttaactgtttccataaaagcttgctccttattttttggtaaaccggtggaaccgaactttcagtttctgtcaacgactctaatgttgactgatgttgtggacgtaccagataagttcagtccttttctactgtcatataacctgcgattcccaaatgatatacagaaaaatgtcatgcattccgatttggatgtttcactaggcatacttgaactcatcatcaataacttaaaaattgtaagaaatatcaatattcagacgctgttcttcaacaacacctttatgataaacctttgtctgaactccaaggcaacaatagttatcatattttctttcgagcgaacgccagtcttagtcagcttcaaaaaatagaacccatttcattaaatccggacccagtctgaacacaatcagcagtgataaatctttatgaaaatctgcaaaaaaatagctgtgaactttatatcgttcacagctcagtcctgcccaggctggattcgaaccagcgaccctttgattaacagtcaagcattctaccactgaactactgggcaattaacatgtctattatattctcatgtttcttagcagaatgcaatacttttgtttaacttttccgaacttttttcagtgtttccttagacaagctcccccgtcgtgttaaatcaggcctcgttaagttgttaactcgtcgctgacaacatgcaagatcaaccgacatcttgggtctttttcctctataatgaatgtgaagggttgtgaaactatggacacgccatatcctaatatgcaagataatcccaacatgccattcgaatcaggtgacgatcaaccggtgtggcaggcgctcgttaagaaaatgccgccagtaacggatctgcgtgtgcttgtgattcattgtggtgacggctggttttgccgctatgccttgaaccatggtgcggctgccgtactgggcattgataccgataccgccgccatccaaagtgcccgcgcagtggccagttccgatcggctgcgttatcgcatcatgcctgatcattggttgaaactgctgaccggaccttacgatctgattgtcggcgcgtttaaccaatcccctgccgagttgcgcactatcacccatgtacttagtcaattacttagcgctaaagggcagctcattgcagcagtggcgccgcctaaacagccaactggtgaccagcttgctgttgatgaactgattagttcccaactggtgattaatcggtggtttcaggtcaccgataaacggctgactcaaactgcgcaactttatttgctactgagttcccgtgtgcggtgacctttttgttaaaagtgtaaaaaccttcgctgacaaagatagcccatgaacgaacatataaacgcgttcactggcgcagaagcttgcgtgtaaggaccttggtcgcattggcccaagcccggaccatcacacccaaggccacttatactccgacttctaaccgcgccagttcacgctctggcttaaacgcgttctccggcgcagaagtctgcgtataaggaccttggtcgcgatggcctaaacccggaccatcacgcccaaggccacttatactccgacttctaaccgcgccagttcacgctctgcaaaaaaacgcactcgctgcttccctgtattgggaaactgcgagtgcgtttaattttgtttcatgttaaaggcgaatcgctttagccaacaacttcaactgtcgcagagagaatgcccgctgaaggaatctggttgtttggcatcgctacgtcaagctgacgtgggttgcctgctgcaaatgaacctgtgtcgttaacaacccggtctaacacctgaccatttgacatcgtgatgcgtaaatgggtgcctttagggaagacacttaagttggcggcaacaccaccataacctaagctgctacccataacagacggatcatagaaactgatcttgaaggtgccttggttgctagttgcttgttgttgggttgcctgttgaggttgagctgtctgaaccgctgtctgcgttgtctgaacggttgcctggctggcaggttgttgtgcctgctgttgttgagcggcagccttagatgcagcagcttgttgttgctggagcgcagcttgcgaagcagcggctgcttgttgtgcttgctgttgggcagcggccgattgctgggcttgttgctgagcagcggcttgtgaagcggcagcagcttgctgagcctgttgttgtgcttgttgctgggcagcggcctgagctgcacttgctgcggctgcgctggatgctgcagcgctttgagcagccgcgtccgatgaagcctgagcattattggaagttgactgagcggcctgttcagctggtgacgttgtctgtgtcggtgcggcgcttgcgtcagccttctgggttaacggtgccagttgctgcaaggtattgatgctcaagtagcgttctggaacccaaccatgatcggcagtttcataccaaatttctgaataaacttttttactattaacaaattgaagatgttcgccagttgtaacgtaacgttttgcttgttgtcccactgtcggtgaagtccaaacagttgttgcgccgccattataagtgacgtcggcttccgtcttatcactagctggtgcactgacggttgtcgattcagtatctttcgttgctgcgctaacgtgactaggtttggacaaagcaacggcggataaagcaacggctgagaataatactgtacttaagagctttttcatgttcgtaattcctcctgatttcatgtggtgacttaactaactgtggcttagtatagtcagtgagtattacgaacatgtattcgcggtgttgcggttacgttaagttctatgacaaaagattacattaggttacatccttaacattgtcaatctcaaaagcccgctgtgacgcgattctcatgtcagcggaacttcaaaaaatcttcgaggatacccttgatttttcgcgctaagtctaaataaattgcgttttttgcttatttttacccaaaaagttgctcaagtagcgcattaagaaccttgtgtccgggtgccaaaatggcttcattaaccgggccttgtggtttaccggcggccgcccccatcgctgtaatcatggtcggcgtcacttccagatgaaattgcaacccgacgatccgatcgtgatacttaaatccttgaagtgcctggtcattttcgtataatagttggctgcccggcagacggctcatcgcttccccatgccaatggaaaacgttaagcagcgtcccatcactggtcctgaccgtgccgattccttcttccggtttttccatcgggtagacgttggcaccaaaagccttggtgatctgctgagcccccaagcatatgccaaggactggccggttcagtttgttcaaactgcgaatcaagatccgttcggctgctagccaggccagatcgtcattgacgctcatggggccgccaagcacaatcaacccatcaatgtctgccggattcagttgcgcaatcggatccccttgatcagggcggtaagtgacagtttcaattgaatgcttatcggcccagtcttgaatgacccctaagccttcagcatccgcgtgttgcatgaccgtgagtttcatcggttaattcctttctttctttattcgtcttcaccttttaaagcagccgcaaatgacttaatcgttctcatctgcggatcgtaaattgcaaaataaacgcgtttgaatgcgccagcaaactccggtaacagcaacgccttccgaaaaacgccggcaactggcttgattggattaccaaaaacgccggtaccgaatgcgcccagaattaactgatcaacgtcatgcgccttaaacgcccgcagcgtctgtaaaaccttaaacgcaatgtcattcatagccgtcgcgtcatccagctgcggatcaacgcggcgatcaggtgccgcgacagtgacgatatcgacatatttttttggcaagcggcgtccctgatcgtcaaaaacctgccgtacgtgttccgcataaatgagctttgagctaaacaggccgcgattaggctgtttgcagttctgatcataataatccgccatgtgctgttccagcgccggcaccaaaaatgttcccttcgcaatcgcttcttcctgcgcccgcgcgccaaacgccacaccaccgcctggatgaaccggactggcaaagttcatcacgccgactttgccagtcaactcactcattagttgaaaaacatccacgttgcgaatcgcaatctgcggcatttccgtccctgttgccggtgtccgtggcagcggtttgctaatcagctgggtcttaggcatttccggctcggctttaaaaaccttcattgtttcccaatacattttgacttgttccatttcggcttctcccctcgaatcgcatactcgttgataccagcataacgcataatatagaagcaatcgatgaattatcgttcatttggctcattcaatgttaaaattaagtttgtaaagctacatgaaatgaggaatggaatacatggaaagtggccaaatcgtccccaatttattggtgatgcttgtcacctttttcttcgcagcgttttttgttgcctgtgaatttgcactggttcaaagtcgtccaagtgccttggaggaaatgatcgacaaaggtactgggcgcaaagcgaaaattgagcgcgccttgcgcatggttcacaacttaaatgagtatctgtcaacgacccaggttggtgtttcactggccggcatcattttagggtggatcggggaaaccaccgttgaattcttgctggttgatctgtttggcctgacccacttaagtttgccaaatggcagcctgcatgcggtcggcgctattttgggggttattattttaacctacctggaagtggtgctcaccgaaattgtcccgaagaacatttccattgattacccaattaaaactttaatgttggtggtgacgccgctacattacttccatatcttgttcttcccatttgtctggttgctgaacgtcagcgccaccggcattgtcaaaatgatgggcatgaagccagccgatgaaggtaatgaggctttctcacaagccgaaattctgaatctcagtaaaaatgctgttacttccggcgacatggaacaaaatgatgtcatttatatgcagcgggcatttgagctcaatgacaaaacggccaaagacatcatggttgaccgtaccagcctgtttgtgatcgatattaataccaccgttaaggaagccttgcgcgactatctaactcaaggctatagccggttcccggttgtggcaaacggtgacaaagataagattctggggtatgtctacatctatgatctcgtcaagcaagggcaagtcgatccatccgtgaaagtctccaagctgctgcgttcgattatcaatgtgcctgaagttaccccgattcacaatattttgacgcaaatgatcaagaaacaaacgccaattgttgtggtcgtcgatgaatacggtggcactagcggcatcgtcactgataaagatatttatgaagagctgtttggtacggttaaagatgaaatcgacgatgtctccgacgagtacattcggaaaaccgacgatcccaaagtctttcgggtcagcggcaagacgacactctgggactttgaacgtttcttccacactaatatcaaagcgttcacggattccgagatcatcaccattgccggctttatcatggaaacgcatcccgatctgaagttgcatgacaaagtcaaaatcgatcacttcaacttcaccgtcgctgatttctcccgaggcttcgccaactggtttgacgtcacccaggatccaaagccggtcaagcaaaccgttgctgaggaagttaaagaggcaaaagataagaagcaggattagttttcagcgttaagctcacaaattgcaactaacatgtgtttaaacagtctaatattcatgactaaagtgtaaaaaagaccaattgatcgtacattgcgatcaattggtctttttttcatgaacgattcttgtttgtatagggattgagatcttagtgccaaagcggagcaatcataggccagatggggctcagttgtgcccaccgctctagcttcgcgtcgccaccccagctggccggagattgcggagtttggcacgaccaaagtcactttccccagataaactgcaacatcgcgcggtcaaccgtcacattgtgttcatggagctggctgtgttgggcatgggggccagtgacttcaagtgtctgatacttggtgaggccacgaagcagatagcctaagctcaaggcggagttgacgctcacaacagtatcggtatccgtaccgtcttgaacattgccgtaaatattcaacaccgacttagcgcgaaaatgcgtgcggttcttcaatagccgcgcatactcaggccgaatcaggttcggccgcccgtctgctgccagctgcagctgatgtggctggtcattccaaccgagcaagccgtcatacgggccggcaatcgcaacgactttttccaattcaatcggcgtttgcgccatcgccgccgcaatgacagcataggcgcccatactgtggcccacggcgtttaatttcaccacgccatagcgctcatgcagcatcgtgaaaattttagccagccattgactgtctacttcctcgccagcggtgttgttttgaaaaatcacttgaataatcggcgcagcagtggtgtgtaacgtaccacgaacatctaactgacccgttggacttaccgtaatcaccatactgcgtttagctacccccgcagcttcggcgccttcaatcagctgattggttgaaaaagccgtgccccgataaccatgaacgaaaatggtcggtgtcgtgtccgcttccaccaattgcgtgcctggcgccagcccaacgagtaaaatcaccacaaccagcaataaccgtttaattaaacgcatataatcccccgccttgccaacgttcccgaacgcagcggcccgcataagcaaggaaaagaggaatcgtgacaccggcaatcaccagcacaagtatattaggatcaccgaacttctccaaaacatagccgaccgctttatgaccatacattaaaggtagtgtactacggccaatgcgatctaaccagtttcctgcaaaagttcctgacactattttggctccagcaaataaaccaccgcagatgatgactggcgcccatcccgccagaagtgggtcggttaagtgatgggatttcatataaagcaaaaagtcgatttggccacgcgactgggcagtaaacagcactgcgaaaaggccgacagcgaccaccacaaaccacggcttggtgacaatttgccgggcataatggaataaccaccagccgataaacatatacggcaaagcaaccagtactaaatcaaggttgcctggaatcggaaatcctaaagctgcctcagcgttaggataactgaaccctaaccagaaaagtccggccattaaaaccgcctcttgccagacttttggcatatagccacgtaatagactaaacagcaaactactgaaggcataaactgtcataaaccaaaagaccgacaaataaccattcaactcggtgccaccgtaaagcagccgtcgcagataatccaaggtaaatgcaggcgtgcgttgctcaaccacaaaattcagcaaaatcagccccacaccgtagccaaaatactgcttgaacattggccagaaccgccgcttcagataatctcttaaagtcggcaacgttgtcggcttgacgaagaaaccgccaatcataaagaacaatggcatatgccaccaatataagctttcataaaacgttgtattgcgcggatagaaatgccccaacacaactgcaatgattccgaggcctttggcaacatcaatccattcaatgcgttgatgcgtcgattggactttcacgttttgaaacgccccttccgtattcattaacttacttttaggctaacaagtcgcaacgatgtttttttgatacctttttaaagattttgtgaaggccattcacccaaacgtgctgttgacgtgctagactggattataacgtttttagaaaggacacgattttgttgacaccaactgatgttaatgggcatccatataatcgtttgctacttgtcatcaccctattgatcggcacgtttacgaccttcttaactcaaaccattctcaccacggcttatccgacactgatggctgattttcatattagcgccagcgcggttcagtggctgacaactggcttcatgttaattatgggtatcatgattccggtttccgcgtggctgttggacaaattcaacgtcaaacacctttatctgacggccatgaccattttcttcttaggttcgctgatttgctggcttgccggcgattttcagatgctgctggccggccgcctcatccaggcgattggtgtcggcatgtccatgcccaccttccagaccgtgatgttcaccatcttcctaccggaaaaacgcggcagcgccatgggcttagcgggcatcgtcattggcttggcgccggcaatcggtccgacgctttccggctggattttgctgcatcatacctggcgtgcgttattcgccgtcatcatgccgattgctgccggggttgtgttattggccacttacagcatgcggaaagttttgccgacgtcacatcccaagatcgacgtaccatcgattattgcttcgacgcttgggtttggcggcttattgtatggcttctcaacagtcggcgatgccggctggacggacacccaggttctgatcagtctcgcgattggcattatctttgtcgccttgttctgctggcgacaactgcatctcaaaacaccgctactggaattgcgagtctttaaatccaagaccttcacgttaagtgttattttgaccgcggtagccttcatgtcgatggtcggggttgaaatggtgctgccgatgtatattcagacaattcgtggcgaaagtgcctttcattccgggatgattttgttcccgggggcaattatgatggggatcatgagtccgatcaccggccggattttcgatcgaattggcgccaaacgtttggctgtcgctggcctgtttctgctggtcgtcggctccttgccgttgatgacgttaactgaaaccacgccgctgatttatatcacgacagtttataccgtgcgaatgttcaggatcaccatggtcaccatgccggtcacgactgcggggatgaatgccttaccgacgcatttaatcaaccacggaacggccgtgaacaacacgattcggcaagtggcggcatcgatcgggaccgcgatcctggtctctgttttgtcggtcgtcaccaagggcgcaacgccggcagctagcggcaaggcccttgatccgattgattacgccaacgcgctacatcaggctaccttggctggctatcgggcggcttttgccgtttcgttggtcatggcagcgctaggcttaatactgagcttcttcttgaaaaatgacgccatggatcggagggacgcctcatgattatcttattgttgatcatcggtgccatcgcctttttctgggctgtcgtgttaatgaaacccagtcggcagcggccattagccatcattgtcagtggcttgctggttttaggcccgattgctttgttgagtgtgaatgatctttaccatgttggttttacgattgacgaaaccaccgagttgcaaccactggcacccatgaatgaccaattgcagattatcagccagcccatcggtacggctaaaaaacatattgcttaccgctaccggatttccggcgacgccatcgatcacacagtcaagccaagtgccaccatcaagacgaaactgaaacacggcaccattccgcaagtcgctgtcaccgagcagaaactcaaatacagcaacgtctttgccgccatcatgtttgccggctccggtgaacaaggcaaaaccatcggcaaggtctacacattcaccctaccaagcaactggcaggttgttaaatcacctaagcgttaatttctgagcgctctaaccaggttcaactatttattcttgatgtaatgttctaactgaatgaatcaaaaatgaccgagtctgccataaaagaatctggcaactcggtcattttgtattttcgatctgtctaacccatttggattaagccaacaacatgcgatacaacgtgctgatcggtagacccatcacattataaaagtcgccttgaatggacttaaccagcaaggctccggcatcttgaatcccgtaggcaccggccttgtcttgataagcatcttcctgcaaataggactcgacttctgcttcctcaagtggccagaacgtaacatcggtgcctacgacttgttggcgcaccgtgccattatccaaacgtacccataagccggtatacacttgatgggtttggccgccaagtgcggtgatcatctgcttggcttcttgccggctatgcggcttgcccagcaatttgccctgaaacgccaccatggtatctgccgcaataatcgtagcccccggataactgggcaccagcgattcgccttttgccttcgcgagactctggacatattccggcggcgctaaaaccggcagcgcccgttcattaatcgtggctgggtggctctcaaaactgggaataattcgcttgagcaattcctgccgccgcggtgagtgacttgctaatatgatcatgcctgcatttccccgctttcatgactatcctgaatccgtttgaacattttctccagatccgtattggaaaagtgcaccaaaaccggccggccatgcgggcaattaaacggattctcacattgcggtagcttttgaatcaatgcccgcgcctgcttgtcgtccaaatggtgatttgccttaatcgcccgtttacagctcatcatgatggccgttttttctcgaaacgccgcaaccgtaatcttgccatcccgtagaacccagtcgaccatctccttgatcgtatcctcttcctgaccggccttaaaccaagtcggatgatgttcaaccacgaaactattttggccgaagtcttccagatacaggccgactgattctaaaacatcgcggtgcgtccgaatatcaatcgcatcggccgcggagtagtccaaaacaatcggcactaacaagtgttgctgatcggtgctgactttgccgatttcctgacgataaaattcgtagttgacccgctcctgcgcggcatgctgatccaaaatatacagaccgtcgctggactcagctagcaagtaagtgccgtgaacctgcgccaaatacgttaaatccggaaatcgctcagctggttcgttccgcttcagatcttgcgctggcaagtcctccaccagtgctggcgctacattggcatccaactgctgataacgctgatcccacgcagccagccgttgcggttcgctaaagattggccgatcatccaaatcatccatggttaagtccggcgctgtctcagcagacggcgttgatgcagcttgaggcgtatttacaggctggtcatgggtttcttcgtgtagttcagttccctgcggcggcgttggcgcagctgttttcgggctgattttattgagcgtcaattctagttgatccagatcatagtgctcgcgtttaggcaggttatccaacgcgtctggaatgagattttcttttgctaaccgactccgaatcgcttcactcagcagatgactgagctgatcttccttgctcagacgcacttccgctttcgtcggatgcacgttgacatcgaccaaggctgcatccatctgaatcgtgatgacacccatcggataccgcccaaccatgagcttggagccgtaaccggcaatcacggctttggtgagctggaaattcttgatataacggccattaacgaccagactcaagtaattgcgcgatgcacgcgtggtctccggcaaactggttaacccactcacttgaaaatcaagatcctgtgcctgaaagtcaaccatggaccgtgctaccggtaagccatagatccccgcaagtgtctgccgcagatcgccttgacccgcagtccggacgaccatattgccatcgtgcgaaaccgtaaaggcaatgccagggttagccaaggccagccgactgacgatatcgacaattttccccagctccgtctgctgtgacttcatgtacttcaagcgcgctggcgtattgaagaacagatcggacacttcaacatcggtgccccggcgatgcgccgccgtggtttgatcctcgactttgccacccttcacgtgaatcttggcgccgatgccagagtctgtcgcggtcgttaacgtgacatcggcaaccgccgcaatactggccaaagcttcaccacgaaaccctaacgaatgcacattaaacaaatcccgcgtcgtcagaattttgctcgtcgcatggcgcaaaaaggcggtcgcaacatcggcaggatcaatcccgatcccgttgtcgctgacctgtattttctgcaagcctgccgccgataccttcacgtcaatctgggttgcctgggcatcgatgctgttttccactaattctttgaccacgctggccgggcgttcaatgacttccccggcagcaatttggttacttaacgtggccgatagctgatgaatttttggcataaaatcacttcttctttaaacgtttctgaaggtcgaaaatcaaattcatggcgtccattggcgtcgcatccatcaaatcaaacttagctagtttcgccaaaatcggactgttcttcggttgcggtttaggctcttcaaaaagcgacaattgctggtccgtcacctggcttggggctgcaggcaccgttttctccggcgtggcggcttcaagctgcttcagaatcgcatcggcacgattcaataagtctgacggcaggccagccaatttggccacatgaatcccgtaacttttatctgccggtcccggcatcattttgtgcaggaaaaccaggttgccatgctcttcaaccgcaccgacatgcacattcttgagcttcgccaatgaatccgacagactggtcagttcatgataatgggtggaaaatagcgtcttggcgtgcacgtgatcatgcagatattcgatgatcgcctgtgccagcgccatgccatcataagtcgccgttccgcgtccgatttcatcaaagagaatcagactcgaagccgttgcatgactcagtgccgcgttggcttcaagcatttcgaccataaaggtgctttccccattcgccaagtcgtccgccgcgccaatgcgggtgaagatttgatcaaaaatcggtaaatccgcagcatcagccgggacgaatgatccagcctgtgccatgatcacaattaacgccaactgccgcatgtaggtacttttcccggacatgttaggaccggtaatcagcagcatatccgtatcctggtccatgataacatcgttaggaatatagctgtcttgccccaaaacgtgttcgacaaccggatgtcggccacctttaacattaatgtcgtgggtgccggcatgcatcgtcggccggacatagtgattgttttcagccactgtcgcaaaactttgcaagacatccaatgccgaaatctgggcggctaacgcttggagtcgtttaatctgagctttgacctgatcacgaatgtcttgaaaaagatcgtactccagcgccgttgagctttcctgggcttcaagtatcaaagtctctttttctttcaattcaggcgtaatgaaccgctcggcatttgtcagcgtctgtttgcgctcgtagcggccttccggtaccttgtccaaattagacttggtgacttcgataaagtagccaaacaccttgttataccggattttcaaattgtggataccggtggccttgcgctctgaagcttccaattccgcaatccactgcttggaattcttcatggcatcgcggtactcgtctaacttcttattgtagccgcgtaaaatcaggccgccgtcggtcaccgaaatcggcggttccggctcgatcgcccggcgaatcaacccggcaacatcactgactggatcgattttaccccgaagtgccttaaaactgccatcatcaagcttgcttaagacatcctgaatcgccggcacctgatcaagtgaggtttgcaattgaatcaagtcgcgcccgttaaccgtgccaaaagccacgcgaccggctaaccgctccagatcataaaccttcgtcagacgttcctgtaactcactacgttcaaaaaagtgatccagcaagtcctgaacttgattttgccgtacgctgatcgcgccaatatccaacagcggccgttccaaccactgcttcagcaaacgcccgcccatcgcggttttcgttgcgtccaataaagatagtaacgtatcgcctttgcgcccggtacggctgttttgcagaatatcaagattgctgcgggcatcctgatccatttccagatacgccgatggttggtaggccacggctttttgaatatgggccagactccgtttctgcgtattcaacaaataagccatcagcatttgcacaaccgcggctgcgaccggatcggtcagatcttgcgacacataactgccttcactcgtgggctgactgtcaggctgaaccgacaacaaacgctcgctttttttcaacatggctgcgtcatcatcggtcaggtcttctggcaccacaatctctttggttgcgagcgcactcagctcattttgcaaagcgaatttacttttgagatcagttactttcagctcaccggtggaaacatcgccataagcaaaggcataaccgcctgcgtgtggcaaaacagcagtaatgtaattgtttgtcttcgcggcaccggctttgatgtcgacattggtccccggggtaatcaactggatcaccgcgcgcttgaccatcccaacggcttttttaggatcttccatttgctcacagatagcgactttatacccatgatcaatcagaatatcgacataactctgcaccgcatgatgcggcacccccgccatcggaatcggatcatccgcactcttattccgtgccgtcaacgtcagctcaagcaactgtgcgcctttaatggcatcatcgttgaataattcataaaaatcgccaattcgataaaataaaaatgcatccggatactgcgccttaatcgcattatactgttgcatcattggcgtatcactggttttttgcggcacaaacttcaccctttgtctttgactatctctgacgttctatatcatttattttaacaggtaagtcaacagagcgcgaacagggccgttagaaaccggaacataagtggccttggacgtgatggcccgggcttaggccattgcgaccaaggtccttatgtggaggtttctggcccagtgagcgcgttttgggccggattgcccctcaccaaacccactaccccgtttaacagaaaacaaaaagcgaatgaacccacacctatggaattcatccgcctctattgcatgtctcttcaacctgcctaaacggtcacttcttcaaatgataactgtaagtggcaataatcacgttctcgcggcttgcaaacgcagcgcgtaaacggaagttggtttggttatggagaatattttgccattttttgcgcggtacgaattgcggaattagcaccgtggtcgtgaagttgcgtttagcagcattccgcgccacgatgtcgacgaagcgaattgtcggtgcttcaatcgaacgatatgacgagtgaatatcgacaaaccggacatccggaaaatcagcccgaaattcgctttgcgtttctttttccttgttcggattctcatccatcgagacgtgcatcgcaatgacataatcgccgatggactgcgcatagttcagcgcggcgcgagtcacccgcgtcacattaccgacaagcacaatgacggtgctgccatcgtactcatgctcctcaacatctgccggcaaccgtaactgcgcggccactttacggtaatgatcatgaatcttgtaaaacataaagatcgcaagcggcatcacgatgaagaacggccagatatcaaacagccgataagcaaataagatgaccagaatcgcgaacgaaattaatgcgccagaaagattggcgaccgttttgccaatccagcccttgccgcggtgccggaaccagtgaatgatcatcccggtttgcgacaacgtaaacggaatgaacacgcctaccgcatacaatggaatcaggcgctccgtggatccctggaaaatggtgatcaacgccgccgagcccagggccaaggtcaaaatcccattggaataacccaaccgatcgccgcgatccaggtacatatgcggcataaacttgtccttagccaagttaaacgccaagaccggaaaagccgagaaccctgtgttggcagcaaccgccaaaattaacgcggtcgcaaattgaacgacataatacatgatgccggtgccaccaaatgtttctttggcaacctgtgaaagtaccgtcaccttcgccatcggcactaaaccataccagtagttcaagaacgtgatcccggcaaagaagaaccccagaatgccagccataatcgctaacgttttggctgcattcttttccttgggcaacttgaaaaacggcaccgcattactgatcgcttcaaccccggtcagtgaactggatccgctggaaaacgcccggaaaatcaacgccatcgacacgccgggaatcgctgcgccgaccaatgaagttgccttatacgggatggcaccactgacaacctgataaagtccccagacgatcatcacggtcatcacaagcacaaatagataaaccggaatcatcaggaagttagccgattcgctcatgccacgtaagttcatgcccatcaagataaaaatgatgattagcgaaatcgccacctgatggccatacagcgcaggaatcgcactggtgatcgcctcggcgccggctgaaaccgaaaccgagaccgtcaacatataatcaatcaacaacgaagcaccggccgttaaaccggcattgcggcccaaattttcgctggcaacaacataggccccgccaccactagggtaagcatggataatctgccgatatgaaagtgtcagcgaaatcagtaagactaaaacgaacgccgcaatcggtaacgaataccaaattgccgcagctgacagtgtcgtgaggaccaagacaatctgctcggtcccataagccacactggacaaagcatctgacgacagcatcgccaatgctttgaagatgttaagctgttgaccaccttcctcggaagatttcaaaggccgcccaatgaacagccgtttcaagtgcatcattttctaaactcctattaacccacaccggttcaaaaattttaatgaatcgtaaacaaacatgcattagtgtactctaaatttcggcttacgcctaccttgtttcatcttaacttatatgtgccgccagaaacaccggttggattgatatttgtcagcgggtatggttcggaaaaagccgcgatcaggcactgctctataaagaagctaaggggttccgttgactgctaagttctgtagcgcgtttggtagcccagaaattcaggtgcaagaacctcaaccccaatggcaaaaaccgccattggggttgagactacttacgctttatttaagcacaccggttcacgctcactttaacgcgttcgccagcgcagaagtctgcgtataaggaccttaggcgcaatggccaaaaccgggccatcacgcctaaggccgcttatactccgacttctagacgcgccggctcacgctcgaccataacgcgttcgccggcgcagaagtctgcgtgtaaggaccttggtcgcaatggtcaaagcccgaccatcacgcccaaggccacttacactccgacttctaaccgcgccggctcacgctcacttctcgataataaccacatcatgcactttcaatttacgatggacttcatgttcgatctcgcttttagcggcgtggtcgatttttagctcggttttcggtgtgtctggcaatagtttctcaagaacaaaatcaatctcggcatctttgatggtgcgcttgtcgtgtgtcaggacaatatcgatttggtcgaagccttccacataataaacatgcaccgatcctagcgtgtaaagttcgaaatacttgactggcttgcgactgtataaaaagcgcatggtgtgcggaagcatcttgtgtaaactggcattaagccgaatgggattttgaatcaatttcatataactcgtcccctcttatttgacatggaaaatagcaacgttaattgtttatcaattttattttaacaaggaaaggtggtcaatgcctatgataacgcttggcacgagtttgaagggtacaaaagacgtgccatcatacgttcgctagcccagaaatcggctggctcacgctcacatataaaaaacaccagcaaagttcgctggtgttttatttgtgttcttctttttaaggataggacgaaattacatcatgccacccatgccaccggctgccgggtttgcacctgcagcacccgcgttgttatcctttggttctggcttgtcagcaacaaccgcttcagtggtcagcatcaaagcagcaactgatgcagcattttgcaatgcggaacgggtaaccttggttgggtcaatgatacctgacttagccatgtcttcccattcaccggttgaagcattgtaaccaatgccttgcttttccttcttcaattgttcaacgatgacagaaccttcgcggccagcgttttcggcaatctggcgaacaggttcttcaagggcacgtagaacaatgttgatcccggtctgaacgtcgccttcttctttcaaagcagcgactgcagggatgacgtcaaccaaggcagtaccaccgccggcaacgtaaccttcttcaacggcagcacgggtcgcgttcaaagcatcttcgatccgatacttacgttccttcaattcggtttcggttgcagcaccgaccttgacaaccgcaaccccgccagctaacttagccagacgttcctgcaacttctcacgatcgaagtcgctggttgtgtcgtcaatttgcttcttgatgatgttaacccgttcagcaatggcatccttggaacctgcgccatcaacaatcgtggtgttgtccttggtaacggtaactttgccggcacgacccaattgttcaatcttggtatccttcagatccaagccaagatcggaactgatcacggtgccaccggtcaaggttgcaatgtcttccagttgtgccttgcgccgatcgccaaagccaggggccttaactgcaacaacattgaaggtaccacgaatcttgttaagaaccagggttggcaatgcttcgccggcaacatcgtcagcaatgatcaacagtgccttaccttgttgaacgatttcctgcaatagtggaaggatgtcctgaatgttggaaatcttcttatcggtaatcaggatatatggatcgtccagatcagcttccattttatcattgtcggttaccatgtattgactcagatagccgcgatcaaactgcatcccttcaacaacagaaagttcagtgtcgatccctttgctttcttcgatggtaataacaccgtcatggccaactttttccatggcgtccgcaatcagattgccgacttcttcattggaagatgaaaccgaagcaacctgggcgatttccttcttgccgttaactttgtggctgatcttgtgcagttcgtcaaccgctgccttggttgccttttcgatacctgtccgaatgccaacagggttagcaccggcagtcacgttcttcataccttcgcgaatgatgctttgtgccagaaccgttgcggttgtggtaccatcaccggcgatatcgtttgtcttggatgcaacttccgctaccaacttagcgcccatgttttcgtaatggtcttctaagtcaattgacttggcgatcgtaacaccgtcgttggtgatttccggtgcgccataactcttatccaaaacaacgttgcggccttttggtcctaaagttgtttttactgtgtttgctaattgatccacgccacgcagcatggcggtacgtgcatcctcagagaacttaatttcttttgccattgtttttattcacctcaaaattgatcgattattttttacgcaattgccataatgtctttttcgtgcagtacgaggtagtcttgaccttcatactttacttcagagccggcgtatttgtcgtataatacagtatcgccaactttaacggccattggcagacgcttgccttccggtgtcaaagcgccttcacctactgcgacaactttgccggtttgcggcttttgtttggcattattggctaaaacaatgccgccaacagtctgttcctcttcttcaacgacctcgacaatcacgcgatctcctaatggttttaacaaggcaatccctccacattacattttttgatttagcactcgctatgtctaagtgctaactacaaaagtaactataacgagttttccgggtgaatgcaaccccaaaacccgggaatgttatactaatttcagatattttttcaaaggagtcccctatatgtcactgcaaaaacatgccttttccgttgtcggtgcttacctcgtcacgtttatcgctaaccttttgattttccaattcatgccggttgggcggctcagccttggtattgtgaccttaatcagtgtcatcgcaatgattgctgcggcgtatagcgaacggcaactggtcattgccaacgcgattgaagcccctggcgtcctcgcaccacaacagcgcgttttctggggtgtcatcggcattgccggcgtcttggctgctcagttagtcggctcatggcttgaaatgatcctttttaaaatgccgcaaaccaatagccagattcatcagcagctttccagtatgaccaccaatccctggtactttttggcaatcggcctcgccattcccgttctggaggagctggcttttcgtaaagtattgttcggtaatctggttaatgtcactggcgttttcggtggcgctttgatcgccagtctgttatttgccgtgactcaaccaggcggccactggctcagcgcgaccttagtcggattggttctggcctatgattaccgtcacaccggcgccatcagcactgccatcatcgcccatgtcggtgcactatgggtggtctggctatattacattgcccacgcgctgtaaacgtaatcgaatattaatctcgttggcgcattcaatcttctataatggaaataatgtttttataaaggagccgttcaaaaatggagacccgttcaaatcaccgccaccgtcaaccgcctaaacgttttcgctggggacgcctcatcggcttaatcgtcattgtcggcctgtttacggttggcgcctatgccctgcgcctctatagccaggcaaaatatgccatcgacaatacataccatgccaccaaacacgtcagcacggacatcgcccaaaagaaaccatttgcagtactcctgctcggggtcgacaccggtgctgaaggacgcgttgaaaagggcaactccgataccatgattgtggccgtcgtcaatccgaagaccaacaaaaccaccatggtcagcattccccgcgatacggctgctgaattgattggcaccaaagagttcaatatgcagaaaatcaacgctgcatacaatgtcggcggttctgatatggccatcaacacagtctctaaacttgtgaatgtgccgatttcttattatctgacgatcaacatgggcgcgctggaaaaagtcgtcaatgcggtcggtgggattgacgttgatgttccgttttcattccaggatccttacaccggtaaccagaaattcaaaaagggtcgcatgcatttaaatggcaacatggcacttgcctactcacgaatgcgccacgctgatccggaaggcgactatggccggcaaaagcgccagcaacaagtcatcaaggcaattttgaaaaaagccgtttctgtcggatcgcttggtaacttcaccaaactcatggacacgatttctaaaaacattgcaactaatctgagttttgccgatatgcaaagcattttcatgaactatcgcggcgctgccaaaaccatcacaaccgatcatctcaaaggggttaacgcctgggtcggcgacggtgcctatcaaatcgcatccgatgccgaaatgcagcgggtttccgataaactgcgcaaagcactgggcctgcaaaccgaaaccatcagcaacgaagaaaccaaacaaaacgccaagaatactcagtttgatttcaaggcgacgaccgatcaaaattacattatcttcacaccgtatgaccgttaacatccctgcaagcaaaaaccgcctaccgactttttttcgtcggcggcggttttttagtggcgtaaaaatttgcttctgcctgctcagtgctatcgaaccatcagctgttcttgcgcacgctcacgatgcagccaccaaagaccaagcgcgagaacaccgataatggagacactgtaggacagcaattcattttggaacagccaatccccaaaattgtaagggacaacaatcaaggcatagacaaaaatgacccagcggagttttggtaacaataggatgtcaccttcgttttccaacgaaatgcggtcaaataaccaccgggtgatccagtaaccggctgcactggctattaatgccatcacaaaaaagaacagaaacagctgatcgccatgcggcaagaatgccctataagaacgcttgtctatggtggtataagtaacaaaccgctgaatggcactcatgccaagccaaccaccaagaagaccaaatacaaacatgccgaataaggaagcaaagatactgccgactgcaataccggcggtgaacatgaagctattaacagccagattcgtcatgaatagtcccaaaatattcaagccgctgatcccgacatacgctgctggaacgcctgcgtaatagccaaacagagtgagactaatgccaagcgttgtcgtccccaaaaggcatgcaagtccataccagtaacgagtgtcaaacaaccgttttcgcttaaacctgcttttaaagagagtcgcgttaaaactgcttgcctgatctgctccagccatgatcaatcccaagagcaagggaacaatataactaatcactgtcataatacggttgatcagaaatggcgaataaagcctgtttcgttgtggctcaatcaaaaagcgttgttcatcacgataaccagcgtaacttttattgccatatatttcagagtgatgtttagctgcctgattttgggcggcataatattctgtaggattcatcatatatttctgctgactctgataattttttaacgtgtcacccaaattaaaaactgccaataacacaacaaaaacaaacatcacacgaataagcgctttgtgccttatccgaacaagtttcaacagctgatgatcacccatctagcccacctccgcatgtttttttcgaaattcgactttaaacaaatccgacaatgacaatggcaggctttcgttcaaaaccggttgctcagcttgcagtgccgcttgcacatctggcgtgaaatcagggaaaaccacttcgatgacgcgtccgcggatgttcaaaatgcggccatgctgtttgatcaccgccggaatttccttggtccggaataccaattgcaatttcactgcttgctgccggacattttccaaggtgagatcacggctgatgcgcccatctttgacgaataaaacgcgatcggataaaccgtctaattcggcgagattgtgagacgcaatcagaaaggttcgctgaccatcggctactgcgtccacaaccagattcacaatgcgttcgcgaatcaggacatccagcccatcgaatggttcatcgagaaaaacatacggtgcctgactcgccaaagccatcgctaccatgaccagtgcctgataccctttggatagaccttgaaaccgctggccgccagctaacccgaattttttaatcaggtgcagaaacgctgtttgatcgaatgaaggataaagcaaggcataggttgttccaattttggctaatgcatacttgcgaaaaaataaatgttgctgatctaagtaaaaaatggctgcttgttgcggtgattcttttgtcagatcatgttgatccaacgtgaccgtcccgccgtcagcgatatactggcggttgacggtacgaaaaatcgtggttttgccgataccatttgggccgaccaatccgacaacctggccgcgatccagcgaaaacgtgatatcgcgcaggacttcctgattggcgattcttttttgcaatttagtcacgattaaactcatacacgatgctcctccttttcagtcaaccatgcttgcaatgtcgctaaactgatgcccaggctttgtgcttccacgacaattgcatcaaactttgggcggaacgccgccactgctcttgaattcgcatgttttaatggctcagccacaaatgtgccgcgcccgggttcaacgtaaatcacgccgtccgcctccagttgcttgtaggctttggcgacggtattgggattcagctgttcttgcttcgccatttcccgcaccgatggcagcttatcgcccggctgcataatgccttgtagaatccgggtcttaatctgcaacaccaagcgttcatagtacgccaaatgagtatatgactcggttgccattcaggcgccccctttcgtactacgtgtactattatacatagtacactcaacaacgcaagaaaaaacgccgtccatctgtcatggacgacgcattttctttttttcagttaagcttccggttcgttgagcgttggcccataatgttccaggaagtaaatcaaggtctgtagttccgttgccaaatcgacattttgtacccgcacgtagctaggcaccgaaatgcgaatcggggtgaagttcatgatccccttaatcccggctttaaccaaatcatcggtgatatgctgggcggcatcaattggcaccgtcaaaatcacgatttcaatctgctgatctttaatttgcttaatcatttcgtccatgggataaatcggtaccccactttgaatggttccggctaaatcagggttgatatcgaatccggcactaatccgaatgttgttagcctgtcgaaaattataattcaacaaggcgtggccaagattgccgacaccaaccagcccgacattggttagccgatcctgattcagaatctttttaaagaatttcagcaaatcgttgacgtcatagccgtagccgcgtttgcccaatgcaccgaaataagaaaaatcacgccgaatcgttgccgagtcaactttcaccgcgtccgacagttcagttgaactgatcttggttgtcccggaattcgccaagaaattcaaatatcggtagtacacgggtaggcgtttcgccgttgctttggggatgattgtttccgccatgtaagcaagcctcctgtagaagtattcccatgcagaacatgtgaactgtccaacatagtatcttctgctaatattagctggtttatggcctgaacgcaagcggatacatcttcacaagcatattttattgtgcgaatgcatcatcagggaacgcacgcccatgaacaaaactatggtatattaggtcttaacgattattgtgaaagaaggtattcctgtgatcattttgcaggcacaacaagttagccgcagcttcaacggcaacgaattatttgccaatgtgaatcttgaagtccaagacggcgcgcgcatcggccttgttggccccaacgggattggtaaaaccaccctgctggaaatcctgaccgggatcgcgcctccggatagcggccaggtaacaaccatgaagaatctgtccattggctatttggcccaaaactccggcttagattcagataaaacgattttcaaagaaatgttgacggtcttcgcaccactgcaggcaatggcccggcaaatccacgcattagaggccaaactcggtgatcccaaactcattgcggacaagccggcttttgccgcaaccatgaaacaatatgatcagttgcaacacgattttaatgagcaaaacggttatggctatgaagccgaaatccgctcggttctccacggcttccaattcggtgaagacacttacgacaagccagtcggcaccttgtccggcggcgaacgctctcgtctggccttggccaagctcctgctggaaaagcatgacctgatcatcctcgacgagccgactaaccaccttgatatcgaaaccctgagttggctggaaggctatcttaaaacctatcccggcgctattttaacggtcagccacgatcaatattttcttgatcacgtggtcaccgaaatttacgaactggatcaccaccatgcgacccattacaaaaccaactacagcgggtatctccagcaaaaggccgagcgccaggcgcaggcttggaaagcctacaccaagcagcaagaagaaattgccaaactgcaggatttcgtggacaagaatattgtccgcgccagcaccaccaagcaggcccaagcgcgccggaagcaattggaaaaaatggacgttctggaaaagccaactggtgacgacaaaagcgtgcgttttaacttcacccctaatcgtcccagcggcaatgaggtgctcaaagtcgaccaggcaacggtgggttatgaagctgatcacccgatggccggccctatcgatttccaggtaaacaaattcgatcggatcgcccttatcggaccaaacggcgtcggcaaatcgactttactcaaaagtattttaggcaagatcccgtttctatccggatcagcaaagttcggcgctaacgttgatgtcggctactacgaccaggaaattcaacaactcaaccctaaaaatactgtgattgacgaaatctgggatgaacatccgatgatgccggaaaaagacgtccgttccgttctggctgcctttttgttcggcccagacgatattcaaaaaccggtcagtgccttatccggcgggcaaaaagcgcggttggagttgaccaagttagcgctcaaacatgataattttctggttcttgatgaaccgaccaaccacttggacattaacagcaaggaagtccttgaacaggcattaaaagattttaatggcaccgttttgttcgtgtcccatgaccgctacttcatcaacgaactggcaaccaacgtcattgccatcgccccgaccggcagcacaacctacctcggcaactgggactactatcaggaaaaactagccgagactaaggcagaggccgaagctgcggctgctgaacagccaaccgccaaaaccgaaaccgcgggcgctacctcttaccagcaatccaaagaagatgcccgcgcaacccgtaagttgcagcgagaagttgctgacttagaagcacagctgcagaaactcggcaaccaagcgaccacaatccaaaaagaaatgaccgcccccgatgttttgagcgactatgtcaaaatgcagaaattgcaaactaagctcgaagcagttcagaaacaaaccacggacgtcgaaaatgcttgggaagaaaaaagtattgagcttgaagacatgcaaactgctgacaagtaggcaacgaaattagcctcaatcaaggtcagttaaccgcaaaaaagctggtaccggaatcaataacttgtttccggtgccagctttttacattttttaactatcgcaattaaaccttttgatccagcaacccgattgcctgctgcaaaactttctcgccgtccatcatcccataggctttcatgtcaatgacagccatcgggatttttttagcgtcggctttagctttgaactggctttccatgaagcggacttgcgggccaagcatcagtaccgaaactggctccgatgccagtttattgtcagcatctgcagccgcagtggcaaaaacatcaacatccataccatctgccgcagcagcttttttcattcgttgcaccaacatcgaggtggacataccagcggagcacactaacataattgttttttcagctatgggaatcatcctttcgttaacaaacttatcgataagttaagtttaactaaatcaacgaacccccgtcaacgaaagtgctgatgattcgctcatgaccctaagcatgggcaaagctcaggcccggatccgcattgagattctcggaggcaagatggcgcttggccaattcaatatgcgcagctgccccgatcatggcaccgttatcgccggttaagcgcaacggcggaacaatcacgtccacatccggaaaatgcacggccagcgcttcgttcatggcttctttgagtccctgattggctgctaccccgccagccacgatcagctgtttaaccggatagtgcgtcagagccttctgagttttatgaaccaggacatccaccaccgcagcctggaaactggccgcaagatcttcgcggctaagcgtttcaccgatttgattggcatggtgcaccgtattgatcacagcggacttcaagccactgaaactgaagtccagattatcctctttatccatggcgcgcggaaaatggaaggtatcgtggcccaaatgtgccaaacgatcgacttctttccctgccggatatgggatgcccaaaatccgtcccactttgtcataggcttcaccagctgcatcatctctagtatcaccaataatctcgaactcaccggcagctttcatgtaaaccagctcggtgtgaccaccggaaaccgccaacgccaacaatggataggtcagcggcttaacaaagcgggcagcgtaaatatgcccagccatatgattgaccggaatcagcggcaagtggtgggcgtaagcaatcgttttggcagccgtcacgccgatcagcagtgcgccaaccaatcccgggccgtaagtgactgctacggccgttaagtcggtgtaggtcaccccggcttctttcagtgctgcgtctgttaccagcgtaatctgctcgacatggtgccgactggcgacttccggaacgacgccgccaaaacgctggtggctcttgatttgcgtcgcgataatattcgataaaatcttgttgccattttcaacgacagccacactggtttcgtcgcagctgctttcaaatgctaagatcaattcccttgctgccacattgttctcctctacaaacatgatggttccggatatcacggcaaaggccgatacatatccagtgcatcatcatgattgctgacataataaccttttttaactttgccatcttgaaaaccgagcgaatgataaagctgcttagcaatatcattatttgttctaacctcaagcgtgaccttttcactgccgtattcaatcgctcggccaatcataaactgcatcaaaaagcgacccagtcccatatgctggtaagctggatcaacggcaatattcgtgacatgagcttcactcatggtaaaccaagtaccgacaaaagcaaccagttggccagcatcttcaaccgcaagatacaatgaatgacgcactttgcgcaattcagagaaaaacgcatagcgatcccacggcgtatcatgatagatccgccgctcaatcgccaatgccgcgtcaacatcggcttccgtcatgcgccgcagtaaatattccttattgcggacattgatcgtgcgtgactcaaattgaagttcatcaggcgtcgtgcggtcaaaccacgacctaaactttctcaacataaacatcatgtcctttgccgggatgcgccttaagccagttgttttcggcttccgttaagcgtaaatagcgcggcacaaaatcatagacagaaaccggtggtaaatctttgcctagctgaccaagtcgcaacgcttgcggcagatttaaccaatctggggcaaaatgagccaaaccgcccaatgcctcgataatctgtccgcgaaacatcgctgcatcggttccgacaaagataaccggttgccgtaacgttgtcaactcggtgagcaaaagcgtcagcggaacgtggcgatccgtaaccacattaatcaggttccccttgtcccactggtaaacacctgtgaagacattgttgcgccgtgcattcataatcggcacaatcatagctttagtatccgtaatgtttgccgctaacacttccaggctggagacgccgaccaatgcgatgttcagcgtgtatgccagagtttttccggtagtcacggcgatgcgaatgcccgtgtaggaacccggaccgtccgcaacaataattttatcaagatcttcgggttgcaagccacttgcagcaaccaaatcgtcaatcgttggtaataactgttcactatgagtccgctcatgattaatagtcgtctgcgccaataaccgatcattgtccagcacggcaaccgacatcgcctcatttgaggtatcaagtgctaataatcgcataattcaggcctcccttcggcgatacaatcatggcaatagtttatcacaaatggccttagagcgtgagtggtatattcgtgtggctgcatacaaaccgctagtcagccgcctcgcgctgtgccaaataagcgccatcaactacaaggataaccacgcttcgccgggattaggcagttccccgttcaacgcggcaagcaaaatgagaatgctaccaatcatcaacagaatctgtaataaaatcttaagccataagcgttgatgaatgatactttctggcgtccaatacaagtccgcggcgctctgaatcccggtcgcctcgttagcagccagcaactgatcatgcaaccattttgccaaccacatccaggcaaacccggcaactaccgcgctgatggccagcacccacaaagcctgattgcgggtggttaaataatctgccgtaaaaatatataatcgccgaataagcggcaagtgactcagttcgttgtaaaactgatttccaatcgcaaaagcgaacgctaagccgctaatccagctgcctgtcagtccgacacggcgaatccgctgcgccaaagcattttcacgatataagttgcggacatacgttttccggccagtacgtacctgattcgggtacatcatcttgtgcgtcgtcagctgcatagcaacaattttacgctccaaggaccacgcccataaaccggttccggccaatgccaccgctatcaatccaagcaacaatagatccattgtccgccttcctttccagaaactttgattcgcctattttagcaattaatccggtgagtgaccagttagatgaactgggtgctagggttgtgccagtgggttcacgccagcatgcaaaaagcagcagcaagcttccgagtcaccgcgaagatgaccgagaaacttgctgccacttattgagtcggtgttaaaacgacttttgtcaattaaagatgcggccgaatccgttcgacggcttttaatgtcccataagacagtgccgtctggatcggtaacatgaccacgtttttaatcgttcgtggccagataatcccttgccaaggcgtccccatcatgttcagccacagcgttgtcaaaatgacattactgatcagcaacaccaatccgacgccaagtaacgtccgcataaccgttaccttcttgccgtggaagaacatgccgtaaatcattgcagcaattgcggcactgagcgtgaacccgggaaaattggcgcccggattgaagaccataatcgacaactggtcattcaaagcagcggcacccgcggccagccatggtccgaaataataccccatcaaaatggtagcgaaaaacgccggactgatcttaagccatggcgtaccaaaagaaaaacgacccaaaacaatctgcattgccatcaacatggccatatacacgatgttccgagtggaaagcttgggactactaaacgataaaacttgcataagctgcaatctccttttttgcggagacgcctaaatatcaggcgaatgcggcatctgcaccgcgactttcgtcttcgtctgccgttcacattccgttccagcagcacttaacgcgcagattcctactcctagattttgtcacgagttctatcgtacaccgaaaattaaccaaaagaaaccccttgaacgttcgcatcagcacttaaaggcaggctcaacccttgacatcatcgtgaaaattatctcacgactttctcggtattttttagcgctacaccaagtctgctaccagattggtccgctaaaatggtgtctcgtaagcaaatttttcttagttgctcaaaactccctgacaaagggattccctcaaaggcggtgtactcagaattttgggtacgccgccagttttatgtgagcgtgagccagcgcgcttaggagtcggagtgtaagcggccttgggcgtgatggcccgggctttggccattgcgaccaaggtccttacacgcagactcctgcgctggcgaacgcgttatggtgagcgtgagcaggagcgcttagaaatcggagtgtaagtggccttaaagcctaaatggctgggctttggccatttaggctttaaggtccttacacgtagatttctgcgactgcgaacgcgttatagaacacgaaagtctgactacccacttgccctaaatagaacaagtttcaagtacacaatccgggcttaggccattgcgaccaaggcccttacacgcaaactcctccgccggcgaacgcgtcatgggcgtaagaacacctaacccaccaaatactgcaacaatctcacttcccgcatagacttgcactcaaaactccgtataataagtctcgataacctttgaaaggaagctttgaccgtgactaaacacattctcgttttacatactggcggcaccatctccatgaccgaaaccagagatggcgacatcatgcccagcaagcataatcccttgctcggcgccgatagttttgtgccagccggcgtcgaactgactagtgaggagatttttaatctaccatcgccgcacatgactccggagcggatgctcaccttagtcaaacgcatccgccaagcggaaaaagacggcgctgacggggtggtcgtcacccacggtacggatactttagaagaaaccgcctattttttggatctcaccctggattccgccatgccggtcgttgtcaccggcgccatgcgttccagtaacgaaattggcagcgatgggctagaaaatctgcaaagcgcgattaaaaccgctgccagcgacgagtcgcggaacaagggcaccttggtggtgatgaatgatgaaatccataccgcccgttttgtgaccaaaacccacaccaccaacgtcgcaacttttcggacgccgacattcgggccggttgggcttgtcaccaaagatggtgtgcgtttcttccaagagttgatcaaccaggaagtctgtgccattgaccaccttgttgaccatgtcttcttaatcaaagcttacgcaggaatggacggcacgctgtttgacgcactcccggaaaatatccacggtctgaccattgaagcgctcggcgccggtaatctcccaccagccaccttgccggctatccagcggctactagatcggcatgtgccgatcgtactggtctcccgctgctttaatggcgttgctcaagccgtctacaattacgaaggcggcggcgtccagctcaaaaaaatgggcatcatcttctgtcagggactcaacggccagaaagcgcgcatcaagctgcaagttggtctgagtgatggtaaacgcggccaggcactcgctgacttcgttgataatgccgtgagttaattgagctaatgaatgaaaagcagttctaggcgacagattttgtccctagaactgcttttttggcactttagcatgagtcatacaaaacttacgccttaaagtcatcccaaatcatctgggcctcggcgttcacttcgccatcggtcgtcacgcggtgtaacgtgcgggttgcgtcatccggatcggcctgaaactgggctttcggactcgttccatacgccacttcgcgctcgtaacgaatatcggcaccacgcaaagtatgcgagctcaaaaagtcatatccaagactgttttccatccactccagataatgggcattgttcacatggccattgctgtcaatgtcaaaatagcgcacatgaaacgtctcttcgccatccgggtgatcgacttttttgaatcgcgggaaccgtttgattttgcgatcggaaaccgcgccaacccgttcaacaagctcaggaataacgtcaacgatcttacgcgtgcgcaagtccataatgacccaattgctgctgacggaaacaagccggttaccttgcgcatcgtcaatccagtaatcacggtaagtaaaatatttattgtaagtcgtagcttcggtcccgacccgcagcagttcttcaatttttggcatacgttggatttccatgtgatactgggtgatcacccaacctgcgtgaaactcactgatggcatcaataccggcatgcagcttctccaactgacgctcagacacttctagcatcacattcatcatattggctaagcccgcacggccaaaccgatcacccagaaagcctggaatgcgataatcttcttcatagacttttcccatgaaaatcccttctctttcgtttcgacttgttcctgttagtcggtgctcaagcgcgcgtactggcgccggttcacgctctgtctaggtcatgataagcatcatacaccacttgtttagcaaccccgttttgtttagcgaccagcttgatcgccgcattcggtttggcgccggtggcaacgatagcggctacttggtctttgaacggtgccgcgcttttgacaactggcttatccggggctcctgctaccatgatcacaaattcgcctttcaactcattctcggcatacgtttgcagttccgtgatcgtgccgcggataaaggtttcgaactttttggtcaattctcgcgccaaaacagcctggcgatcaccgaacgcttccaacatcgcggcaagggttttcccgacccgatgtggactttcatagaacaaaagcgttgccggttcagtcgccaacttggccaaaatgcgttgcttatcgccggatttgcgcggtagaaacccataaaacagaaatggctgcggtgacaatccagaggcaatcaaggccgttgtcgccgcattggcccctggcagcggaaccaccggcacaccatgttcaattgccgcatggaccaattccttgccgggatcggaaatcgacggcattcccgcgtcactcacctgagcaatcgtcttcccggcctccagcttcgccaacaactccggaatgcgcatttgggtattatgttcgtgaaatgaaatggttttggtcgtaaccgcaaaatgattcaacaacatctgcgtatggcgcgtatcttccgcggcaattaaatcagccgtttttaaaatcgccaccgcacgaaatgtcatatcgtccaaatttccgatcggtgtcggcaccaaatacaaagtcccggtggtatgcgacccaaagcttcgttgctgctccaaatcaattctccccataaataatatcaagacaaaaggcgcatggctcgtcattcacccggcgctgaccataaaacatcgggcaaacgtggaatccttcattgtagaggctttccaggttctgcttcgacttggataactcaacgccgccatcgctggttttgttgtcatctttttctagctctgccaggtgctgacgcagatgcttattctcgatttcaagttccgcgttacgttctagcgtctccgccatatcgtctttcatcgccgcaatttccttgagcatctgctgggcgtgtttctcaaggactaagaaaccatcatacagttctttcttttccacaagatcacccttctaagagtttaagcattaactgttctgttgccgactgaaacgtcacattctggctcaagcgaacctgcgccgttaaaatggcctgcaaatcatcggtcagttgccgactcgataacttcgccaacgcagcaaccgccggaatatccagctgttgcgtcgccgcaatttcaaaatggcgattcaaggcatcggcatacgccaaaccgatcagcgctaaaacctgacgttgtgccgcagcatcttttgcaaccggcaacaattgggtctgcacccgcacaaagctttcaggatcatggtcagctaggcgatccagcaattgaaacacgcgattaacccgatcctgaaagtcctcggcagtcaataattcctgagcttcgctgacattaccggttaaccggccagccacccgcgccaattgcggattggcaccgtcttcttctaatttggcaatcagcgcttgccgatcagggctttggaacgtaatcacctgcgcccgcgataaaatcgttggcaaaagttgatttttcgatgaagcagtgagaatcaccgtcatgcccggaaccggttcttcaaaaaacttcagtagtgaattagccgctcctgcagtcattttatcagcatcttcaacgataaacacgcggcggttgccttccacaccggttttgctcatttcctgtttcaagttgcgaatatcatcaaccttaatgctttgggtactggttttgagcaccatcacatccggatgattgtgattcaaaatacgttcacactcaggacattcgccacaaggagcaccgtcttggacattttggcaaaataggcgcaaggcaatccattcagccagttccaacttaccggcaccttttggccccacaaacaaataggattgggccagttgcttgcggtcaatgattcgggcaaattgggcgactaacttaggctgcaacgaatcaatcaaaaacttagccattagaagcggtgaaaggattcaatcggcaagacaaagacggtggcgccgccgacttgaacctcaactggataagccatggaactgtctgatgtcgcatcaagattaactggcggcgtcataaactgttgccgcgtctgcgaggtttccttgataatcttcaacacgtcatcgacccgttcatccgcaaccccgatgataaacgtcgtattccccgccttcagaaagccgcctgtcgtggacaacttggtcgcctgaatgttggcatcaataaattggctgctgagtaagttactatctttatcttgaacaattgcgagaatgagtttcatggtatgtcctccttatgagagtgagcgtgagccagccgattagaaaccggagtgtaagcggccttgagcgtgatggcccgggcttaggccattgcgctcaaggtccttacacgtagatttctgcgactgcgaacgcgttatggtgaagtcagcccgccatcatcatccaaacaacgacgggaaccgcttcgtaatcgctgcctctgctgccgtgacaactgccgcaagcggctgagtggcatcaaccgtgacaatccgcgttggattatccgccaccaacttcatataggccgaatgaacgcgttcgtgaaaggctaggctttcctgatcgagtcgatcatattggcgctcatgttgatgggccgcaatccgatccaaaccgacctgcaccggcacgtctaagtaaatcgttaaattcggctcaagcccggctgttgcaaactgattcatttgcaaaaccgcctgtgtaccaatttgccgaccaccaccttgataggcaacagaactatcgacaaaccggtcacagataacaatatcaccttgtgcaagcgccggttggatcacctcgaccaaatgttgccgcctagaagccgcatacagcaatgcttcggtacgtgcatccatctctgtattagctggatcaaggatcacgtcacgaatcttttcggaaatcttggcgcctcctggttctctggtgagatgcaaagcggcttgtgattgcgacttaagccttggaattaatgcttccaagacactggttttccctgcaccatccgggccttcaaatgtgataaacgtccctgtcacgatatgctgctccttttttagaattaagtctattttacttgatatgtttcacaattaaaaatttatctgcgccggtgaactttcaaaacgccccaacgatgatactgaaaaaagaaaaacggccatggccgatcttatcgtgcgatcatcaccatttgccgtcaatcgaaaagctatattcagtgaatcagaatcatcttatggtctatttaacatggtacgcggtccataactaagtcggcgcttttacaaatccctaaactccgcaatctgctcggcagcgaccttagcaacgacctcacctttgatcttacgagtgcgcgcctcgcggtagagaaaatcgaataaggcagcttcaagcgccacctgtgatttcgtctcttcgtcaacttcgcggaaagtcgcaacaagtttgcgctgagctgccatctggtcacgaactcggtaaacaagcatcatgagttcttcgtctttttcctctttgaccttgatccgcttacgtccaaacattacagttcagtccttccttcaacggccttcattaacgtcatttgatcggcatattcaatgtcactgccgactgccagcccgtgagcaagccgcgtcaccttaatgccggctggtttgatgagtcgagcaaggtattgcgcggtggcttccccttcaggcgttgcgttcgtcgcaataatcacttctttgacagccgtgttcgtcttcaagcgcttcaacagactttcgatgttcaggtcttccggtccccgaccttcaatcggcgaaagcaccccatgaaggacgtggtagaggccgtgataatcctgagcccgatcaatgctcatcacatctttaggctgctcaacgaccagaatcgtgctttggtcgcgacttttatcccgacagatcgaacaaggatcttcatcggtaatgttgccgcaaatcgagcaataatgcaggtcttctttagccgccaccaagctcttggcaaaagccgtcacatcatccttgtccatatcaatcgtgtaaaaagccagtcgggtggctgtcttcgccccgataccgggcaaacgcatgtaactgtcaatcaatttactgattggttccggatattgcataatcatccctcttgttgaaaacgttcaaaacattatgtggcggcagtcgtcatcctaccaggttggatagactggcgcggcacgctacatcggcaagccgcgggtatatttacctaacttgtcctgagtttgcttatcaatttcactcatcgcatgattaactgcctcaaggatcaaatcttgcaacatatcaggatcgtcaggatcaatggcttccggcttgatctggatatctttcatgaccttttcaccggtgaatttaacggtgaccatatcggaagctgacttaccttcgaattccgttgcataaagttccttctgtgccgcctgcatttctttttgcatcttttgcatttgacgcatcataccttgcatattgcccattccacgcatatttgatcatccttttctagtcatttttgatcgtaacattaggtgcatctttaccaaaaagttcagtcatcttgttgacaaccggtggcgtttttggcttggtgtcggcgctttttcccttggtcgccggcgctttaagttcctgaatataatccttacgaatcgttggccagacatcgctttgaaccagcacgatcttaggctgcttgccggtcagcttctgtaagccgttttccaactcagtcatcagtgcggcatcattcatggcccgttcgaccaaaatatcataatcaaagctgacaatcacaccgtcaggactggcggcaaccggctcgctgactttcatcatggcccgtttggtgatgctcaacatccccaacaaatccggccagacatccttcagattggttaaatcttgcttcgtggccgcgccaagaatcggataaatcgccttgcggttgacatggctggctttggccttcacatgcttccgcgttcgggtcggcggtggtactgtgccgccatttgcctcaacccgtttgagttgatcactcaactgtttgaccttagccgaaagctggtccagcttctgcgtgtctgccggctccgcagccacgggggcagcagcaggcgcggcggtttcacttagccgaactgtggccacttccagatagatttccggatgattggtcattcgtagctgttgctgcgtattgttcaacacatcaatcatgtgataaatctgcgccggcttgaaattttcacttaaaattttgaattgatcgtctagcagactcttttccaagtctcctagcaaggatggtgcctgttgattgaccagcaagtcgcgtaaatattcgatcaagtcttcaatgagtcggccagcatctttaccggccgctagcaaatcctcgatcattttcaatgcctgggcatgatctttggccagcaccgctgccagatacttgccgagcaccgcggttgtcacgccaccggtaacatccaaggcatcttcggtggtgacatgattatcgccaaaactcaggacctgatccaaaatggacaaagcgtcacgcatgccgccttcagccgccttggcgatgaccttaagcgcagcgtcgtcataagtgatctttttatcgtccaggataaaacgcatgcgtttgacaatgtcttccggcgtaatgcggcgaaaatcaaagcgctgtgttcgggaaataatcgttgccggaattttatgcggttcagtggtcgccagaatgaagaccacgtgtgccggtggttcctctaacgttttcagcaaagcattgaaggcgccgctcgagagcatgtgcacttcatcaatgatataaaccttaacgcgtgcgcgcgtcggggcgtacttcgctttgtcccgaatatcacggatttcatcgaccccgttattagaggccgcatcgatttcaatcacatcagtcagactgccatcattaatcgcctgacaaatttcacaggtattatccggctcgccatctttcaggttcaggcagtttagcgccttcgccaagatcttggcaacggacgttttcccggtgccgcgcgggccggtaaaaagataggcgtgacttgtctgtccggtgatcaacgcattcttcagcgtcttggtaatcgcatcttggccaatgacatctttgaactgttgcgggcgccagacccgatacaacgcttgataactcaccttaacgcccctttcaacctgttgcagatgccacaggttcacttaaacgatttgttgactattgacgtctaccctcatcgtgatggacgtcaaaacctcgttctagtttaccatagctcggaacaaaattgcctgacatgatgacaacaaaaacggccgcttcgtgatgaaagcgaccggtcaatttctcaataacaaaaggcacatgacgagcttaccttagtgctgcttccttccggacctgacacaatttggaaagtcaccattgccttaaggcctttcggcaaaaaccattatacctgattttcacgcgtttgaccagcctgtttggcggcttttcgttttgcgcgaatggttcggaaaaaactttgcagcagttcggcactggccgcggctttaagcccaccaacgacggcaacttgatggttaaaccgcgaatcttccagcaggttgtaaaaagtgccggcaacacctgccttaggatcagttgcgccaaaatagcacgtggcaatccgggcattgatcatcgcgccggcacacatgggacaaggctctagcgtgacaaataattggcaatcttccagacgccaggtaccaagtttgcgacaggctgcctgaatagcaataatttcggcatgttgcgtggcatcttgagaagtctcacgcaggttgtgaccccggccgacaatctggccttcgtgaacaaccacagcgccaatcggcacctcgccaatcgcagcggcttttctggcctcagctagtgcggcttccatatattggttgatgtctgattcttcggtctcggccacgtaaaacttgcctccatttttacgagaggactaattgtcgtgccaaactccgcaatctccggccagctggggctggaacgctgtgggcacgactttgagcctcagcaagcccggctgaggctcaaagctcggccttgttgtaggcggggcaaagaacgccccaccaacaacaatttcacagctgagccccatctggcctacgattgctccgccttggcactcacgtttttaatccatagttacaaaacataaacactaaaggcgatcgtagtcccaaaatttgcggacccgatcgtcttggttgggcttgaatgatgcactgtgcaaactcgatgataatcatcattcaattgtttagcgattcaaagcgctcttcaaccgatcaagcgcggccatgccttgttcgcgtgccgatccggcgtattcgctggcgctgtctttgaggctgcgtagcttgtcgctgacccggagcagactggcaacgtcttcgtcactcagtttatccagaatgctctgaacccgatcgctgtcaccgaaaatcttcttcacaaagccttcaacctgtttgcgttgctgcctgcgttcaaaatattccgtcagatttttggcacaaacaaacgcaccggttgcaaggacagccgccgcaatggcacctgctgctaagtacttcgattttgtcatctaaatctgctcctttctatccttactacgagtttaccacgtcaagtattgaaactgttattgactcgccttgagaatgtaataaccatgctcttttttaatgacttccgccgttttataagtcgctttcattagcttcaaggctgatggcgcaccttgtttcttttggatcaccgcatataactggccaccaggcaataaatgctcggctgctccggcgagaatcccggaaacaattgccttaccggctcgaatcggcggattggtcacgatgacgccgaactgtccgtcaatttggtcgtacatcgaactttcaacgatgctcacattggtaatcccgttgtcggtagcattctgtttggctaacgcaagcgcccgttcattcacatcgctcatggtaatctgccgctcaggaaaatatttggccaaggcaagtccgatcggcccataacctgttcccacatccagaatcggcccttcaggaagagatgccgctaaaacgctggcaatcaaaacccgactgccaaaatcaacggtgtgttttgaaaaaacgccattatcggtcgtcaagtgcaaaacgtgaccgccgagctcaaaatcaaagctgtgttcatcatgggctaaatcaggatcgttcgtataataatgctgcattgataagccgccttcctatttgcctggcactaccagtattttacacgttaatggcgctttttcgcacctttattcgtatcattcggctacttatcaatcccctgaccaagacggctgacccaagccaatcgttttggccaccaactgttagaagtcgtcaaggtcaccttttggctcaccaccatcatgatttgcaacagtgtaaagagtaatgacgtccgcttgcgataagcaacgtactttggtacccattccgttacatatttgtttttataggagcgcaacccttggaacccgtaaaaccgatagccatactcgtacaccaaatgggcaatcttttcttcgacaaaggaataattcgatgtcccgacgtttgccagcggggccatccccatattgaagtacttgtagccgcgttcctttgccaatcggaacagattgataaagacctcgtccataatgccagacggtgcatcggtacttgaccgcatcaaatcaatactcgtgacttcatgattaccacttggcatatctgacgcaaatgccacaattttgccttccgggctatgcaccactgcaattggagcctcattcagataatgctcgtcaaaaaatcccagactaaagcctttctcactgcgcccgtctaaccaagagtcagacacggcctttaattcatgcattaaagtgtcatcaaacggcggcttaagcagctcaacagtatagccttcacgctcaaacttatgcatcaaggcccgttcacctttgcgctttgtgccggccagcgtgaaggttgtcacatcgacatagccttcctcgccaaacttcataaaatcaaacccgaactcatgcagcttcatcgtcaggttttcattgatttcatagaacaccagcgacatatcctgcttatcggcttctttcatgaaatcgccgatcgcagcggccatctgggtctcatccccaatcggctcgcccatgataatcagcttgtccgcctttttcttaaactggaagaaaacccgatcttcgccatcgacttgataaaaccgcaatgatttgtcgcgcatcaaggccaggtggctgacttcattgccgccgtatttttcaaccactgctttcaaccgctcctcgtcataaggatcagccaaatctttggtcggcgccgatagatatcgaaagatcaaataaaccgtcaacgctgccagcatgacaccaatcagggttgtaaagaacatgcgctctgatgggaaaaggaacacatccggcacccggcgatgatgaattgccggcgcattgtaaaacgcggcaaacgcataaaagataaacgtcataccaaacactgcgccgtcgatcaacttgttgccccacgataaggcgagccgctcgcgggtcagctcacgacgcgtcagtatcaacgccaagacaacgagcaccaggaaaataatgaaccgcagatgattatcttcacgcaaggaggctaccatcgcaacgatcaaaacgatcacggttggccaataagcccgcttcacccggctggcaataccgcgtccgaacccaagaatcaaaaaggcgacaaccacattggtaacccgatccaaaaacaggaaggtatatggataaagccgttgataaagcgtgttactgaaagcaagatccggcgcaaccccgcgcaatagcaacataatccccgaaaagtacaggaagacgaccagaaaaccaaaggctgcctttcgaatcagctgaaccggcaaaccttcaagataagcattcagtcgtttccctgcatcctgcgcaaacaaaccagcgccgatcagaaacggaatcacataataaaacaaccgataaaaaagcagccaaacaaccgcaacattgctatcgagtcccatttgaccaagctcgacaatcatcaggacatcaaacgaacccaagccgccgggcaccatcgaaacgaccccgataacattagccaccatgaacaatggcaaaatcgacagcaacggcacatgcacttcaagaaagtacccgatcaacaagaagaatgcagcacaactgccccactcaagaaacgagcccaaggtcaagcgcagttgccgcttcaacggcatatccgcaaaaaattcgctatttcgtaaatgggtgaccaacatcaacaacggaaaataagcggcaccgccaactagccaaatccagtaattcgagaattcctgaccaatcccgaacacgaaaataaccacgatgccaatcatcgaccacaatgacagtcccgccaacaaaaacagtgctattttcgaaatggcaaatagaacctgcttttgggtcgccttttcgtggtagaaattggcgcgcaagctagcacccaataagccgccaaaaccggcaatattggtaaaagtattgacgatccagccggacttcacaacatacctgcgtttataatggcccggcagcagttccgtgattacaaaatcataaatcagcattggtgtgacggcgattaagcccaccaccaacaaaatcagtaacgaaaccggactttgggttgccaggctggctcgcatttgctcgccactgagatcctgactgatccgtccgacttgaacaatcacaaacaccaggactgccaacacaaatagcacctttagcgttgtgagatgtttttttaaaaacgttccgacttctcgaaagagtctcttcattttttctgcgtcctccgtgcctgtattctcattcattatagggaaaacccgcctcggccgcactcattctgacttttttgtaagacggtgtaaggttgcgctgacatctgaaagcacgccaaaaatttttgaataaaaacgcttgacctgaaacgcgttacacaaattacactgtgtttgcagttaggaaataacaaatatgtgtgatcgccattaagaaatcaattgttacatcagttgttttcgcgactgttccaccgatacaaatcacacttgttaatgaaggtccctgaacgtttcactaaaggaggatgcaccatgttaatgcaagcacacttttacccagaactttccgtttatcaagacacacaaatcggtgctttgaaaggtattgcactgaaactaaccaatgattatgattttgactatcaagaagtattgagttctttgctggccagtgccgcggagccgacgcaaacgatgggcgatcaagtggtactgacgtatggtcatgtcagcaagttgactgaaccgattgtcatcggctttgactttggcaagtccttaccatgggccggtaaccatcagatcagcggtgctgtggtcttgctcgtcccagtggcaaccgatgatgttacgatccacgagtggctggcaaccattgcagcagctaatgatcccgatcaaagcctagaaagcatgacccaaagtgcgactgccgcgattgcctaaaatgtgtgcattaccataggccgacatgccgggtggcgttatccaccacgcgcatgccggcttttgcctgttacaaaaacaggctctgttatactgaatggggagatgataatgtggcaaatattcacgatattgcgcggctttcaggctattcaacggcaacggtttcccgtgtcttgaatcgccatccctacgtctcggcttcggcacgcgctaaaatccaagccgtcattgatcagctagactatgtgcccagcaccatggcgcaaaacctaagcgctggcaaaacgcgcacaatcggcgttattctgccgcacaccgaccatccttatttccaacaattggtcactggcatactcaatgccgctatggctggcaactatcacgctgttattctgccttcgcgttacgaccagaacctcgaagaaacctatctggaagccttacgccgccatgcttttgatggacttattttcacctcccatgggctcagtttgacaacgattgccgcttaccaaaaatatggtcctattgtcgtttgtgaaaatcccggccgtgtcaaattggcagctgcatacgccgagcggacgcccgcttatcgaaaagcgtttaaatggatgcaagcgcaaggttatctcaaaattgctttgctgctaagccgtccgtacgcgcaaagtgctaccagtaaactgaccatcaacagctacgtagacgttttcgggcaacgtcccccacattcgctggtcgtttatcaaatgcggacctttcaggatggctatcacgccggcgctgaattggcgccgcagcatcccgattttattctcggcaatggggatgatattgccgctggcgtgcgccaatattttgttgatcaccatctcccggtcccaccactgatgggtcaggaagatcagctttccagccatttgttgaacatgagcactattgatcaccatgtcacggcaatcggtgcagcggctctaaagctggcattgcgggcagaagtcgcgcaaacggtgattcagtcggatttaattcttcgagattaaccttaactcgtcagcgctcatcagcatataaaacaattcaaaaacggcacgcaatgacagggaccaccctgattgcgtgccgcttttgttgaaaatggaaccacgaacctgaacttcgtgacgatcagttaatatcgagaatcactgagctcagtgcccgtcgttaatgttctttacgccgacgattaaccccaagaaacccgacgatgcttgtgatgaaagcgccgaggaatgccaacccggctgtctgagtgacttcggccgttttcggcaaggtgtctttcttggatgcttgctgatttgtaccgtgtgaggaagtgccaccaccttgaccagttgatgtcggtggttgcggtgtcgtgtcatctttcccagccgttcctagtggttgcgtcccgtcgccggttggtgtcgatggttgttgttttgtgtcagatggcgtgccaccgccatcacctggcgtttggccctttccggttcctggattcggcgtttcgccaccaccattattcgaatcgttagttgcgccaccgttgttcgaatcgccgccggtatcaccgccacttgaaccaccattattggagctactgccgctgcctccgttagttgtgccaccgttattcgaattgctaccgttgtcaccagcttgtttagcagcctcaaccgccgcagcaattttggtctttaagccaaacaagccttgtaactgagcaatcttctgtgtgtcagtggttgctgtcgtcccagctttcaacgcggaatcaatctctgcgtaccaagtcagaccagtggtagtgtccttagtatcgccaaccgatgccggggtgccgtctttaactgttttcgccaattgcgtcagggccgcatccaacatcttattgaagttggcatcaagttggtcggcggtactcgtgccggccttggtttctgcagtcaacgcgtctaactcggcattgaatgtcattccggttgctgaatttgtctgaccaccaaacgttgttcctagaacatctttagccgactgtagtttattaagcagcgcatcctgttgatctgctggcaatttaagcgttaactggttgagcgctgttgttaactgattggtggcagttgccagagagtcgatcgttgcatcagcctgattcaacgccgcttgtgccgtcgtaaccgcggaattcagcgctgtaaccgaagcgtcgagatacttgccggttgcggctgttgtccttgccttggaaatcagatcctgcaaggccgttttagcctgctgcagttgagcaggatcatccgtcttgatattcttaacaacatagtctaccgctggcgattcgttgccgtacaagtcaacagctttaaacttaaaggtgccattagccgtcacatttagaccatttgccggaagatcctgatacgtcttgccgtcatccgcactgtattgaacggtttcaccagttgctgcggctttggcggtcaacgtcacctgcttagccggatcggtcgtacttggcgcgacagttggtgcagctaaggttttctttggttcgtaatacaccgtcagcttcttggtggtgacattcttgccactgtcagtaaccgcaacggttaaaacatttttaccttcgagcagtttcacagtctgatcaattgccatatgtcccggtttgccgctgttcatatcgacatcggcgtactggctggcaacgttgctgccgttgatcgcaagttccaggtaattcacattgtcagtcgctgttccggtaatcccgaaattaggatcattcgtgtagaccggtttgtcggcgggctgatccaatgacaacgttggtgcgatcgcatccaaagtgaacgttaaggcctcttggaaagtcttgttttgggtcgtatcgccaacaacaacgccaaacggtttttgtcccgcggtgcctaagttcagcgtgaaactgaaggtcagatcattcttaatcggtacttgcttcccatcaacctgcagtgtcgtggttggatgcttgactttaccggtgatggtcgcgatcccggtcttcgcatcatagtatttgacctgcttaatgttcgacagatcgttcgccccgaagtgaacaccttcatcgaaggtcactgcgtcctttagcacgtcagcgtcataggtcgagtttaccttttgctctttaaccgtggtgttgccatcttcatcttcagctgtcactttcagcgtgttgtcaccataattgaccggcacgtcgacactgaactgatgcttgttatccaacgttaccggtgttttggtgctgccgtttgtgatcgtgacttgcttcgtatccgcactggcagttccggtgactttaaccgtgctttcagaggtctggtcttggttattgttgatcttcaagtcacggaaagtcggcgcggtcaggcgaacatcggtgtcaaaatgctttagcaactgtgtgtgcgccttgtcggcatacagatcaaccttggtggcgtaatcatccgccgttaatgccatggaggcggtgaagctattagttgcagcatcatacgaggtcgtcaggtcatgctttttgccttgtgcatcggtgtaggtgccataaaccggcgcaggatacgtaccactaaaggtatacttgccaccttgcttgcctgcttcatagttctcggttgtgcttgaaatcttatccggtaacccaccgccattgacaatcagactgaaggtcgttgatcccggtttctgaaccgcggccgattgatacgtcgggttcgatgcgttatcagtgaggtaaacttcaacctgattatcaccttcgcctaaagcttgcgcctgtttatccgtcaaaggcacttcgagttgtgtgtaaccgtcagcagtcgtgccggtcgttgtgaacgtcccgtccagattggtgacgtcattaatggatgttttgatatcctttgctgcatccaatccactgagctcatccttggcttcgactttaagatagtacgccgttttcccgttttcatttttggaggttaacgacaggttgcgaacatccggcgctttggagtcaagcttgaacggcacatcgtaagtctgccgcttgttgccgccttcaggaacacctgaaagtcgatacgtgtagcttccatcttgagcagtcttaatgttgccatcccgctgatcgtagtaagtgccatcccaagtcggtgcctgataataaatgtacataccagcatttgcatcataataagtcttcgtctgattggtcgagctgctaagcgttgtcagcttattgccttgcccatctaacacgtcaacctgaacattgctgatgttgcgcagtagataatactgcatgctaattccgttataaatagcatccttgctactggagatagcaatggccttttcatcaatcgtcgggttaccactagcatcgttcaccaggccgccaataaactgattctttgttttgcgactggtaatgacaggcacagtcccgtagttaccactggcaggtgcataagtctgaccgttaatgctatcgacaatcttgccgtcattccaatcaccaaagaagcccatgtatggcagattcaatcgcgaaccgtcactgcctttgaaattcaggaagccttcgacaaattgctgttggtcaaaagatttaggcaacgataacgtgaagcccacctgaactgactggcctgccggtaccacgatttctcgatccggcttaatcgccgcaccattgatctttttatcatagagcacaccagaatttagatcggtcgcggaagtatagacagcattggtatcttcgttactgtccatttgataagtcagctcatgcttggtgcggttagtgaaggtcagcttgaacgtcttgtcggtgctggtaaaatcttttaattcaactgccggatagccattttcggaaacaaccgtcgacgggttcttttccagcgcatcgatggcagccttaacatcgacaaaccctgccccttgccgccgcggcgagacaataacgttgttgtaattgatgtcgttgaccggctgagcggtgttcatctcaatagttttaagaaaatcggtcaaatccgtgccttttaactgtttgtagtcagcgtagaacggattgtccttgttgttgagtgcttgcttcaacaaagcttgtgagccggcgatgaacggcgacgccatcgaggttccagacaagttagtgtaaccattgttattttgtgtggaccagatattaccgcctggcgccgtgatatccggcttaaaggccagattggaaaccggaccataagacgtaaaatctgacatccggtcggcgttgtatttctggttaggtaacaaggccaacccgattttgacacccaattcatcattcggatgcgccgttacccagtcaaccagcttctgaccggtgacactggacaacccaaatgtcgggaaggtcgcatcgagtttgatcgaggttagcgcagtagctgtcccatcattgttgacgatgattaagccggatgcgcctgcttcttcggcatacttttgcttgtcggtgaatgcaatgtcgccgcgcttgacaatggcaatctttcctttggcgtcggccgtgtaatcgctggcaccgccgatgctgagtttaccagtggcatctttcaccacgtagaacttcttcttgtcaaaactatcgataaaatcgttgcttgaaagttgaatcgtctctggtccgagtttcagaccgctgccatcggtaattgtcgcgctttgaccgatcacatcggtattctcagccgacgccacagtggttgcaccacgcgccgtcccgggactgcccactgtttcgttatcctgcaagccataataatctttgttgacgccctcggttgccgagccggatgtgccggagttcccggcggaaataaccgctgccgtgcccgattcattggcattttggaccgcggcaatttccggatccgcaagcgtttggttgccggaaaccgaaccaagcgacatgttcagcacatccgcccctaacttggccgaatcttcaattgccgaaaccaacgtcgatgatcctgtcgttgaggaagtatccgaattggtgaacaccttcatcgccagcaattgtgattccggagcgacgccgacaaccgatttggtcggatcacttcccgtaccatttgctccgataatccctgccacgtgcatcccatgctgttcgtcaacggtatcatcggtaatggtgtcattgttatccgcatagttaaacccataaggcactttgtcggtaaaataccggccatgcttagcggttttggtaaattgttcgacatccgctcgctttagcttggcctttttgtcatcactcagccgcatatccttgtgcgtcgggtcaatgccagtatcgatgactgaaacaacggttccttcacctttgtatttgtaattggaccaaaccgcctggacattcgccatcgaattggccttggcatcggtcggataataaactttggcgagtgtgacggttttgacaccggcaatttgcttcaactgcggaatgtcagccactctgaccttcgtggtaaagccattgaccacatagccataactttccccggctgcctggtgggtcacctgttcaaccgcggctttcacgcttgcttgcgcggcaatgaccttgttcgtctcttgttgaatctcggcggtgctggagtaatccgtcttcaaggtgccattttcagatgcaggtgctgcactcatctgaacaataacatctacataagtatcctgctgttgcaccttgttcagcttgtgataatcaatgccttttgccgctaactgggttgcaatggcctgattcgtgacggcgcttgttgtatcggtcgccgtttgtccggtcgcaacggtctttgccagtgacttttccttggtctgttgcgagatagctgccttagcctggacctcgccgaccggtaaaaccgccagcgcgcccaatgcaacagtgctggctaagagaatagatagccctttctttttcgtttgcatccaataccctccaattcccggtagttccacaaccaatcaaaaccctgctcgatatagttaggattatatacgattaaaaaagactttcaacaattttcttaatcttaacttaattttcttatctgtaaattttcatctatctttgtcacatcaaggaatcagaattcattttttcaattcaaaaattagattatgtgattatgaggaaatatattgagttttttaattttaaacgttaaaatgtagccacgttatgctgtcagcttgtcatagggggatcaatgaaatgaaaaacaaactgcgcgttcaaggcttgttagccatgatggccgcatcactcgtgctactgaccggatgccaaaccaaacaggcagatggtccgactgttgcaacttattcaggtggacaagttacccaagcgagtttatacaaagaactcaaacaatcgccaacagccaaaacagttttggctaatttattgatttaccgcgcgctagaccatgcatacggcaattccgtcagcaccaaagctgttaacaccacttatgacagctataaaaaccaatacggtgaaaacttcaccagcttcttaacgcaaaacggcttcagcaaagccagctttcggcaaagcattcgtaccaacctgttaagcgaagtcgcacttaaaaagcttaagaaagtcaccaacagccaacttaaagaagcgtggaaaacctatcaacccaaagtcaccgttcaacatattttgaccagcgatgaagcgacggccaagcaagtcatcagcgatttagcagctggtaaagatttcacgacattagccaaaacatattcaatcgataccgcaaccaaagacaacggcgggaaagccagctttgaagccagcagcaaaagttttgattcgacctttaaagatgcagcatacaagttaaaaaatggcgattatacccagtcaccggtcaaagtaaccaacggctatgaggttatcaagatggtcaaccatccggctaaaggctcttttgaaagtaataaaaaagcgctgacagctagtgtttacgcaaaatggtcgcgcaattccagcgtcatgcaacgggtgattagtcaggtgttgaaagaccagcacgtgacgatcaaagataaagatctgtcagacgcgctggatagttacaagcaaagtgtcgcgaaggattagtttcatatggatcctgttaaagcagggttcttttgcttcgagacttatggcatcgattccacaaaaccaatcaatttatacacatcaaaaaagcaccctgctcaaccacagccttaacgactgtgttgagcggggtgcctttttgaaaatgaagcttaattatttgagggttaccgttgcgccaacttcttcaagctgttccttgatcttgttagcgtcgtcttcggacaagccttccttgataaccttaggagcggcgtcaaccagacccttggcatccttcagaccttggccagtgatttcacgaacagccttgataaccttaaccttttcttggccggcttcggtcaattcaacgtcataggtatccttggtagctgcagcgtcgccaccagcagcggcaccggcagcaacaggagcagctgccttaacaccgaattcatcttcgattgacttaactaagtcattgagttccaaaatggaagcatctttaagttgtgcaatgatgccatctacatctaaagccatgttttgtttcctccgttttttaaatagtttgtaacgtcatattatgcagcaggttcttcgtctttggcttctgcaactgctttaacaacaagtgcaaagtcgcggacaggtgcctgcaagacagaagcaagttgcgacaacagaccttcgcgatctggcatcttggccatttccataatggtgtccaaagaagcaactttattttcgatgatgccgcccttgatctgcaatgcatcaaattggtcagcgtacttggccatgatacgtgccggagcaacaggatcgtcattggagaaggcaacggctgtagggcccttgaaaacatcgtccaatgcttcgtaaccgttggcatcagcggcacgacgcaggtaggtgttcttcaggacttccatcttaacaccggcctcgcgcagttccttacgtaatgcggttacttgctcaactgttaagcccagatagtcaacaacgacagcactggtagcattcttgaattgttcagaaatcgtcttaacgagttcagctttttttgcgatagcttgttcactcatgtttttcacctccattagtttggttgaagtttttagcaataaaaaaactccatgcctaccaagacatagaggtatcttatgtttccgataccacctcggcaggatgattaaggcttttacgccccctgagtcttaggcagagtgactaatcacaacgagtagaataccatggtcgccaagccatgtcaaaattatttggcgttcatttgcgttttcaggttcgattttcagtctgcttgctgattgtatcccttttttgattgcgttatattaattaggtaactattttttctgaaaggaagttggcgattttgccaagtaaacttaaaagtctcgaaccatggcagcaaaatctggctgtcttatggcttggtaccttcatcgccggcatgggcttcagtgaagtctcaccgtttatttcattatatgtcgaccaactcggcgattttacgaaaggccaactcagtatttattccgggattacctttggggttaccttcatggtcgttgccattgtcagtccgctttggggccgattggctgatcgccgcggccgtaagctcatgttattgcgttccagttttggcatggcgattatcattggtgcctgcggattcgtgcacaatgtctacgccttgatcgcgctgcgttttctgcaagggctagcggcaggctacatccctaatgccagtgcgttaattgcgaccgaaacaccgaaagccaaaagcggaacggcgattggcattctcacaaccggttatgtttccggtaatttaatcggcccgattctcggcggttttctcgcccagacattctcgattcggctgacgttcatcatcaccggcgcgttgctgctgatcgtgtttgttctaagtctcacgatggttcacgaacactatacacctgatccgcgcctgttgaaaaaggaaaaacggccagggctgcttacccaagtcagcaaccctaaagcaattatggtgctcctcatctcaactgcaatcattcagctaggcaacatgtcgatctacccgatcatcagtctttatgtcaaagaattgatgcataacgtcgggccaatcacggttgtcgccggcattatcgcggcactacccgggatctcgaatttaatggcggccccgcgtttaggtcagttaggtgatcgcatcggttccggtaaaattctggtcagtggcctgatctttgccgtcatcatgtacatccctcaaggcattgtcggcagtatctgggcgctaggctttctccggctcatgatcggcgtctcggatggcgcacttttcccgaccatccagaccctgctttctaagctgacaccagtgagttataccggaacggttttcagttggaatcaaagcgcccaggcatttggttccatggccggatcactggctggtggttttatctccaatatttttgactacaacggcgttttcatttttaccgcgttatgcttagcccttgatcttgtgatggtctggacgttcattccgcacatctggtccagccgcccgcaacagcaggaataatcgtctgctgtaataagtgataacagaatatttgtattcaaaaaggttccgttgaccttaaatttgtctgcggaacctttttgaattgtgtctgtcaacaagcattagtgcaacaacagctgccatgtgaccagaggatgcggatcaggaatcgctagtcggcggtagactgcccaagcatgcggatcggtatcatcaaattcaccgttaaccactcgataatttgcctgaaccagcggtaaaacggcctgcatcagtcgtaagatatcagcttgcttgaccccgccgagccaggcacttatcaattcaccaggttcatcttcaaaccagaacgcataagctcggaccctattgcctacaacccaaaaaccgggctgctgcgaatcggcatcactcaactccttctcaaattgagcttgcgtcatcgtagcaggattaactgtgtgtgcacttacgtatttttgatagcttagctgaaccactgactgccactgagttgccgttaattgagaacgtgatttaatgccgcggatcgtcgctgtcggttgcaacgttcgataagtgcccatggcggtgtggcgaatgacctgaaaacctgcctgacgcaattgttgcgtaatatctgacgaaaaatcatagctgctaaattgcaaccgatcgtgttgacccgctaattgcttaagcattgggatcagctcagctaaccggatgtttcggccgaccacattgaaatagagcgcacgcttatgataagtattttgccacacagccaccgcatattgtagaggccccgcttgaggaaagccacggatgattgctgctttgttaccaaaaagctgattcgtccattgatcttcgccttttaacaaaggttgcaattccgctggcgtgacgcttcgccccgcccctggctgccaattaatcattgtcctcagtatcctttttatgatcccaagtaccatgcaaatgcaggaacccgtagccaaaccggcaaatgccgtacgcgattggcaacatcacgccgatccagaaatgatttgtcaggtaatattgcggtagcgggttcatgtccatcgcggcttcataagccatttcaatcgcaaaaatcgcgactgccagtaccagcgcagacaaaacgccgcgggcaactgccagccaaacatactgatgataagcttcaggcgtatcaacttcaatcacctgcagtcggtagtaatgtaagctgaccgtgttcatcaagccaatgatcaccgtcaccagcaacagaatccatgtgcttgcagtaatcattttcaaactattggcatcaataaaaatggccgtcgcactggcaatcagcagcattaactctgccgtcagcatgttgcggcccatgatcgcgtcataagttcgttgcttgaagcgatccttaagtgaaatgccgtaataccattctgtgattttcttcataaaactttgccttcctcgctttttgctatgttgttccatcttaacatgcagcatcgttcattccccaaagttgatacaagttttgaaaattattttgctttctaaacacttgaaatcattgaggtcttatccgcttgtgatgcatctcatgaaaattcttattgacagcaacccgcttttttgatgaaattaagatcatgcaaacgggtgtcaagacacccaacttgtgaggaattcatcaaggaggagacaaatgacaaagaaagcaccgagtcatgcgcggttgatcgtcggcattggcattgcctggctatttgacgcgatggatgtggggatgctgagtttcgttatcgcagccttacataaggaatggcaactaagtactgttgaaatggggtggatcggcagcgtcagttcgatcggtatggcggttggcgccattttgttcggaatgatggccgatcgttttggccgcaaagctatcctcattctcacacttctggtcttttcaattggaagcggcatttccgcttttgcaacgggttatggtattttccttgttttacgctttatcatcggcgctgggttgggcggtgagctgccagtagcttctacgctggtctccgaaagtgtgccggtcgaaaaacgcggccgcagcgttgtgttgttagaaagcttctgggcggcaggttggttgctagcggccattatttcctacttcatcatgccggtctggggctggcgcgttgccgtttttgcaactggtttagccggcctatacgccttctacttccgcgaaggcatcaacgaatcacgcgccttcaaaaaggttgcccgcccaagcttgatcaaaacgctcacgacactctggcatccgccttacgtgcgctcaaccatcatgctgtggattgtctggttcatggtcgtcttctcctattacggcatgttcctttggctgccaagcgtgatggtcctcaaaggcttcagcctcatcaacagttttggttatgtgctgatcatgacgttagcccaattacctggttatttcgtcgcggcctggttgattgaaaaatggggccggaagctcgtcttgagtctgtttctcctcggcacagccgccagtgcactggccttcggaatggcaacgagcctcccaatgctattaactgccggtatgttgctctcattcttcaaccttggtgcatggggtgccctctacgcctactcaccggaacaatacccaaccatcgtccgcagcagcggctcaggcatggcagccggcatcggccgcatcggcggtattgtcggtcccctgcttgtcggccacctgttaggcgccaactggtcagtcaccagcatctttgccatttttaccgcatcaatcctcatcgctatcgtcgccatcgtctttttgggacaggaaaccatgggggttaagttggttgattcgattgagacagcgccgtcaaagtcataataaatgcctttacgcgtaccggcatctagaataatttaaaaaagaggacaaccattcgcgcgggttgccctctttttttaatgccaagcaaaaagagtggtgcaagaaacgtgtagacgttcctcacaccactctctatttgtgtcaaagcttagtcgcgtaacagtgtttaacgaccatcgttactcagctttactttgatgttttgtcatccttgcgacgtctggttcctgcaaggccgaacaatcccatcagactgaccataagcagaccgagaacaggagcatcttgatcgcttgcctcactggtttgcggcaatgtgtgtttaccactattgccattttccgatgatgaacctgtctgacccgctgtaccaccggttgttggcaacgtgttgctgctaccatttccggtttgcgatgatgaacctccaccattagcggagttgccaccattgccaccgttgcctgactgcgcgccactgccgttgccaccgttacctggctgcgtgccactgccgttgccaccggcaccagctgcgctcgatgacgagcttgaagatgaactgctaccaccgttgccaccagctgcacttgatgatgagctgctggacgatgagccgttgccaccggtattaggtaagacttggtgacttgcggctgagcttgctgcggcgcttgcggcactgcttgcagtactttcagcactggaggctaccgagttatctgagcttgcagcacttgcggcactggaagctgttgagtcatcggaagcagcagcacttgcagcactgcttgcagtactttcagcactagatgcagtgcttgctgcggaacttgcggcactggaatagctgcttgcggcactgctgtcgccggagtttgcggcgctcgatgcggcgctggcggcactgcttgcggtacttgccgcactgcttgccgttgaatcagcgcttgaagcaatgcttgcctgattgcttgcatcgcttgcagcagacgaagcagttgatgattcgctgcttgccttgcttgcggcgctgcttgcttggcttgcggcactggatgcggtgcttgcatcagacttgatcccgctatcacttgggtagttggatgcagccgaggatgcatcacttgcatgacttgccgcactgcttgcatggctgtttgcttcactggcacttgaacttgcctgtgacgcgtacgagctggcttcgctagcactggagctggcgttgcttgcgtaacttgaagttgccgacgatgcattacttgcttggctagcactggaacttgcaccactggcatcggacttagcagctgctgacttctcagccgcactagccgcgctgcttgcggtacttgcagcactggatgctaccgaattgtcggtgcttgcagcgctcgcagcactggaagccaccgaatcatcggaagcggcagcacttgcggcatggcttgcatcactttcggcgctagatgcagtgcttgctgcggaacttgcggcactggagtaactgcttgccgcactgctgtcaccagagttagcggcactggatgcagcactcgcggcgctgtttgcggtacttgctgcactgcttgcaactgaatcagcgcttgaagcaatgcttgcctggttgcttgcatcacttgcagcggaagaagcagtcgatgattcgctattggcgtgactagccgcgctgtttgcggtacttgcggcgctggaagccgtgcttgcatcagacttgatcccactatcacttggg

SEQ ID NO: 323 - DNA, 757 bp, Lactobacillus casei
attggcgtgactagccgcgctgtttgcggtacttgcggcgctggaagccgtgcttgcatcagacttgatcccactatcacttgggtagttagaagcagctgacgatgcggcacttgcttgactcgaagcgctgcttgcatggcttgttgcttcactagcactggaactagcgttgcttgcatatgagctggcttcactggcactagagttggcgttgctttcatagctcgaagttgctgtcgatgagctatcagcaccacttgcactggaactggcaccactagcactggagctggcagcagacttatcggctgcagacttttcagctgcactagccgcgctgcttgcagtacttgcagcactggatgctaccgaattatcggtgcttgcagcacttgcggcactggaagctaccgaatcatcagaggctgcagcacttgcggcattgcttgcttgactctcggcactcttggcactgctcgaggcagcacttgcggcactagagaaggcactggcagcactgctgttaccatccttcgcggcactggatgcggcactggatgcactatcagcatctttggctgcgctacttgctttagcatcggcgctcgaagcgatgcttgcttgatcactggcatgacttgctgcagaggaagcagtcgatgactcgctattggcgtgactagccgcgctgtttgcggtacttgcggcgctggaagccgtgcttgcatcagacttgatcccactatcacttggg

SEQ ID NO: 324 - DNA, 34320 bp, Lactobacillus casei
attggcgtgactagccgcgctgtttgcggtacttgcggcgctggaagccgtgcttgcatcagacttgatcccactatcacttgggtagttggaagcagccgatgaagcggcacttgaagcactgtcggcgctgcttgcatggtcattagcttcgctagcacttgaacttgcctgcgatgcataagatcctgcttcgcttgcgctagaacctgcagcactggcatagctagatgttgcggtcgatgagctatcggcaccactcgcgctggaacttgcaccgctggcatcatgcttggcagcatcagacgccgcagcactggctgcactgcttgcggtcttatccgcatcactagccgtcttatctgcatcacttgcaacactcgcagcactggatgctagcgaatcgtcagaagccgctttgccagcggcgtcactcgcctgactttcagcactcttggcactgctcgaagcagcactcgcggcactggagaaggcactggcagcactactattgcctgctttagcggcactagatgcggcactagcagcactgtctgcagctttggctgcgctacttgctttagcatcggcgcttgaagcaacactggcttgatcgctagcatcacttgcggccgatgatccagccttagcggcactgtttgctacacttgcatcgctctttgctgctgcagaactttgtgcagcactagcggcactgcttgcagcggcattcgcgtcactggcagctttgtcataaccagccgcagctttagcagcagacgatgctaatgaatcatcggaagctgctttgccggcggcatcactggcaacggactcagcactcttggcgctgcttgcagccgtacttgcagctgtggagtagctagcagcagctttgctgtcaccagccttggaagcactggctgcagcactcgtgttggcattagcggccttagcggcgctacttgcgacaacatcggcactaccagcggtcttagcttggtcactggcatcactggcagccgctgaaccagctgtggcggcactattggccatgcttgcattgctatctgcttgcgcagcagcactcttagccgcatttgcatacgactggatcccgctatccttcggataactggaagcagctgaggcagcggtgcttgcatgtttgtcggctgtgcttgactgacccgttgcgtcactggcactggactttgcattgtttgcataggaaccagcttcactggcgcttgaacttgcagcactcgcatattcatgcgttgcggtcgaagcactgtcggcaccacttgcatcactcttcgctgctgcagaactttgtgcagcactagcggcactgcttgcagcggcattcgcgtcactggcagctttgtcataaccagccgcagctttagcagcagatgatgctaatgaatcatcggaagctgctttgcccgcggcagcactggcaacggactcagcactcttggcagtgtctgcagccgtactggcagcagcagagtaactagcggtagccttactgtcaccagccttggatgcgctgcccgcagcactggcagcactgtttgcagtacttgcagcagtacttgcatctgtatcagcactggcagctgtcttcgcttggtcactggcatcactggcagcagttgatccagccttagaagcactattagccaagcttgcattgctatctgcttgagcagcagcactcttggccgcattcgcatacgactggatcccgctatcctttggatactcagaagcagctgaggcagcggtgcttgcatgcttatcagctgtggtcgattgacccgtggcatcactggcactggaactggcatcctttgcataggaaccagcttcactggcgcttgaacttgcggcactcgcatacttatgcgtcgcggtcgaagcactatcagcttgactagcactggaactcgcaccactggcgtcactgtttaatgcatccttgatcttattcaaatcatcaagtgcctgtttgcttgcagctgatgcagcagcagcactcttgacggcttcgctttgagcggctgcagctgcaacggctgcactacttgcaacgattgcatcgcttgcggccacttttgcggctgtttgggcatcagacaatgccccattcatttgcgcagcagcagaacttgcggcagatgacgctgttgcaaggcctgccgagtcattgactgcagaagcagcactggcttcggctgcgtatgaatcatatgcagcggcagcagaacttgctaaggcatcgtcactggctacggcagcagccgcggatgatgcttcactggcggcgcttgctgcagatttagctgctgcagcagcggcggtcgagttcttgcttgccgcagcttcggcgtcagatgctaagcttgcctgcttctgggcatcgcttgctagtgactgaatcgtcgcattagaagcctgactcttggcaatcgtctccgcttcacttgcataacttcctgcagcacttgcaaaactgtttgttgctgcttcttgcgaactagttccgtcagcggcagtgctcgttgtctttgaactatcagcagcactagaagcctgttttggtgtttcggcatcattaacaaccaccgttgcggttttaacgatgaaggcatcgcttgaaaccactttaaaggatgtatttgctgtcaatgtgacaccggcaggcagcttataactccagttcccattgtcatcagcttgtactaaatacttggtcgaatcatatgggtctgccgtcagagtgccagcaggaagtccctttaacccggtaatcgttacataaccatccgcaccggttttacccgtgagttccgtggtttcgttggtaactggatcaacggtaacaaaattatctgcagctgtgacaaattcaagactagtatcagttgcaaaatcatttgcaaggtcctcgcctgaagtttcagcgtccggagttaatccttgaaccgtcgctttcgttgatgtagaacccttaccacttaatgcatatgaaacagatttatatgggccaaaaggattcttaccattgtcagggataatcttgacatattggccagttaacgcaccactgccagtaacatcgaagatactagaagcactattcgtattaccttcaatgctgaaaagaattgacttcggcatatagatattgatctttgagttattgccgatgttgagtacatgggcaatacctgtgccaccattaatagtcagcttagcagttgcatcctgggcaaaactcaattggctactacccgtcgtcttgatgacgttaatcgaagctgcatctgtccctgtcacattaacggcaagggtgctgccgctcgcaacataaaagccgccactaccagcgatattaatgacaccattagtgccgaacgtatccccggtttggttaatggtcattgatgaaccttcattaaggttgacagtaccattaccgacaatcttaatcggcgtgttaccagtcgcaccatcgatattaacaactgcatctttgtcgactgttaaattggcaccagtgtcgatataaatcggtgagaagttagtttcttgaagcttattcttattaagagtaaccttcgatccttctttaaactccactgaaccacttgtatagatcagtgcattaaaaccgtcttcgttggcgccaaccgcactggttctctgcaggtcaacggtcgcacctttatcgacaataaacgagccaccgttgtgaacttgaacagccgtgccactataagtagtacccgtataagtagcaccgcttttgacttccatgtagctaacttcaaagttttgctggccaccatcaccgggctgagttgattggttcgattgatcgaacggtgaagtataggattttacggaattaaccgttgtctttccgtcgatgtaaaccttcgtcgttctcccgaacattaattgggcaccagtataggtgacgttattgaaggtcactgaatgatcatagcctgagttagggttaacccccatgatggtaaccgggccccagtaactgtagccgtacatggtcaaatcattgatcgtaagactttcactctcattggcctttgcatctagctcgtaccagtgtttgcgaaaatcaatcgtgtttccgttaccattgatgacaaggttcggacgataagcatatgactgtcgatcagcacctgatacgtcatcaacgaaactagatttaacattaatctcgctgacagctgagttcgccatagccgcattaaaatcagaagccgtgcttacgtcaacgctggagcctgaatcagttgcatctgaacttgctgcaagtgtgctctgtgcagcttttgcagcactagcactgcttgcgctggcgcttgatgcactggcagcactctcagcggcacttgtcagactggcactgctgctgttcgcgctattactgctcttaccatcgctggcagaactgctgctaccttgactagcactgccatcgctggcgttgctcttgctgttgcttgaagcactggcgctagcatcgctcttactgccctggctggcgctggctacgctactgctaccttgactggcgctcgcaacgcttgcactgccttggctagaacttgcaacgctgctggtttggctgctactggcagcactgttactgctgtctgtactggcagcagctactttactttgactagcgctagttgtgctgctttgtgcagctgcggcagcgctgctactggcgctactttggccgctactagctcccgatgaagacgcttcagtatagacggaactgctgggcgtttgaacatcagctttaacttcgtttggttcgaaggctgttcccaacccgacgccaaggaagaagagtggtgcaattaaccactttttcttcgacttgaacatcttgtatcgtttcttctcgaccaaaacattcgttctctttacctttttcatactcaagatcctctcaaaaataattgagcaaactaaaaatgcttagtttccgacccattctcctcaaagcagttcccccgtggcaccatctcctttccggaatatgctgttcacaactacctgaacattgacttaaagaaattcagaaagccctgatttccattcatcaacaaatgctttttctgagtgttgggctgcggtcttcaacgcgccagcctgtaaccggtgatacagctgctcatcttgcaataccgaaagtgccgccttgcccaaattgcttggcgtcatgttgtcgacggccaatccgttctgatcattgatcaaaaggttgttcttcaggaagaggcagccatacgcgacaaccggtactccggccgccatcgcttcaagactgttcatcccaaaagcctccgactttgccgctgaaacaaacacggtggttttcgccaaaatgtcgtgattgtcattgctgtaattgaccaagtgaacggcatcatcgagctttttcttgtgaatcttatcggtaatctcgtgatggtaatcatcatcggagaaataacctttaaggaacaattcggcgtccggacgggcttggtggacctgttcgaatgcatcaatcaactcagcaatgtgtttgtctgggaaaagccgaccgatataggttaaatgtggatgctcaggctctgactgattatcggcttgtacttcagcaaatgtgtccggtgatgacttaatcgttaaatgcggccacttagaactcaggctcttagcctgttcgcgggtggcgaagaagacggcagtgaatggcttttgttcgtccagtgcttcgtcgtaaatatggttaggtactttcttcttgccttcaccttcaataaacagatcaccttcatgaatataagcgatggtccctgttgcatgcgccacttgcttcacggctgcatcaagtgttcgccgatccgaaatcatgagtcccggcgttgtcttggtaatttcgttcatgaagaacaggaacaagctgtcttcggaatcaaacgcgtagtcatggccgtgatagttcattaatttccagagcgtcggcgcaagcttgccattcttgttcatgtgcacaatttccagcaccacatggccttgacgatcgaagaacttttgggcagcaactgtttcgtcaggattgtaattctgctccatcgatttgaacccgcgccaatcccagaactcggtcaattccttattgccaaaccgatcaaaataatcgatgctgccaaccaagcccacggtttccggcataacagcaatcttggcaatggttcgacccagaagatcaatcgttgtcaaattattatcgatgccgacaacgtggtatttcgtcaacggaatggaatccagcaagcggagctcctgctttttacgttcaaggccaacaactccttgaaaatagtcatacatattgatgtagtcatctttggccaagccagctcgggaagcatcgcgatataagaatcggttatagttccgcaccaacagctttgcttcaatcccgttgcgtttaaaagccttgagccgctgcatctgggagaattcagtgccggagttaaaagtgaagacattttcgccaaccatgtaaatcatttcgcgacacctccttccgtcttttctgcgtcttgtaggagattttgccatttgtgccaaacgttttcttccgaatagcgcttagccgactcgtaagcgttggtgctcatttgttgcattttgtccttgtcagcaaataatgactgaatcttctcggctaatgccttgatatcgccataaggagtgacataaccgttcacgccgtcctcgacaatttcgttcgggccgtaattgacatcataagtgacaccaacaacaccatgcgagatggcttccagcagggagagatcaaagccttccatgatcgaagtcaagccaaaaatctgtgcggtgttataggcgctctccagattctccgtataacccttgaaggtgacgacatcttctagcgacagttccttaatcgtcttttcgatcttcttcttctccgcatagttatttgttgcgtcggggtaaccatacaggtcaagcgtcacttctggcgtttgtttatgcacaatcgcaatcgcccggactaagttatccagattcttttccggtgcaattctggcaaccgcaatgaccttgccaaaaatacgattcttggacaaaatgcgttgccgattgagaacatcatccggaacaataccaaccggaatatcgaaggacttggtgatatatggaaaacgtttcgtaacatcaacggcttgtttcttagttgccgatacaaaggccgaatacttagcgccattgactaaggcgtattcatagttgttattcataactgaatccatcggccgctgggcatcgccggcatgtgaattgtgcagatgcatgactgtatatgccggcttgtctaagtgaatgagggcttcatccgcaagtaacgagcgatccaaaataaagacattctcgccactttcattgacgtcattgatgaagtgctcaaagaacgcatcaatcgtgtcaaactggaaacgtttgcctttacgatcggtcaggatccagccggtttgcttaattttgccgtcctcacctttcttgttaaatgccttaatcaccgggcggccatccaatgtcagccactcttcattgcctatcttgttgtctggcgtgtaccactgaattaatgacttgaacccgcgtgaatcataaaatgcaacctgataaaggttttcaacgccatcaaaaagttcagttgaaacaacctgtctagtttcacggacatagttaattcgcgcagccaaccgaccatcagctcgagaaaccaaaacgcggttacgtttatactcgtcgtcgtacttaagatctttaagacctaagtcaacctcttcaggcaaaagctgagcctgatcaacatgacaggtgtcctggtaataatcaaacatgttaatcagatgttcgtctgtaatccctgcgttagctgtatttgtatgtaaatcccgcgaccagtcccgcagcaaaaagcagtaggcctccttgtgcttatcaaaaagactcttgcgcttaagttcagcatgctcaatcccggatttactagcgggcataccgaagttgatgaaatagttcactcacaaccactccttatttgaaaagctcctccgtcagtaaaagggcaaatacgatcaaaaaaatctaaaaacgtgattatatgctctcctgccaaaggcaacgaaagtcctgtgaaagccactggaccaatctttcaaaggacttcttttcataaatatttaaatagtgacacacatattacatttatataatactattattgtcaaaaatattaacacaccactgtcatgaaaacggttccaatttttgactttttaactttcatgctgactttcacgcgttacgaacccgaatttctctcacggtgacaagcaaaaacgccatcgcaacaaaatcgcgatggcgttttctggaaatatttaaaagcttctttggctcaacctgccacggtgcaatgaccacctaacgcacatactaaaacaacgattacttgcgcagtgcccgcgtaacggtttgttcattaacaaatgtaaacagccccaaatcgccaagttcccgaccgtaaccggaatttttgactccgccaaatggcaattcggcattataactctgactttggttagcaccgaccataccggtttcaatctgcgcggcaacttctgcagcgtgattggtatcgccggcaaaaactgcaccgccaaggccataaggtacatcattggcaagctcaatagcttccttttcagagtgtaccttgtagacacaggcaaccgggccaaataattcggtgtggtaagcagggttatctttgtcgatgtctgtcaaaattgtcggctggaaaaaggcgcccggcagatcgactggcgtattgccgtaaacgaccttggcaccgtgctcgatcgccgtgtcaacctgaccttgaagcttatccttggccttttgactgtttaatgggccaacgtcaactgaaggatcgcttggatcaccgattttgacactttcaaagcccttcttcaacccggctacaaaatcgtcatagtacttatctagcacaataaaccgtttggagctggtgcagacttggccacagttcatcagtcgcgttttgaccgcttccggaatgacgctgctaagatcggcgccgtctaaaaccagaaaggcatccatcccgcctaattccatcaacgatttctttaagtatttgcctgcaagcgccgcaacatgcgaaccggcaccttcagaaccggtcagacaaacgccggcaacccggggatccttgatgaaggtctcggtatcatcgtggccgattaaggcaatttggaaggcgcctttgtccgcaccgcctgccagtacagccttttcaaattcgagtccactggccggtacgttacttgcaggtttgatgatgacggcattgccaaccatgaagttcggtgcaaaaacccgcattaattgataatacgggaagttccagggttcgacaccaaacacgattccggtagcaacgtgattcgtcactgcagcgccagccgtgctgtcaatcggctgcggtttcaacagtgccggcgcccgatcagcatacatgtccgcaatttcagcacaaagttcgacttcacctaaagcctcttccgtgcgcttgcccatttccttggtgataatcgcagccatttcatctgcattatcccggaaataagcggcaactgcgtgtaacgttgcggcccgcgttgccggatcaagattacgctgttccttataaaacgcatgcccggttgtcagcatttcgccgatttgcgcaggcgttgtgttcgcataagtcttctctaaagtgttcgtgttcggatcaacggtttgataagccatttttgtaaacgctcccttcgtgtccttacttaatcatagcgtattcccttgatagatgccaactgcataccgttcgcacggacagtcaaatcggcaaattccttgcagcccaaaggcgtacgccgactttaatttaacgcaaaataaaaagacccgccagtttcagcgagtctcaaaataatcattattttagaagtcagtcgggttaaccttgataccaggcgccatggtggacgtcagggtcaggctcttgatgtagatacccttcgtacttgctgggcgtgccttcaaaacgatgtcgttcatggctttgaagttttcaagcagcttgtcagcatcgaagctcttcttgccgattggggcatggataataccagccttgtcaacacgataagcaacctggccggctttgatatcattgacagctttggcagtgtccatggtaacggtgccggtcttcgggttaggcatcaagcctttcgggccaaggacacggcctaaacgaccaacctgagccatcatcggtggtgttgcaaccgcaacatcaaagtccaaccagccgtcttgaatcttttgtaccaaatcttcggcaccaacaacgtcagcaccggcgtcttcggcagccttggcttggtcgccttgggcaaaaacaatgaccttcgacgtcttaccggttccgtttggcagcacaactgcgccacggatctgttggtcagcctgctttgggtcaacgtttaaacgataggcaacttcaacggtttcgtcgaacttggcatagtcgattttcttcagcagattaaccgcttcttcaggggtgtactgcttgtttgaatcaaccgctttagcagcctctaaatactttttaccttttttagccattctgggttttcctccttgcaaatgtggtcactgggagatcagttttctcccttccacctgattacctcagttttcactgagaatccgaacagtgcgtcttagtcttcgacttcgaagcccatcgaacgagccgttccttcaaccatgcgcatagccgcttcaacatcggcagcgttaaggtcttgcatctttgtttcggcgatttccttgacctgagccttggttactttagcaaccttcttggtattcggttcgccggaaccatgttcaacaccagcagctttcttcaaaagaattgcagccggcggggtcttggttacgaaatcaaatgaacgatcttcataaaccgtgatgacaaccgggataatcatgccggcttgatcagccgtacgtgcattgaaatccttggtgaaccccataatattgataccggcttgcccaagtgcagggccaaccggaggagctggggttgctttcccagcaggaatttggagtttgacaatgtttgctacttttttagccacgagacatacctccttaagtccgtgatgtggttatgatggccagaagttttggcctcccacgcgtatgctgaaaacatacttaagtagcgtagcacgccgtctcacaaaaggcaagtaagattcaggttgtgaaacaccccgaatggctttttacagccacggccagccgtgttttaaatacatccgcttaacacattcaacaacgattaggtaagtcaatacgatgagcgccgcccccggccaataactaagtggcaacaccgcaaagtcaaaggcgcgatgcagcggcgacaggataaggaacaaacccaccaacaaggccagcatggtcgacaggatgacaatggccgatgccggagaccgccaaaatggtgtcacccgcgtccgcaaaacgtgcacgactagtgattgggtgaacaggccgacaacaaaccaacctgcctgaaaaacatgctgtgccggcaaactggccgcatgggcgccaattccgagcccaaaccataagaataggaacgttgtgatatcaaaaagcgaacttaacggcccaaatgtcaacgtatatcgcaacaaacccttagcgcgccatggcgtcggctcggctaacgttgcgtcatccacattgtcccagggaatcgtcatttgcgacgtatcgtaaatcaaattttgcaccagcagctgaatcgccagcattggtaggaacggtagaaagatactggcaaccaaaaccgaaaaggcattcccaaaattcgaggcgattgtcattttaatgtacttcatggcgttggcatagacccgtcgtccttcaagaatgccatcttcaagcaccaacagactcttttccagtaaaataatgccgcttgcgtctttggtgatatccgcagccgtatccacactgatgctgacgtcggcttcgcgcagtgcggcggtgtcattgatgccatcgcccatgtaccctactgtgtgtccggctgcccgcatggttttaataatccgcgctttttgcagcgggctcagcttcacaaacagatccgtcgactcgacagcctgctgtaatgccttatcgtccatggcttcgacatcatttcccgtgacaaccagctgattggcaatgcctacttcttcggcaacatgttgcgtaataatggcgttatcaccggtcaaaactttcacccggacgccgtggttccgcaataagccaaccgcctctttggcatccggtttggccggatccaaaaagcccagaaaaccggcgatcaccatatgctgttcgtcagcggtcgtataaatttcctgttgatggacgtcttgccgataagccaccacaatcatccgcatcccctgaccgctcatggccgcgtttgtatgttgaagttgcttgagccgctccggggtaatcggcaacacctcaccatgcagttccacccgatcacacaccgccagcatttcctcaaacgcccctttggtgatcatccactggtggtcctcgttagcgacaaccaccgtgagtcgccggcgctcaaagtcaaacggaatttcatcgattttggttaatcccgcgggcaaatccgccaaaatcgcctcgtgctcatgcgcgtaattcaccactgccgtatccatcaggttgtgccagccggtttgataattggcattcatatacgccattcgcagcaccgccggatcagtggcaccggtcgcgtcgacgtaccgcatcacgaccacgcgatcttcggtaattgtcccggttttgtcggtgaaaagggtatcgatggccccgagattttggatcgcatgcagtcgtttcacaataacttttcgtttcgacatggcgagcgcgccttttgccagattgctattgacgatcatcggcaacatttccggcgtcagccccaccgcgaccgcaatcgcaaaaaagaatgcctgggaccagtcctgtttggtgatgccgttaatcacgaacaccaccggcaccaacaccagcatcatactgatcaaaacccggctgatggcccgcatcccttgttcaaaactcgtcggcgcgggtttatggccgatttgattcgccatatcgccaaaataagtggcatccccggttttcaaaatcaccgcggtaccagaaccggaaatcacgtctgttcccatgaaaaccagattcagcgcatcaaaaaggctttgatccgcttctaaagtggttttgccggccgttttctccactggcatcgcttcaccggtaaaagacgattgattgacgaacaaatcatgcgtcgcaatcaaataagcatcagccggaatcatatctcccgtcgccagttggacaatatcgcccggcacgacttcatccatcggccgctcctgcgtttgtccgtcacgcgtcaccgctgtcgtattggcaatcaaggcagccagcgcgtggctttctttttgcgaccgatactcctgccaaaagtgaatcgaaacagagagcgtgatcatcagccccatcattcgggcaccgtcataatccgctgtcataatggaaacgatgcataataaaagcagcacccagacaaacggttcattaaatgctgcaaataaaatcaaataccacggccgcggatgttgggtcacgacggtgttggatcccgtttcttccagacgatcggcggcttcggcaggcttcaaccctgcttcacgggttctcagtgtcgccagaacctcctgtggctgctgctggctatactgcatcaacgccgccgttttttcctgggtggatgcgttgtgccttgttatagtttttttgaacatcatctcttgttatataaaatgtggaagcatgccgctttggcatcaataaacttttatatagttcctttctgattgagtggctgtcttcattaagcctcgtgatgacgcaaggccggccagcggacagatggtttccagaaaacatttgtcagctagtcatgaatacatttcgctattttcacgatgataaccacatgagcaccttccacttaattattgcgttcatgtcttcgtgggtgcttcgtcactattatcttgttccataagccgcttcttctcacccctttttgtatgcctggcaaaaaaatcacgaatcattgcaggcaattagctttactcaaagaataacttgacagtaagatggttgtcaaagataactaaagtagcactgttgtcaggaagacccttttggaggaaaaattaatgatttcttcagcattagcccaagctgccgcgattcgtgcgggcgccattaccagcgctgacttaatcgatgcggcggccgataaaattgccaagctcaatcccaaactgaatgccatcacctggacaaggtttgcggccgccaaacacgatgccgcgcaactgaaagacaacggccaaccattcttgggtgtgccgctggtcttgaaaggtttggggcaaaacttcgccggcgcaccggccacagccggcagtcggctattcaaagatgccaaagctaccagcaccaacaactttgtcaaagcattacaggcactgggttttgtgatcatcggccaaagtaatgtcccggagttcggcttcaaaaatatcactgatgccacgctttacggtccggcacgcaatccgtggaatctggactattcgccaggtggctcttccggcggggcggcggcgttggtcgcggctggcatcagtctgcttgctgccggatctgacggcggcggttcgattcggattcctgcttctttttccggcttaatcggcttaaaacctacccgtgggcgcttgccgaccgggccgggcgagtggcgtgggtggcaaggtgcttccattaatttcgctttgacccgcacgatagccgataccgaagccttgctgcgcggactggcaacgacccagttagctgcaccgtttaacgcgccaccgttgcacctcgaaaacgtcaatgacccgcgaccgttaaaaatcgcctacaccacgcaatcgcctgtcggtacaccggttagcgccacggcggtcaaggcagtcgcgttagccgtggatgccttgcgcgcggctggccacactgttgttgaagcgcagccggatgtggatggcacagccttgatgaaggcttattatttgatgaacggcggcgaaaccgcggccatgttccaagcctataccgagcaatccggccgcgcggtcactgcggaagacgtcgaacccgttacgtgggccatctatcaagccggattgcacacaacggccgctgattacagccgttcgctgggcgtctgggatcaggcagccgaagcttacagtcatttccacgacagctatgatctgctgttaacgccaacgacagccaaaacggcgccgcgcattgatgccgagttacaatcacctgccatcgtcgataaaatgaaacacgcagccgagcttgcgccggatgagcaaaagcagctcgtctgggatttgttcgagcccagcctcgcatactcgccgttcacgcaacaggccaacttaaccggcgccccggcgattagcctccccactgcgatatcaccggacggcctaccgctgggcattcagtttgtggctgctaagggtcgcgaagatcagttactgcggcttggctattggttcgagcagcacaatctgctgcaaatgtatccattaagcgagtcggaagacatttcacccgcagaataaaccattctcaatgacaatttgcatgcaaacgaaaagccttagtccagcgaaaaccggactaaggccttttctattgtctgtgcaattacttacttttcacttcaggaacgcctgccttgaaattgacgtaacgtgccaatgcaaaaaggtaatcagatagccgattgctgtattgcaaaaccaccgcagtgaccgtcttatctccctcagccagcagatccagcgagcgctccgctcggcgtgccacggcgcggccatattgcaacgccgctgccagcggatgaccaccgggtaacacaaaagcggtgatgcgcggcacctgtgccatcatgtcatcaatcgcatcttccagtgccttgacatgcgcttcggtaatcgtttgatgccgcggtaccgcaacgtcggccagcaactcataaagctcccgctgccggtcttccaacgcttgcgcaagccaatcaaaccccggtgtcgccgttgcttgcgacgcgacatagccaagccatgaatcaagctcgtccaaatcgcccagcgcgataatctgcggatcatatttcggcactttcttaccattaatctgtttcgtggcaccgtgatcgccgacttttgtgtaaagtttcaaaccgaatcctcttttccgtaagcgcgttatccgcgattgaaccgtttcagtccttgctgcaacaccaccagaacgattgggtaaaaaacaagattcccgatcgcgtgataagtgtcaaacaacaaaccactgatataatacgcccaaaagccgagtccattcaaactgccaatgaccgccatccccagactgacaacaaccccataaagatagcccagcaacccggccaagccgatttggagccagagctggcgccggacgaccggcaacatcagcacaatcgcctgcaacacgagcatgcaaatcatataagccacgatttgcggcaacgtccacaagccgaaccctaagacaaggttggagaccaccagcgtactgacagttaagccgagtccccaacgcagtccgagtaacaacgtcacgaccatcaaaatatctgtcaccggctgaacgttgggaatcggcactttaacgatccgcaaaaccgtgcacaatgccgtcaatagaccaagcaaagccaccgcccgaacaggcgatggctttttggctgacgttggcagcttcatttggtaacactcaggtcaaaaacaactttatcgtggttcttgaccggttgcgttgtggcaccttttttcgccatcttgccgttgatggtgtatagccagtaagtcttcttggcaacattttgcttcttgccggcaatctcagtgataaaccctttcgaagccttgaccgaccaaccttttttcagaccggtcatcaccactgactttttcggttgggtaatttttttcttggcaaacgccttgccattttgcttcagctgataagtgaccacaatctgattcggcttgctgctggatttggcagcgctgttcgaactgttgctgcaaccagccagcacaaacattgctgcaaaaaagacaaccagtgaacgtaaagctttcttcaacataaccttcaatttcctccgcatttttacttaatcgggcaagcgccgccaacacaatccgtctggtcaactaattccagatctttttgatcatgattggcattttgagcggcaaaaacagctgcgactgatccgtgaatcttggcgcacttttgcgtataggtgtcagcatcaatcggctcttttggcgcctgtttgaagcctgagccaacgtacggcaacatggatgttgacttgatcacgtgccgatactgtgacaacaagccggcaatctgatcggcttcttccggctggaaggtgaccgtgcagctaaccgcattatccgaccagtatgtctgcaagaatgcctgggtcgcaatctgttcggcaatcgaaaccgttccggctgaagcaaatgccggatcgtcggcatgcgccgcgcgaatcgggaactcgacaaccatcgtgttcttggtgtaaacatccggttcaatatgataaccacatgctttcaaagccggcagcaacgggtcgttggcctggaaccgaatgcgctgaatcaggtagccggcataatggaaatgcatgccttctgaaacgcctgccaatttagcaacggttcccgatggcttaaccgtggtgtgtttgcgggaaggctcacagcccaatgcatcggaataagcctgatccgcatcaacaaccgcgtgatataagccatccaccgcttgcttgatttccggattataaatcggcttctcaagcattttaccggtgtgcggatccacaaccggttcaaatccggacacaacgcgatgaccgaaatcatccaggaaccaatcctgaattccggacatcgaaatgccgatacggcgattcttcctaataatatcacgggaaacctgccagtcataattgctgaaggttactcgcttggcataacgcgttgccaacgcaaaggcctgcttcaatttccaaccttgttgcaccgcaacgaccggaaagagttcaaacaagttgcatggttcaccattggccaacgaaatctcgccacatgggttggtgccttccacatccggatcgttagctgcattttcaccatcgacaatccggccgaagcggcgtgataaatcgaggttcacaacgcccggttcaccgtttttggcaatggctgtcgcaatcggtgcataagcgtcaaactgcgtatcaatcgcgacactgttgttagatgcccagcggtgatgataaagctttttttgatcctgcttcatcgtgatgaacgcgtcatcatcggccgagcctaacgacatttccgcggaacgtcgcacattgccggccaccactgtcttgccgatcaagttgccgatatccgtagcgtcaaccgcggtcaatcgctggccaacccgcgcattaagcaccttgttgatatccagcaacatctcgactaatggcatcggaccggaagccgtgccgccaaagccatgaatccgggcgccttttggccgaatccgactgatatccagcaccaacttggtctgaccaccgggattagtcgtcgcaaaatgatgatcaatcaccttggcgttggctaaaacccagccttcacgggtatccggcaaaacgtagcggtcattgtgctcggccgcatgcgcctgttcccaggcttcccgatcaaccgcgcccattttcagtgattccgcatagctggcactgttgcgatcaatcacaatcgtcaggtcaacggcgtttgcgactggcggcaacttggcaatgttgtctttggtcacggaaaaaccgacgccgccgcctttcatcaattcgtcaaacataaaggaatacggcatcgagacagcaggctggtcagccgaaaaatccgtcggcacgatatgcgactcaccatagggttgcgggcgaatggcgataaaccaacaattattcaaggcatcgccattgcgcttttgataatcggttccggaaatccacaggttacggccagatggcgtgccggccaacccgtaaataagcttgaaaagattccgtgcctctttttgcagttcatccacgacttctgaatcaggattggctgtatgtaaccgcggatcaaggttaatattcccctcaaccactcgcttgacggtttcatcccaattctcggtccgttgttgatccggcaaccaccgggcataggtccgcttatacgtgacccatcccagttcaccccagtgtggcttaatttctttcttgacctcggcaacaaaatcaggtgccaaggtgatcggtttcatcataacttgcatagctgtacctcccgtatacaagatatggtatagccaaacgaacctaatatcaagatatagattaatcaataacaaattgttaatgctggcaaccacctgcccaacgcgggatgcacggctttttaaaaataatgacgaaattaaaaaatcgccagcgcaagaaaacgctggcgacatctgatctatccgtggatttaaaagaccggtccgacatacggccgcactaacacatggtccaaatcaagacttttaagctcgaccaaatcattcacaaagcaggtaatcgaccctgccaacatcagattcattttcatctcgccaagctgaagcgccacgattggcatgtggtgcgcataggcgtacccaatctcaaacgccgttcccggatcggggttctcaccgacataatccagaatggcgactaagaccgtcgagcggtgcagaccctgaatgtcttcaccaaacacctgccgctgccaccctggtgagttcggcgtcaatcccgctttgttcgtgtcatcgcgcggtgaaaaaatcgcggtgaccgattcatttgcatgcaaagctgctaaaacttgatcaagccgctcaatctgagcaggatcaaaaaacggtgcagccaaatatacttctgccatattcgtttactccttgagcggcttctgtccgcaaaccttcaactatctacttcaattcagcagcacctaaaaatcgcgttgacgttgccataaatattcggcgatatcatgatccaccaaccgattctcgtgcagtaaactatgggctgcccgtggtccgcgaatcacaacttcggtataatctttgatccgatccttaaccaaataccgcacggcaaagctgctgctaatggccacttcaccatcgtggcgcccgcccaacatcaaatccccggcaatatttagccaacgaagatcagccgggagattggcaatcgaacgttgaaaatactgatagatcggcgctgtgtgctccggtccttgacgggtcaacggccaattaagaatcggcgaacgccgcgcaacctccacatcattcatcggtgcggcaatcgtcaccagattcgccaccggaacagcaggttggctcaataaatacagtgccgccgttacgccacccatcgaatgcgcgaccaaattaactcgggtaaacgcctgctgcgcctgcaaagcggcgatcacatgcttcaacccgcgcaactgggcagcgggccgcaccgttttgtccgtatacaacacctgaacggcagcgtgatggtttagattcaactgcccgcgcaaatgaacgctgctatccggggcgacaatggccacgacatctttgcttaagccataacgccgctgcatacgccacaacatatggccaaacgaatagcgcgtccccagatgcccgggaataaacaacgtcggcgtcggatccatcacaagcggtaccggcgcatagccagtccgcgccaatagaaaatagtcggtcatcacgcccacaacgacaatcacgcccagcgtcacaagaatccagaaccagccgctcataggcgttacctacagcttgtcgacttgatcaaagtccagttcggcggttacttcacggtcaaacatttccgtaacaactttcaacttcatcttatctttatcaaccgccgtcaccttaccatgcatgccggtaaaggcaccatcgataatcgtcactggctcgcccacatcaaactcaacgttctgatggcgcgtgctcatgcccatcgagtgcagcacactggcaacttcttccggcagcaatggtgctggttttgaaccggccccatgcgaaccgacaaaccccgtaactcccggcgtattccgaaccacaaaccaagactggtcagtcatcaccatttcaaccaacacatagccaggaaaagtctttttcatctcaactttatccttaccattcttttgttcatgttcctcttcttcaggaacgaccacccgaaaaatataatcatccatattcatactggtcgtccgctgttcaaggttcgtcttcaccttattctcataaccggaataagtgtgcaacacgtaccaatgcttctctgccgatgttactgtttcagccataatgcgtctcctttttgtgttttgagtcaaaataaaaaaccgtcatcgaaggcggttttgcgctgttcatagtatagcaaagatgaagcggtttgtcaggctttaatacaagaacgcctgaaagatcatgttaatgacccaatcaaccgccgcaaaataaatggcaaagataatggaagtcatgatgacggtaaacgtatcacgccgtgtctgtttcgcggtcggccacgtaacagccttcatttccgcaaaaacacttttgataaatttcatcagtctgctccttccactattacttggtttcttggtgaaccgttacccggccacaatgtttacaaaattttcttaaagttaaccgttccgttcgcttcgggttttcgggaacaaaataattccgttgcccacaaaccgaacaagctaaagcaactttctttactgacatcttgttccctccagtcacgtccaatatgataccaaggttgtccatgaatagcaagcgtcagcaaacaaagacggtgtcatctttagtgccattaatatgtcgttattataagcatctgaggtcattttaaaaaaggattcccaaccacaacgtcaccaacagcgccccaccaaagctcaagagcgaacgaatggtgaaaataaaagttttgtctttactaggcgaagcggtataggtccgtgtgttgtggagcaccagtggccatgtcgccagtaccagcaaactccaaatcggcaggatgcccgtaacgatgccgagtaataaggtgacaaaggtggtaaatggaattagccggtaccaactcaaggcacgctttttcccgaggtaatagggcaatgtgtagcgttcatttttcacatcttgttccagatcggcgatgttgtcggcaaacatgactgccgcgttgaggatgacaatcgggagaacggcgatgaataactgcaacaaccacccgagattcagtgaaaacgcaaatgtgcggcggcccaagacgagatccaaaggttgcggtgcctgcatgttgattagcacggcaatcgtgaatgtgccgaagccttcgacgattccggccagcaattcgccaagtgggagccgggataagggaatcggaccaaatgtatataaaatggcgatgccaacaccaacggcaccgatgaccagaaggctgagattcgtgcgcatcacaagaagcaggccaagaacgacactcactaatagcatcagaatcgtcaacgccaacatcccccaaggtgaaagatgctcgcggccgatgatattttgttgttgctgataactatggtctgtggctttgaagtagtcttgcacgttgttgaagccagtgacaaacaaagcaatggcgagctgggccaagccgtaaagcaggctgttgacccaggaaaattgttgaaaagcccacgcggcgtaactaatgcctagcgcatacgggagcatgctcgccgcttttgccggtaagcgaataaattcaaggaacagcggccaagttaggtgtttgtaaggttgcgtcataacaagacccccattcccaagccgagggttaataaaccattttccaaaaccaggttcacgacggcggtgtggaacgttcgcggcttgcttgggtcgcgaataaaacgatggacgttgcgaatgacgagcggccacgccaactcaatcagcaatgcccagctcggcaaggcgccaaacacaactgctaacaagaccgcgaggaaaccaacataggctaacaaggcgtaaacccgcggtgcccaccagtgacctaagtacatgggcaacgtatgccgatgattccgctcatcttccttcaagtcagccatgttgttggccaacataacgttagcaatggtggccattggcgtgatacaggtcaagcctaaagcgataatggcaataaaatcgccgtgcaagacgatggtcggccatccccaatccaaagcaatcaattttccggggacaatattaatataagtggcaatcaccggaatgcccaagcccatcacgacaccggaaaaaatttctcccagtggcaaccgcgacaatggcaacggtccccaagtatataagataccgattgcaaaacaagccatccccatcaacaacacaagccagtcagtccgcacaaccaaaataatcccaagcaacgaggcacctgccagcatcccgataatgattcggctgactaacttcggatttaacttttcccgcccgatcacattaacagcttgctgatagtgttcatctttggctttgcgataatccatcaagttgttcagcgcggtggtcatcatgtcaaaaagcaacatcgccaccaggaataaccccgtgttcacagcattaaagccgtgaaagtaactcactgcaaataacgtaccaatcgcaaacggcaaaatacttgccagcttcgtgcgaatttccaccaattccaagaaaatcggcagcgtcatcgacttccccctttaaacgcgctcgccagcccagaaaccgggctggttcacgctctactttttatagtcgccagcgtgtatccggaatttttgaacagtttgaagctatctttcaatcccgagctgacgtaaacttttttgtctttggtgacaaaaatggcatcggcatatttcagcttttcgatatatgccatcccatcaactagccccttatcaaacgtcgcggttgacagagcatcgccgtcgacacttttgttggtgacgatcgacacgcccatcaactcattgtcaaatgggtagccggttttgggattcataaggtgcatataaactttaccattaactttgagatagcgctcgtagattccggaggttacaaccgttttgttactggcaggcaaggtaccgatcgccgtcccccgtggctttttcggatcctgaatgccgacattccaatctttcttcgcatccttggggctcttacccatgacgaaaatattaccgcctaagtcaataatagccgtggtgacatgttgtttcttgagtgtcttaacgacttcatcggtgatgaaccccttcgcgatgccgccaagatcaatggccatgccttttttcttcaggtaaacggtctgttgcttcttattaagaacgacatcttggtaatgtaccaacggcagcttggcatcaatttcgctttgggccggtttgcgggcatcggcaaagccaatgtgccacagactggtgatcggcccgatcgccaaatcaaacgagccattggaattctcgctgtaatgcttggccgccgcgatcacgcgataaacactcggcgtcacatgaaccggcttgatcccggcgttttggttaaccttatcaacttccgaccctttttgattgaccgtcagctgatcggccagctgttggactcgggaaaaagcagcatctaacgccccttgcttgcccttgtcataaattttaaccgtgacaaccgtgcccatcaaaaactgggtatccgaataagggtcgccttcgaccaacgtgcgtttagctgcaggcttgccggaacaggcagtcgctaccaatgccagcagcatcagtaaaacgacgacaactcttttcttcatctaattattcctccaaaagtgagcgtgaaccggcacaatcatccggctgcagagccattatacggggttttgtaggcataagaaaagaacctgctcagaagaagtattccgaacaagtccctacttaagctactagactgataatcagcccaaccgcttcgatcgtgaaaccaacaaattagttgttgtaaacaatgttgtcaacttcgatcttgttcgtgttgccattttgtgcagcattgaccagttgatcagcatataagatgaaggtatcggaactgtgggtcgcgccggaaaccacatcaaccttggctggtgactgcttggcaaccaacgacttattcagttccggaatgtattccttcgggccaaccttgttgacttttttcatattagcttcgtacttggtatcaagtgtcttggacttgccatctttattaacattgtcatagttactttgcgtaatcttgccgtccttgacggtgatggagaaggtaacccgatagccattgaagtagttcttttcttcaagggtgtaggtaccgtctttcatcttgccggtgttgttcacttcaatcggcttggtgtcaccggcttgggcagcctgaatcaattgttgtgcatagttcttgaaggtcaaactagaatcagtcgcacctgagatgacatcaattgccccaacgtttgttccgttcttctggaacgacttgttcaactcaggaatatattcttttggaccaaccttgaccttggacttcatcgacttttcataagcagcgtccttggtcttggatttaccattcttgtcaacgtagtcatacttagtagaagtaatcttcccgtctttgactgtcatggccatttcaactttatagccatggtcatagccggtttcattcagcttgtaagtaccatccttcagcggaccgccggcaacttgcttttgggttgatgacttcttcaccactttgctgctggaagccttactgctggacgaatttttgctgcttgaactactgctgcatgcacttaaaaccaaagtggacagtgcaacaacggctgtccccgtcacaactttacttaacttcatgacatttaccccttttgcagttcattactgcgatattgtgttctcaatcacatatttagtttagccagtcaagtcaaaaaaatcaactaaactcaggtattataagcgctttctcattttcttagattggtttcgaaaacgtatttttgtgtctttttacacaaaaatgtccggatttggaaaaagagagctagaacgttagacattaagcgaaattaaaggctataatgacttggatacatacttcacaaaagtatggatattgcaaatggtaaggagtgttatgcatggcgaaaaccaatatcgtcgtggttggcgcggggtttgccggggtttatgcgacaaagcacctggccaagcactacaaacgcaacaaagacgtgacgatcacgctgatcgatcgccactcgtacttcacttatgtcaccgaactgcacgaaatcgcagcggatcgtgttccggaagatgcgattcaatacgatttgcagcggctattcaatcgacgtaagaacgtcaaaattgtcaccgataacgtgacaggtattgaccgcgataggaaggaagtggtcacggaaaacggccgcttcccttacgactatgtgatcttggggatcggatcacagccaaatgatttcggaacaccgggcgttgccgaacacggtttcactttgggtaagtgggaagacgcgattcggctgaagcgtcacattgaagacgttgtgcggcgcggttctgaagaacacgatccggctaagcgcaaagcattattgtcaattgtcattgtcggttccggctttaccggtaccgaaacgattggcgagctgcgtgactggcgcgataccctcgccaaacagtacaagctagatccgaacgaaatccagtttagcctgatggaaatggcgccgacgatcatgaatatgctggatcgttcagacgcgaacaaagccgaacgttacatggaaaaacgcggcatcaaggtcatgaagaataccggcgttgtcggcgttcatgaagactatgtcgatctgaaagacggttccactttcccaacctgcacgctggtttggacagcaggggtcaaggcaacggatcaggccaaagactttggcctgaaacaaggacgcgctggccgaatcctggttaagaacaacatggaatcgcaagacgatccaagtatttacgttgtcggcgatgtctcactggttgatcaagacggcaccggccgcggccaaccgcaaatcgttcaaggcgccgaagcaaccgcgcatactgccttgtccaacattgaagccaagctggaaaataaggagcagattgaatacaaagccaactattccggcttcatggtcagcttgggttccaaatatggtgttgccaacatcatgggctggctgcatctctccggtttctttgcgatgttgatgaagcacttagtcaacatgctctacttcatccaaatttattccggttattatttattccaatacttcatgcacgaattcttccggacccgcaacgaacgtaatatgttccgcggccatctttctcgtcaaggcaacgtactatggacggtacctgcccggctcacgttaggcgcgatgtggctgattgattgctggccgaagattcaaggcaaggagtcatggtttattgataagctgcgcctgccatttagttggctgcagccagctgcgaccagcggtgcttctgccgccggtgccgatgctaccagtgccgcttccggtgcggcagccggcgcggccaaggccaccaagactgtcttttcactttcctatcagtacgggaatgatccgatgatggtctttgataagatgccgaactggtattacagcattaccaagaccttgattcctaaccagcaagtggcgttcttcatgcaaaaagcgatgacgatcatggaaattctgatcggcctcgccttgatcaccggcctgttcacttggttaacctcagcagccaccattgcttttgtcggcgtgttctgcctaagtggcatgttctactgggtcaacatttggatgattccgatggcctttgcctgcatgaacggctccggccgcgcgttcgggcttgataaatgggttgtcccttatctccagaaagtctttggcaaatggcgctatggaacaccgcaatcactttacggtaccgatgcactcaaataattgtcacgataacgcgtttaccggcgcagaagactctgggtggattttgcctagagtcttttttcaagagcgggaagctgctgcggccatcttctgtggtgtgcagtgctccccgtccttgacgttcacgtccatcttttcattgaccgatgcgaacaactgatttttgttagattggagcttgactatgaaacggccgaatacgttcaaacgctatcttaaaatgattcgcccttttgactggatcattgtcggcggcctgtttcttacagccttcatcccctacctcatcttcggcattcaggaaaatcagcagcaacaagaagcctcgcagcgcgttttaacagccgtggtgacccatgatggccacgaagtctatcggaaaaggttaaccggccacaccggcacgacccaattcacttatcgcgccaaagacggcgactggaataagatcgaagttcaaggagccggggttgcgattaccgaagccaactgtcaagaccaggtttgcgtccgtcgcggccgaattaccaaacccggacaaaccattgtctgcctgccgcacaagttgttgattgaaatcaaatccaacaaaggcggcagtaacaacacgggaggtatggtgaccgaatgagcatttataaagccgaccgcacccggcaatatatttatattgccttgctctgtgcccaaggcgtcattatcggcttactggagcgcatgattcccttcccgtttgcgtttgcacccggtgccaaactaggcttagccaaccttatcaccatcatctcgctgtttacgatgtccatttcggatagcttcgtcttgctgtggctgcgccttttactcaccactttgctaggcggcaccctgtcaacgttcttgtacagcggggccggggcactcctgtcttggctggggatgctactcatcaaacaactgggtgaaaaacgcgtcagcatgatcggcatctcggccgctggtggcattttgcacaatgtcggccagctgctggtggcatcgttgatcgcccaaagctggacggtgatgctctacctgccgatcctggcgtttatgggcattctcgccggcatcgcagtcggcattgcggctaatttcctttttgaacacattgatatcttacgtcgcctgcgctacgaccgaagcaagcggcgtaaaaaaggagcgacttcatgaaaattcatcccatgtggcatgaatacccgacgttggcgcctgaattatcctcagcactaacgttaattgaaaaacagattaccaccaacaatacgccagtggctgaagctatcctggagatgatcaacggcggcggcaagctgttgcgtccggcctattgtctgctcttttcgcgttttcaggatacggatcgggagaaaatgatcgccttggcagcagcgatcgagaccttgcacacggcaacgctcattcacgatgacatcatcgacaaatcaccaacccgccgcaaccagatcacgattcaaaaacaatttggcccggagaccgcggtttatgccggcgactatcttttcgtggtgtgcttcaagctcctggcccattacgcctcaagcctccgcagcattcaacaagacagcggcagcatggagaaaatcctcaaaggtgaactggatcaaatggctacccgctaccaaaccgacatcaccattgatgactacctcaaacaggtttccggcaaaaccggtcaactttttgccttaagctgttttgtcggtgcctacgaaagcggcggcagcaacaacttcgccaaagctgccgaaaaaatcggtatggacatcggcattgcctttcaattgctcgatgacatcctcgactacacaagcagcggcgacacccttggcaagccggtttgcgaggacgtccgcagcggggtgtattctgctccgttaattctagccatgcagcgcgatcgccaagcctttttgccgttgctggctaaaaaggaccaaatctccgatgcggaaatggatacgctccgtgatttggtcatccaatatgaaggcgtcaagcaagcctatgccatggcccgacaacataccgatcaagccatcgccggtttaaagaagttgccggccggaccggcgcaggatgatctgatccgcttgacgggaagcttgctgaaccggaaagcttagacatgtttgattgaacgcaaaaaagaaaacccacagtgctttctcaccatgccaattggcagatgaggaagcgctgtgggtttttgttcgaagcttcgatcaatctactagtaagattgtaaccggttagaacgttaggcaattggtaacgcagaggtaggctatcaggtagaatttcgtttagctagcaaagcttaagaaactaacagctttttccatgggaccatttaaggccacagacccaagatttgaccgatgccgcttatgacacaaacaattcctagactaataagaccaatccttcgctgtttgatcatctccgggcgtctccgatactttaaccaagctgcgtcaataaccccgagaattataaacacaatcaccataattaaggtgaaaagggcaattctaacggtcaagggtaagttcattagtttcttcctccatgcagggcttaacgtctctacaagtaggctactacatgaactgcaagaatagccaagttaaaaattaacgttgcttatgtgccataaaacgtttgttattctactcagtacatttgatgttctttataccagcaatcgcagatcaaaaaagcgcacaggcttatacctatactgaattactgcgatataaggataagactgtgtacttcttataaatataaaatcgtttacttaaaaattacccgtaacaaatcttggataattggtgaagttatcaagccaacaacaataccgcctaggaaaagcgaaatataaacagccgtcttattggttgatctcttgttcttcattctttctcctccaacacagtagacaccccagacatccaaagatcttgcttgttattgtcagtctaacaattgcatttcatttaaacaatcaattatagaagcaaaaacaaggcatctcagccttcaagaagctgcatgccttgcttttataccaatctcccgtcacccattaatgactatgaaccttcgccgctatccgcttaccaaactcggtctgatcaaaatgatcaatgatgtccttaacctcggcgtagcgcaggctggcgccgaatagcggactgcccggttcggtcatgatgccatctgccagattgttgtggacaaccgtgtcaaagcccattgtatcgacaaaggctgccactgtggcgacagcgtcaggatcgtttccggtgacaaagagcgccttccgccttggatcgccttttggccgcgcttcttcttgcagattatggtagcccatgtgattgaacgttttgacgattttggcatctttgaaataagcctgaacctgttcgctggaagtcgtgtccggatctaagacttcttcgcgaatgccgtccgtttcccaccagtaattcatggcatcaatgaccagtttacctttcagcaagtcagcatcgatgttcttgtagcgactaagtggaatcgccagcaaaatgatgtcactgttggcaacgacatccgcattctctgacgcaatggcgccgggaactaaggttttaatggttaaggcgattttcttgacggatcccgaaccggaaattcgcactgtgtagccggcatccagcgccagaccagccagcacgatgccgacttttccggcgccaagaatacctacgcgttgaatgaccattatttcaccgccgccttttctgccaaaatttctttaacccgcggaatgactttcgtaccatacaactcaatcatccgctcgcgctgagctgcggtctggttgccggcaccataaacgagatcgaagcggccgagatcgagcaggtcaattgtttcggccatgcgccgcgcaacggtttcgggattgccgacatagaatgaacctaccttggtttcaccgtcaaactgttcacgactcatcggtgcccaaccacgggtcaacccaatgcgatcaaagttggctttgatatttttaaacgcaacttcgacagcttcattctcgtcatcagcaatgaacccatgcgagtgcacggcaattgggaattccggcttgccgagttctttggcagctgcgtgatatagctcaatatacggcttgaaccggctggcttgcccgccaatgatcgcaatgatgactttgtaaccgaacttaaccgcgcgaatcacggattccggcgagccgccaatgccaatgtaagtctcaagtttgccgttttctgttttcggataaacttcctgatttttcaaagcggcacggaacttgcccgaccaggtcactgccttttcattgcgcaaggcgtcgtatagccccagcttctcattaaataggtcgtcataatcggttaagtcatagccgaataagggaaaagactcggtgaacgagccgcgtcccagcatgacctgcgcccgcccattggacaacgcatccaaagttgcgaaccgctcataaacccgcacaggatcatcggagctgagcacggtgaccgccgttgccaacttgatctgcttggtcactgctgaaatcgccgccaaaaccgtttctggactcgaaacgctatagtccgggcggtgatgttcaccaactccaaagacctgaatgcccaagtcatcggccagctcaccttcgcgcacaatctgacgaatggatgcagccgcggtctgcaagctgccgtcttcatttgccacaatgtcaccaaaagtttcaagcccaaactgtaaatgctcaatgtctaccatcgaaaatgcctcccatgcgtgttacttactttttgtaagctagtaacgacatcatagaatattttgggcgagaaagcaaccaagagattttatcaggttccccaatagcaactttggaaaagtcaaaatatagcacatcgaatgacacgccaaatattacaatttgaggctaagtttcatccaatttcaaacagaaaagacgacgaaattgcggtttcgctgtcttttctccttaagttattgaaagattgttgatacgacttagctgcccagcgattgggctggcaacgcattgctaaaccgaagaagcacggcattaactccgccaagttcgtagttttaaacgcgtccctggtgcaagccaagcaactcaccgcgtggattaattggttttggaaaaataaattcttcccaatatgacagcaatgaggatccatccagtcatctttaaatactcgccccatattaaatgtccgtatagataatatgaagtgaccccctagattgtcgactcggggatttagactgataatggtgttgtgttaaaacgaaccatacaatcatta

SEQ ID NO: 325 - DNA, 6171 bp, Lactobacillus casei
acggaattctggagcttgttagtgccaacgacaatatcgaaaatcttataaagatggggttgacaggggtcacttcataacagaacgcgatccatgagcatgttgaaaagaatgacgagtgcccaaaccgcgacgccgaatagaaaagccttacctttttttgtgatacttaccacccctaatgcgcctagccaagagaaacataaccaacttgtcaatcgacctttactcgcagattttcactggatgataatccaataaatcagcattctggtcaacatgggtaacgaaaagaataatcgtgccttctgtagccatttcatttatcaagtctacaatgtatcgcatgccactcgtatcaattccagaaaagaactcatcaagcatcaacattttgggctcttgaagccaaaacaagagaaatgttaatttcatgactgtgcctagcgacagcgccgacgttagttcgttgtaatatgcttcaagtttcatcttttccagtaaatacggcaattttgccagcctttggcgattgattttatcaaaggaaatcaaaaaatccacatgttctttggcacttaagttgggatccagtatattcccgtcatgaagataaacgatctcctctcgcattaaatcagtgtcgattaccccttcgtttggcaataggtcaaacgcgagtagcttaaggagcgttgtctttccaaccccgttcgaccccatgattctatatatgcttcccgaggaaaaatgcaaagaaaggtctcgaaatagtacattatcatcgtaagaaaagctaacgttctttacccgaacctgattgcccatatcttcccctctttatacataatgagaccactgttagcagaactaagacactcagcgttgcagtgagcgtcattgccgtttccaaaatgatgaatagttgtatattgattctgtcgacaacaagtagcgtcaacggcaaggcactacaaggcgcaacaaaagccaaagagataccctcaataatcgttctgaaagattttacacgaagctgctctctaatttcaaaagcattggtatcatgatttctcgtatatcccagtaaacccgtcaattgataaaccactgccattaagtaagagatactaagggtgcccagaatttgtaatcccacttccaaaaatgaaagtcctttaatccagctgaaaagtaggatcaaaaagactaagggcattaatttaacggtgaggtacaccagaaaggagcatagacaccgacgtacaagcacctctaagtgattattccaaataaatatttgtttatgaacatttatttcaaaataacccggaagattattaataatcgtctgatacagaaccatggtgctgtaataaattgtgataaacacgaccaacaacgagtatctttcgtctaggctgctcattagaagtgcaagcccactaccgctgataaagtaaaaccatgtgccaatctgtccagtatctttgatcgctaaggaaatggcatttttcactggatccttcatgtaagaccacctgagactgattggcttacgatatttgtaaagtccaaaaaagactatcaaaatcaatactaaaaatagcacgtactccggttcaaaactgaaaaaggatgcaacagttaaaattttttcgtttaaaaaaattcttataaactcgacgcataaacttttccccacacttgctgtgaatacaaatgcaaaaataagtacaagtccattctttataagctcgttcctcagccacttctccaatgaaaagtgcataaaagtaatgagtgcaatgcccaatgtcgccagaaaaagactgcaagaaagccaacgaacgccgcggagattttctatagtcagcgttataagaaagagcaaaaagggtattcgcgtaatggagatgattgctcttatgcaaaatgcagccttcaacaaacttgaggaaatgcccgaacgcactccgaatcttattattggttgattcaaggacataagacaaagtgactttaaatcctgataataaattagggcattgaccgcgacaataattccaagtacttcaggaacatttaaagtgaacccagaccacaccatcataattttcttgatatcgtcaagaaggacgcctgatatcaagatttctctaagaataattattgaagcggccaagccggctaagttgatcattccccaaaaccaaactgtctttctagcggagagtgtatcaacaaaaggaacaccagaaagacctctttttaacgaaaccgccaatacttcaatcattttaggtcatctccaaaacaagggcgttacaaacgtttccaggctggctgaaataatgagtaatatcagtatgagcactattgtatttctaaatgccaacctctgtgtgcgaatcttgagattaattcgctgaaatcctatatttgccgcaatcattagcgcactaagttcaactaatccatgaatacttatcaaaccaagaaagtaccagacttcgccagttgtatagatattcagcgttaacacaaaggaaatggccactgcgtttgctaacaatacaatcactgttgatactttatataagaagaacccacttattaataagaatgaaacgaaaatgttcttcactaggattttaaagaagctaaattcagtaacttgacttttcaaatcaacaggcaagttttgaggaaagtgatatgatgatagaaaaaggctgattgcaattgaaatagtaattgcggtgaatataaataaagaaagcggacacaaaattgccgttttctttatcagaaacactttggactttttcacaactatttaggctgcaagaattaacttcttgcccccacttttaaatgcttgccgcacaatatacgcgattaggccaccgccacccaataacgtaataatcgctgctgcacccataccggcatccaaaaacatttcaatagtcttcctagtctctcgactcaaaggaactgctgcagcaatatcagcgacaattgcgttgtacctaactgcaaccacaagcacgatagcaaacgcagccactgccaagacaatcgccgctttgcgatgacgcaaaaccatatgactcacatttttctccttttatgtttagaccggaccgttgtaaatcgagatagtagccttcaaccggaacaatggcagtaaagtcacggaagtctgatagaccatggcctcgtcgccaaagctgttaaacatctttgacagctttcaccctgcctcttgtgaatagcacgccatcataggtttattacggcctttcccagccttgcttaaagccatcaatcagctggtcagcatgattaaatgcatctgtcgccagaatgcctagaattgttgctaccggaatcgcgaacggtaagaagccacctgtaatctggcaaagttcggaatcttttaagttggtcatgacgctcatcctttcttttgactgatcctatggcaaattttcttttcgtttgagctcgttgagaacatcgatgctaaggctcattgcgggtgccacaaaaccaccttgaacccagcttcgtgcaatcgctccgagtcccatgccaatgtaagtccaaaaattatcagtgccgccaccactgatccgttccaggcggctatcatccaacgtcacgaattgttgcatggcttttcctccgtttcttcgacttatgcgcagccgatatatttaaactttttagggtgctagcttccctaaacacaatatacgataggtttaagttcatctgatcaattaattttaaacgtcggtatttttgaacttttcgtagtgactttaaccaaagacgacaaaattcaacgaaaaaagccgattttgcgacgtttcttttttgggtgcatcaacaacttagtggatccgctccgcttatcatttcaacgcgactagcgtatgctcgcgttgagggaagtgcccatgatgactgatgatacgtatgatgatgctggtgaagggtacaaagattattgcttcgactttatatgctgtgaacatcagctggttggagtctttacatattgatccgaaatcgcttgatttggagcgcgcataagactttgtcaaaataagtaccggaactatctcattttatgtccttttccttggcatgatttttctttatatgcaaaaaagctccaaattcggagcttttttagtaaacaggtggtgcctagtgacccctaagaccaaattgcctttgaacccatgcatgcctttcagcccaatttacgtgtgaattgaattaaaagtattatcattaaaaatatttttaagctgttcgcttgcattgtctaaagcctgatttaattcaataccacgcgcaaatttcttagtttcttggtatccttgccaagagcgcaccatatcaggtctggtctttagctgatcaatgatttctttaccctgtttcagactaatgtcactgattcctttcgcttttgccgtttttttaaatgcctcaaccagcgtgctttgatccaaatctgctaaaattgtcatgcccagcacccaaatatcataaaagtcctttgcccgagtatttctaatgcttttttgataaatggttaccaacttatcggccataatttgttctagcgaaaatgcgttcatcataaatttatcggtggaatcaataaaatttgtatgtgtcaatctcattggctttggatataccacatctcctgttgatacatcaatgttcaacttagaacgtgtcttccccattgtaccgagaacaccaacacgaaaacccggatattcatgctcattcatttctgatttaatgcgtgtcacggtgaaatgaataggactttgtgcatgatcaaaaatagtcgtcaacacttttttgaggttgtctggatttaagtcttggttattcattgtcgtatcaagatctattgtagttcgtcttgacaccccaacaatcatggctacttcaaacccgcctttgaaaatgaagttatcttggtaagccgattcggaaatctgccgtaataattcttgcaatctgaaaagcagctgcatattttgtcgcggaacgccaagcgcatcagctgcttcattaattcgattggcaattttgtgaggcgaaagatttgcataagggttcattagacaagtacctctaaaagttttgttaagtcgctgtgtggatacagttgctttttaagctttaaaaggcgctcaaacgacgcattgttttgcccatattcatcaaagtaattcttaaacgcttcattacgagtgtaaggagcaacatcaggtcgttcccatacatctaataaagtgcgttcaactgaataggttcgtacaaaattcatattgggcgtttcgactgtggtaatgcctggaaagtatcgattaggcacataataaattggcacaatccaatgctctgataaccgaggattacgatacccacgcggaaaagccataataaatcgatctgggatctggtcagttaacccatataagaataaagcggtatcaagtgcaaacacacctctgctatagcgttgtgaaaggattgcaaagtcgtcccatgtgtagccattttcgacatagacaccacgtgcttcgcgtgaaattcgcccctctctaatagcattggttagcattgaagaagaaacaccgtactgagccgctgtgccactaacaaaggtgtggtagtctgccagtaacgaatcgagtcccttgtttttgcccataaagatcctcccgtttaagtttgtttgtaactacgcctttagtttattatacgttgtacataacaacatatcaacttttaagattaaaccgtatcaatgtctccacgaagctttacgaaatacaagaatagttaaattctggcaagcattattggtcgctatctccccaagctcttcaatagatatcgccatggttacgtgcaagaaatatcatttcgaaatattgctggttgtcgaaaactgcaactggctattttctaacggcttaacccaaggggagcagtcgcacgattaattttttaaaatgattcctctttggctgcgataatccctttatggttgtcagatgaaatatcataattcatctgatgatcatggagggattttctatgcccagatctaagcataca

SEQ ID NO: 326 - DNA, 42875 bp, Lactobacillus casei
ttaccccagaagaatactggaataaggccatctaaaagctaccaaaattttatattatttcatctgtcaacttgacagggccgaccgcaggcattaagatatctttcactttttcaaacgcatttgtcagttactggcaaagtataacaaagacggctctcaagaggagagccgtccaagatgaaagatttattcttcaacactacttaacgcaaaactatttttcaggatttgttataacaggttgctgggggagttatttcagcaaaacccagtttcttgaactcttttaagctcgttgggctacaaacttattttaagctgttcttcgtttccgatagtcgtaaactgtcattgcaatccccatcatgagcacgagaacagcagtctaaagtaaacctggcacaggagtcaaaacatcctactccttcggctttggccgccgctccaaatgccggcgcattttatccaacagaaataactggtcattattccatgggctgttgcggcgggcgaggtgggcagcatagttggcagtatcgtggttgaattcacgatcagaccgctgaacctctttgaggaaatcgcgcgaactaatccggagggcgccgcgggagaacacggtccactgttccgcctgatcgctggtgacaaccacgagttggacgaggggcgagttcatttcctgggctaaccgttcgatgtaactatccgcagtttcgtcttctttggtgaagaccacttgcaaatcccacttcgcatagcttttgccgataccaggtacatacatggcatcgaagacaacaatgattttggcgttttcgtggctgcggtattctgcgaggatgtccagcagccgatcgcgggcaacatcgaaatggtcttccgctttcaacttggccagctccggccagtttccaatgacgttatagccgtcgacaatcaaaatgtgttcgcgcatggttatttgccctcgtgccggctggcaaatgcttgatacatcaagatgccggccgcaacactggcatttaagctttgcacgtggccgaccattggaatggcaatcgtggcgtccatgagtttggcaattccaggcgaaattcctttgccttcgttgccaatcacaagcgccgtactgccttttgcatcccactggcgataatcctgaccatccatcgcggtgccgaagacccacatgccgcggtcttttaactgtttgatggtctgcgccagattagtgacccgggcaaccggaacgtattcgattgcaccggtgctgactttggcgaccgcactggtgagacccacggcgcgatgtttgggaatgataatcccatgtacgccgctagcatcagcagttcgcagaatcgagcccagattgtgcgggtcttctaagttatccaataacaagaagaacggatcttcgcctttatctgctgcatgttgaaaaagatcatccacacttgcgtaagcatagggtgtcatcgccagtaaaacaccttgatgattgctatggtcactcatgagatcgagtttttgcttcggtgcggtagcgacaagaattttctttttttgcgcgatgccgattaaatgttgaatcggctcgctttttagatcggtttgaataaaaagtttgttaatagttgcggcggtgccggctttgagtgcggcttcaacggcatggcggccgaagacaaactcgtctggatcgtgttcatttggtgctgcttgcggctcttttgccatgacccgtcttcccttcttcaacgtactgaatacaccatgcggctaattcggcaacccgcttgtcgtgcttctcgagatgcagatagccaaacaaggcctcaaagccggtcgaaacgcgatacgtgacgacatcggtattcttggcatgcgtgtaacttttggcattacgcccatgtttgaaaaccgcgacctcctcgtcgttgagcaggtgttcgtcttccatccccgcgattaaggccgcctgcgctttggcagaaacgaaatctttcgcggcgcgctgtaaggcagccggacgtaccaacccgcgtttgaggagatgttcccgaacgtagacttcataaaccgcatcgcccatataggccaatgcgatgccgttcaattgttttggatcaaatgtcattttctgcgccaccgcgttccttgaggagtgtcttccaaaataatgccttgtgctgccagctgatcacgaatctggtcactcttggcaaagtctttcgctgcccgggcaacatcgcgcgctttcactaacgcatcaatatcggcatcgagattggtctgatcggcgaaaaccacgccgaaaatctgcagccacgcatcataaagattcagcaagtcgtcgaggctttcacgtttaaccgtatcttcattggcatattcgttcagcaatttagccaagtcaaaaaggacggtcaacccgttttgaacgttcacatcatcatccatggcggtgataaactggtctttcaacgtttgcagttgctcggtgatcttggggtcgacgcctggaacagcattgccacggcgataaaccagattttcacgggcgatttttagacgattaaggctattagcagcgttcttgaggttggcatcggagtatcggatcggcatccggtattgagtaccagccatgaagaatctcagaacttgcggatcgaccgttttcaaaatgtcatgaaccgtaatgaagttgccaagcgacttgctcattttctcgtcatcttcgccaatggttacaaagccattatgcatccaatagcggacgaactgcttgccggttttggcttcactttgggcgatttcattttcgtgatgcgggaactcaagatcctggccgccgccgtgaatgtcaaacgtatcgccaagaagttgggtgctcatgaccgagcattcgatatgccaacccgggcggcccttgccccaaggagaatcccagctgatttcaccgggcttggcagccttccacaatgcaaaatcgattggatcttcttttttagccagttcttcttgtgtaatgtgctgactggcgccttcttcgagttcgtcgacattttgatggcttaactcgccataatgtttgaacttgcgcgctcgataatacacatccccgtcgacggcgtaagcatagccttttgcgaccaagtcctgaacaaaatcaataatgtccggaatcatttgactcgcacgcggatgggcagtcgcaggttcaattcccagcgccgtggtatcttccatgaaggcatcaataaaccgctgcgccaaatcaagcggtgcttcgccggttttatgcgcggcattgatgattttatcgtcgacatcggtgaaattcgagacgtaagtgacatgataaccgcgatattcaaaatagcggcgaatcgtatcaaacgcgatcgcactgcgcgcattaccgatgtggatataattatagacagtcggtccgcagacatacatccgaatttctccaggatgcagtggcgtgaacggctctttttgccgggacatcgtattatataacgttaacatcggctcatttccttcctgtagcgtcttacctgcattttacaggaaaatgggaggattataaaggaaagagcgtgagctgggccggttagaaaccggattgacgcctcagtaaaaagatgacaaaaaagagcatcggtcaacacgctcaaccgatgccgcgaactttaatcaatcttccgcttcggattcaagatattcagcggatcaaacaagtccttgatctggtgctgaatttcgtcaacatcaaagccgagttcctcgttgttccactgattcttgctcatccccacagcgtgctcgccggaaattgtgccgcccaatgccagtgcttttcggaacatcatacgaatggcttggagcgcttcttttggcggttccgtctggtcagctggccagataaccgttggatgcacattgccgtcaccggcatggccggcagtgtagatttcaacgttcaaatctttggcaacctcagcaatgtagtccatcatctccggcaacttggataacggcacggccatatcttccataatgtgttgaccgttcgcgaaaaccgctggcaacatgtcctgccgcagtttgatgatggcgcccgcttcatcaggatcgctggttaccttgatattcttggcgtgatcggccgttaaaatctgttccgccattttcagactggcttcaccgcctgcatccagccggaaaatgagcatcgcctcggcaccttctgcatagtgcgtgccttcataccgatccaacgccgcaacggtcaagccgtccaatgcttcgagggtcaccggataaatccctgacaaccgcaaatcctcgacccctttggccaaggcagtcatgttatcaaaataagccaccccgaccacaggcgtcccgatcggaatcggattcaacttaacggtgatttccgtaataatgcctaatgtaccttcagatcccacaaaaagatgggtcaggtcatagctaaaggcatgcttataagtgcggccgccgagtttaatttctctaccatctgcaagcacgactttcaagccaagcacattgtccgttgttgcaccgtacttgactgtactcatcccaccggcattcgtcgctgcattaccgccaatactggaaatcggcttagaacccggatcaggcgcataaaacagaccttgcttgcgggcttctttatccaagtcaccgttaatcacgcccggctccacaaccgccaacaagtcgcctttgctgatttccttaatccgattcatccgcactgtcgataggataatactgccattcaggccatccgccccgatgacagtactggtatccgcgccttgaggaacgaccggaatgtgatattgccgcgctatcttcaaaacaccttgaatatccgcaacatcgccagccgctacataggccaaaattctgccgtcaatttccagctgagcattgccattggcgctgtattcgcgcgcaacctgatcatctgtatgaatctccgcgtgcggtgcggcggcacgtaaagctgcaaggatctccgcgttgtcataagcagtaaaaattgccattatccagacctccattgctttgattgctgggttcattataaaaatccttatcctcattatgaacctatttccaaaaggctgggttaatttagtctggaaaacgcgatctctccccattcaatgtggtgcatacaaaaaatccgcgacattacgcggatttttgctgctaattaaagttgtgatgtgaccaaatcaacgttcttcaacacctgatcgcgccccatgagctcaatcgtttcagccagttgcgggccatgcatcctcagcgttgcggcaatgcggatcggcatgtacaacttgcgacccttgacctgggtttcttgcttgacttcgttgacaatgcggccaacggaatacgcatcgaacgtgtccagtgctcggatttttttagcaaatgcttcgataaccggcttggcattgtcgtcagccagctccttgcgctcgtcatccgtcagatcagttgccttgtcgaagaaaatatcggcaagcttgctaatctgcgcggtgtaactcatctgatcggtgtacaagctgatcagttgacgagcccactcgatggttttcggatccggatcgctatgaatcaggccatcttcaatcaggtttgccaacgacatgctcatcagctcgttcgggttcgtcttttgcttggctttaatatactggttgttaacccattctagcttcttctgatcaaagcgcgccggactcttggataagcgcttcggatcgaactgcttgatgaattcctttttggtgaaaatctcatcttcgccaaccggtgaccagcctaacagcgtgatgaagttaaacatcgcttccggcaagtagccgagctcacgatattgttcgatgaactgcaagacggtttcatcacgtttggacagctttttgccggttgcgccattgatgatcaaagtcatatggccaaaaatcggtggctcccagccaaaagcgtcataaattgccagctgctttggtgtgttggcaatgtgatcgtcgccgcgcagcacgtggctgatttccatgagatggtcatcgaccaccaccgcaaagttatacgtcggcatgccgtcgcgcttctgaatgacaaaatcgccgccaagcgtgttggcatcaatcgaaatcttgcctttgacaatgtcatcccattcgtaagtcttatcagtcggaatgtggaaccggatgaccggctgtaatcccttggctttcgccgcagcaatggcttctgccttttcggcttcactcatgccttcatattcatattcataatgcggcatttcatgacgggccttttgggcttcgcgatcggctttcagttcctcttcggtccgataagattcataagcaaagcccttatcgacaagctgtttgatcagcttgtcataaatgtctttacgttcagactggcggtaagggccaaagtccccacctttgtcaggaccttcatcccagtcaatcccgagccagtggagattctccatttgactcttctcgccatctgcaacgttccgctttgtatcggtatcttcaatccgcagcaccaacgttcccttgttgtgccgtgcgaacaaataattgaacagtgccgtccgtgcattgccaatatgcaaatgcccggtcggacttggtgcataacgcacccgaattggtcgatctgccaatgtcttagcctccattttctgtaaacatgcaatgctagtgtaccacagaagggcaagcgatggacggcaacgcctcaaggtcatcaggtttttcgtttcgccgggaaaagtgccatctttttaaagcaatttgtttattaaaacattatgcgctgacagtactgttcggcttttctcggcgccagagccagtaaacaaacgccaaaacaatcactgtttgcaccaccaacagcagctctgtcacagtgaggctcaaagctcctgcttgactcaatccagccgggaaatcaataaaagcatgcagcccgactggcactagcatccagaaccaccgcttgcggttgaccacaatcagccagacaaccagcgaaagggcaatctgaatggtcaaggctaacagccgttcaagcaaacttagtgacaccgtccagccgctcatcccagtcaactgcttcaccgcggtgataatgccagcacgcgcgcttgccggggttttggtcattaatttagccaacgcgccactgttgatggtcgttgcaaaaagcacattgcttaacattgacaagccaccacccagcatcatttcaaggccgccatgacctaaaccatacaaaaacggagtctccggcgtcttggctttttgcggtatccgccgctgaatccatttgaacccgaaccaccggccgacttcttcaaaaacgccggccagcagtgcaccataaagtgcgtacaaccacggggtatgctgaaattgccgggcaataccgcgaaacggtccttccaggataccggcaaagaggatgaaaatggccatgccgataaagaacaccggcgtcgccccttttttcggatgactgcgccgttgaatcatccacacggccaaggcgatcggcaaaaccaaacaaataatgatctcgatgaccatcatcacgatggctgcttgactgacagtgctgttcacaatttttgacatacgcgcgacctcacattcgattgttcagaaaacgatctgttgtggtcgttttcaattctttaggtataaaaagagcatcatttacagtgaatgatgctcttttccattccatttttcaactcaatttacacaattgaaaatggcactagttaatttttatgactcacttttttcgttcgccggcgccaacgaatacctataaagcctgccaaagctagaaggacaacgccaagggccgtcaagccgatctgttcttcttcgtgtgtccgtggcaatgtgtgcttagctttattagttggcgttatgatcgttgttgtcgcgccattgctgccacctgttgatggcaaaacgttgcttggcggatttggcatggatggctttgtcggcgtgcttggtgtgactggtgtacttggcgtgaccggcgtgcttgtctttgcataaacaaaggtgacatttaacgttccatttgtgaacgtgcctgaatcagccacgctgtttggcgccatgcgcagatactgatatcccgcaatggttgttggtgttgtggtataaggtgttcctgcgtttccagtcaaaactttgtctggcgcgagtgcgttcccattttcgtcaacataatgaacgttaacggttccttgggcggccggtgttttactgtaaacaaatgtcacagtcaaagtgccggtactaaaggtcccgttttccggtgcactgcctggcgcaagactagtgaattggtaatttgcaatatcgatcgggcgggcttcataaggatcgccaggctggccggtgagcactttatcaggtgcaagcgtgttgcctgcatcatcgacgtacttcacgttaacactgccttgagggactggcgtcttggtgtaaaccatggtgacagtgacggtgccattggtgtacgtgccgcttgccggtgcgctatttgtggccaaatgggcgtattggtaatctttgatgctgattggcgagatggtatacggatcgccgactttgccactaaacgtctgatccggagcaagttgattgccttggtcatcgacaaatttcacattgacggtgccttgtgcagctggtgtctttgtgtaaatgaaggtgaccgttaatgcgccgtccgtaaattgaccgctgaccggtgcactgccgtttgccaaatgtgcgtactggtaattagcaatattgatcggcgccacgttatatgaatcgcctactttgccactgagcgttttgtccggtgcaatttggttgccgctatcatcaacatatttgacgttgacggtgccctgtgcagctggcgtcttggtgtaaacaaacgtaaccgttaacgagccgtccgtgaattgaccactgaccggggcactgccgtttgcaagatgtgcatactgatagttatcaatgctgatcggcgaaacattgtatggatcgcctactttgccactgagtgttttgtccggtgcaatttggttgccgctatcatcgacatatttgacgttgacggtaccttgtgcagctggagtcttcgtgtaaacaaacgtcacggttaaatcgccatcaataaattgaccggttgccggcgcactgtttgcagctagatgtgcgtattgataacccggaatatcgatcggggctacttgatacggatcgccgaccttgccattgatggtcttgtcgctggcgatttgctgaccattttcatcgacataacggctggtaacggtaatgccggttaccggcaggctgttcttcttataaacgtaggtgaccgttaatcgaccatcaacgaacttgccagttgcagcagcgctatctggccccattttctcgaaactatagccatcaattttcttttgctcagtcgtgtaggccgcgccaacgttgccattcagcgttacactcggcgcaagtgttttgccattttcatcgacatagttgacgacgaccgaaccggttgcaatcggattcttcttatacgtgattgtttggacgttatccggactatcggcagtgacatcgttaatcgcatcactgttcgccttatctggggtatagccatcaatcttaggtgaagcgacggccttaaaactgccgctagctggtgtccattgaccataagccacaactttgccattagcatcaaccgtattggtccgcttaaacgttaacgcattcgtcgccgaatcgtggagcgctttgccattttcatcaacatagttaatcgtctgcttgacggtcttggtttccgtaacttgcttggtattggagagttgaatcgtcacggttgcgccttttgccgaatactgccccttttgtgatccggaaataatctgatcactggtgtacccatagcgcgtctttaaatctgtcagttcctgggtgacgttttgatcggacaaaacatcatagtcggtgcccaatttgcctgaaagcagcgttgtccctaagttcttgccattctcatcgacatagttaactgtgacgttaccgacagttgcatccttttcatatgggatgatgacaaaaccatcgaatggataaccattaccacccttaaacttgtccgtccaaaaataagtgagataaccattgttttgtaaattagtccacttaatcgttgaaccggcttttttgatgacattgccgttctcatcaagtaccgatccggtcgcattgctgagatagcgtgacgcaaagttctggtcattttgggggatcctgtcgtagtccccttctgtctgactgtcaaaaggcgtaaccggaagtttatcattgtctaagttataaataccttttgccgacaaggtcagtgaatctgtcgcagggtttaaatgcagcgttggcatgacataactttgcccgccaatgggtgacatcggataaattcccggtccagatttagccagtgctgaaatatccgtgatatggttatacgacaatgacaacgaattaatatgggttaagttcttaaaggccgaaatgtcatgcaaattgcacatctgcaagttgacatacgtcagtttattcagattagcaatagccgagatatcgcttaattgggtattttttagcgtgctgccggtctgcgcgtaattcacattttgatccggcgataaatccaaccaggtcagattggtcgcatattgtaagccttccagactcttgacgttcaaaacatgatgccacatagtcagatccgttccgtcttgagtcggcgcgatccatgtcagctctttcatcatctgtttggtaatttgtgacggactggtaatgtcaatgttattgtcttcccgtaactcaccgactatgatggcctgcagatccttgtccggcatccactcgttaatgtcatcagatgttgcagtcacatttttgttggtatcggcggtagctgccataactgtctgcgattgcttttgttgctgagcagtcacagatgacgtactgccaggcgtcgatagcccgtatgttttacctaaagctgtcgatcgttgtgtcagtacagaaggtgtcgctgccgacttagccgccactctatgagttggcatcgcgccacccacagaaatcaagccgatcagcatcaccacccacaacttgccatctttatatagcttgctatgaactttttcttctccaattggtctcactgctactgctcccttcagaaaccagccaaaagcccttcaaccaaacctttgaaataaatattttaatttacatacaaattataacacgtggtattggtataaaaactttcgaatggattcttgggctaagaaaatatccactttgaagcattcggataactgatttggacgcagaaaatgacacttaaacgggcgttttatttttcgtaaataccatcgagctaccgcaaattacgtctgcggaagacaatcaggccaagtatcaagaagatactaccataagcaaggtagccgatcatcatctggttaatgcctaagtgagtcagactcgaaagctttggcgagttcagttgtgcaccgaagttcaacatattcactgggttccatttgagccagtcatgttgatcaatcagcataaacatcagttggttaaagaccgagacaacaaagtaggcactaatgccgacgatgattgcaggcgttgagttatcaaataaagtggccagcagtaacacaaaagctgccagaaaaagtaaagtcaaaaattcgctcactgtattcatcaacatcgcctgccaaatcggctgatgcgtgctaacttgcaaagtcagactaaatttattttggaaaaagatcacttttaaaagaaaagtcatcacgaggctgctgccataaaagcaaagtgcacagcccagcaaggttaaccacttactaaccaaaactttgctacttgaatactgccgatacagcaaggccttcagcgtgccatactgattttctgatgacagctgcgtactgccgactgcaataatataaaagacaatcatcaccggcgcataaaagtcgttgagaaacaaattctcaggctgaaacgtctgtggataaacctttccgaaaattgccattgccagttgaaacacaatgagaaataaccagaatatggtaaaggatggtctttttaagagtttgtaagtttcctgtttaagcaatgtgaacaaaataaaatcctccgtatcgtcgcgatcactcaatgatgcctaaaagtgagttttccaagtcatcctgttgttcgtgaatgtcgtggatcgcaatattctgatccagcaccgcacgcaacaaagacgtcatattttgaattgaattcctagcaatcttaatgctgccttcttcgacagcagcttgataacctttctgcaataaaagttgcgccgcgcggtcgttctgatcggtttgcagcaagagataactttcatttctggctaacaccacgttcatggtattgcttgtgacaagatggccatgattaataatcacaacgtcgtcagccactttttgcaactcgctcaggatatgacttgatataaggaatgaagtcccttctgcttttttctgaaggatcaattcgcgcagttctcttgttgccttgggatcaagtccattcattggctcgtcaaggatcaccagacttggctggttcaccaacgccagcgcaattccaagcttctgcttcatccctagcgaataatgtttggcttttgaatcggcataggaggtcaagtgcatctcttcaatcactttgtccactttggcttgccgatcagcgcctctcgtaaaaaggtgaagctgttctcgaccggttaaataaggatacagacccggatactcaatcaaggcgcccacatcttttaaagcatcatgactgttaacggtgatcttctgatcattcagccgaatgtcaccggtaaaattcgaaatgcccaaaatggttttcataatggttgttttacctgcgccatttgccccaatcaggccgacaacccgtcccggtttgatttcaaatgaaatttggtgcagcgcttgtttcttcccgaaccatttatcgaggttattaactgttagcattaagtcataccacaactttcttgatgagattgatgattgtcagcttcatttgctttaaacatccactctagatataagaaatataaaattccatcaactttggagatacgtacaaaattcatctgacactttgccttaattgccagacttgattttgacatcttttaatggtgttaacttaccacagcaaaagaaacaaactgtgctttttgacaaaagcgaatttttcaggtcataatgaatcggtagttgattttaagaaaacaaggagtcagacactatgggtgtacgcgatgctgggtatatgtttaagaagattcgccttgaacgcggtttaaggatctcagatatggcaggttctttgagtgctagcactgtgtcaaaattcgaaaatggccatactgacatttctgtagagaagttgtgtctcctattagataacgtgggaatggatacgaccgaattttttgaaattctcaaccaaaatcatgatacaaatgcctcgccagccgatctttcgcaaagagcgatggacaaacgtatgctcagatacgcgatggagcaagatgttgacggtctcaaacaattccggcaatctttctcgtcgaaatttaaaaagacccacgcccgtctgtataagctgcgagaaattatggtctccgccattattctcgacacccaagatgttcacgctctcctctctaaaaccgattctaaaactatcaatgattatttaatggggcgtgatacctggtacgccttggaatatgcgttgtatggcgattgtgtgccatttttacagcctgacgactttaatcgattatacgcaaaatttttggccattcactttgattttcatcaacgtcataactatctcgatttgtttttctctgcattctataatgtcggtgtttcgctgtattacaggtgtgaatatgcaaaagccattcaaacactcaaccgattacaggaacaaagtgtcccggataacctcttttttcttcgcattcagttgcgcctgctcaaacttttatgtacctacaagcttaccggtaattcaaacgccgccaatgagctgaatgccatggttaaagtgatctccaaaataagcccagcgtttggccgtagatggaaggttgatttttcttttcaggagccaattactgatgagcattagccttgttcatttgcgaagtaagcaaatgaacacactatgaaaaaagtgcatactcaaaaggcgctgccccaactcgggacaacgcctttttacatccacaatatttacttttccttatcccggatcgccttttgctggtgtgccggcttcgcgaagatcatgcgccccgcggccgtttgcagcgcgctggtgacgatgacttcgagcggtttgttcatgtagaacttaccgtcttcgaccaccaccatcgtgccatcgtcgagatatgctacaccttgttggcgttcggagccggatttgatgacggtgaccgtcatgttttctccggggatcacgtcaggcttcagggcattggctaacgcgttgatgttgagcaccggtacattttgaaattgtgcgaccttgttgaggttaaagtcattcgtcatgacgatgccgtcgagcaatttagcgagcttgagcagcttgctgtcgacttcggttaaatcgtcaaaatcgccttcgtacatctcaatatgaatgtctttatctttctgcatggcattcaaaatgtccaatccacggcggccacgcattcttttcatcgaatccgccgagtctgaaatcagttgcagctcatgcaaaacaaagttcggaaccagcatcgtgccttcgataaagccggtcttggcaatggcctgaacccggccgtcaatgatgacactggtgtcgagcagcttgtatttgcgaaaatgatcgccgactttacgctcgagcacttggtcgttgtccgtatctgccgtccggcggttgcggaaattcaatagccgccgccattcttcgctgcgtgtcgtacccacccgaaaacccaagtaaccgaataatagcatgatgatgagtggtaggaagatattcagcggtgcgatgaaccgatacaacggaattgaaataatcgcggccagaatcaagccgatcgtggtcgacaaactaccgaacagtaaatagcttggtgatttggtgtttagcgtcttttccagcacttttaaccgtcccagaatccagttgacgctgagactggccagtaacaggaaaatgatggcgccgattaaaccgttcgtcagcaggttgttaacaatcaggtgatgctgccaaccaatggcttcccaaagcgccggtaatgcgcccatgccgaccccgatgccgatcaagccgaaaatcaaataaacaattcgtttcttcatggtatgcctcctctcttcttctaattaaaaaccttatgcaacgcttcggcaatgcttgtaaccccaatgacttgaatatctttgggtgcgtgccagccttgtaggttgttacgcggtacgaaaatccgcttaaatcccagcttggccgcctctttgacccgatcttcaatgcggttcacccgccgcacttcaccggttaagccgatttcaccgacaaaacaatcagtcggcggaatctctttatcgcgatatgacgaggcaatcgcaaccgccatcgctaagtcaatcgccggctcatccaacttaacgccgccagtggctttcaggtaagcgtcctgattctgcagcatgagattggcgcgcttttccagcaccgccataattaagctgacgcgattatgatccaatccgctgctagtacgtttggcattgccgtacattgtggggctgatcagggcctggatttccaccagaatcggccgcgtgccttccatcgataccaccaccgccgaaccgttcgccccggccagccgttcctctaagaagatttccgagggattggcgacttcctgcaggccattttggtgcatctcaaaaatgccgatttcattggtagagccgaaccgattcttaaccgaccgtaaaatccggtaagtgtggtgcatatcgccttcaaaataaagcacggtgtcgaccatatgctcaagaattttaggcccggcaatcgcgccttccttggtgacgtggccgacgatgaagatcgtcacccctttagatttggcaatacgcatcagttcggctgtaacttcgcgaatctgggcaaccgaaccgactgccgagttcatatccggtacattcatggtttgaaccgaatcaatcacgacataatccggctgcatctggtcaataacaccttcaatgctgggcatgtcggtttccggatacaggtacatccccgaattggcaacccctaagcgcccggcacgcattttgatctgactggcactttcttcgccggacacgtataaaacggtaccgccagtgctcgctaactgtccggacacctgcaatagcaaggttgatttaccgattccgggatccccgccaatcaaaaccagcgatcccgacaccacgccgccaccaagcacacggtttaattccgccaaaccggtcttaacccgcgtttccttggcaaccgtcacttcatccatccgcatcggcttgactttactgcctgcccgcgtctgccgcggtgccgacttggttgaactgacggtttcttcaaccaacgtattccaaccgccgcaattcggacagcgccctaaataagtggctgaaatataaccacaattttgacatacgtactgtgtttttgctttcgccatattatcccttcaatattaactagtgatcggttgacccaaaaccgctttgccgcttagccagtccgccttgatcgccatcggccagtaaaaatggcatgaagatgccctgcccgatgcggtcgccttttttaatcatcacgtcgcgggggaagaaattcagtagctgaatatagatttcgccttcgttgtccggattgttataatagtcggcatcaatcacgccaatcccattgggcaacgtcaagccgtgcttgagcggattgctggagcgattagccagaatcagcacttcattaggctgcatatacgcctttataccagttggcaccaaatacggtttcaagatctgctcagcccgttcgaaatccttgttggtcagtggacgttcattcttaatcagccggaaaagccgaataaaatcataccgccagatgctttttagcaagaaatcctcacgcgcgtaaaaatcatatcctgccgcctgctttgtttggcgtgtcggcaaggtcaggtcgtcatcctgatactttgaaacaatttcaaaaccacgggtcttcataatgaacctccatataagtagtgtccaaggtatcataacacgtggcaccggctgacaaccatgctgaaaaggctttccttcttgtaattataccgttttcttgctaaatttggagtgcggacgcggctggtcaatcgcattaacaaaattgacctaggcgtcacggtgactggattcggtaaaagcggcgctgacagtgcaatgcgttggatgctcaaccataacgcgccagttcacgctcacgcacttttaccaaggaggctaatatggaatttcaacacgaaccgggccggattttcaataccgactgggatggccgtctgctggccgaattaacgtatcaatcaattgacgacggccaggcatgggcggtcgatcacacttttgttgacgaaagccttcgcggtcaaggcatcgccggccaactcatcgaagcggtcgttgccgccgcccgtcaagaaggcaaaaccattgaaccactttgctcatacgcagtgcatgcctttcacaatcatccggaatatgctgatgtcttgcgtccggtgaaggataactgaatgacgttcgcgtaatctaggatccaaacttcatagaagcaaacgtgctaccgattgtcaaaaattggcagtacgtttgttttttgtttcggctagatagttgttttgaatcttaaagaccgtagtgccaaagcggagcaatcggaggcgggggcgggctcagtggtgacattgtactagccgggcgatcttcccggcgtagtacaaggccgatctttgagactctgccggttttgcagaggctcaaagtcgtgcccacccctctagcttcgcggtcgccagcccttgcccccgccggagaatgcggagtttggcacggcatgaaacatctaccgtaacatctttctgcgtacgccaattttattcaagtccatctcacatctttaaattcaaattaaattgaggtaaggtttctttaatgcactaagaaaaggggctcgctatgtcagaaattacatttgatcagattaaggcgtttcaagagcagctcgcgcatcatcccgccgccgctgcccgcagtcgcgcggtccaaaacgtcggaccacaggcggctagtcgcgaagccatcgacggcgaggacatgaagccagtattctcgctcgaccttgacaccggcagtgttgccaaccagaagaaaagcggccgctgctggttatttgctacattaaacacggttcgccacggcattgcggatgaattcggcctgaaagatttcgaattctcgcaaaactacaatgcctttttcgaccggctggagaaagccaacttattctatgaaaatattttggcaacggccgataaaccactcgacgatcgcgaagtcgctacctacctcagcggaccggatcaagacggcggccattatgatcaggccgccgcgctcattgaaaagtatggcttggttccaaagtccgtcatgccggaaacatacaacagcaacaaaacggctgaattaaacagtgtcttgaacgagaaactgcgcaaagacgccaaagtcttgcgcacgctgaagcagcaacatgccagtgaagacgcgattgccgctaaaaaacgtgaactactcagtgtggtctatcgcattcttgcctatacttttggcaacccgccgacgactttcgattttgaatatcgcgatgacaagaaacaatatcaccgtgatacgggcttgaccccgcaaactttcttcaaaaagtacgtcaagtggcattttgatgattacatcgtggttgccagcgatcctgagccaagcaaaaaatatcaacagctctatgccatcaaagcggccaataccgtggttgaaggccatcccttaacgatcctgaacctcccgcctgaacgcctggagcaactggcattggcacagctgcaagccggtgaagtcgtgtggttcggtaatgatgtcttggccgatatggaccgaaaatccggtacgctcaaaggtggccttttcaattacaacgacttgttcgacgttgattttcacgtggacaaagcagatcgaatcgtgaccaccgaagccgaaatgtcacatgccatgacgttcaccggtgcggatgtcgttgatggcaaggtaacaaaatggaaagtcgaaaattcgtggggcaaagacaacggccatgacggttactttgttgccgatgcgagttggtttgaccagtacgtctatgaagtcgtcgttcgcaagagcctcctgactgaagccgagcaagccgcccttcaaaccaccccgatcaacctgcctgtgtgggattttctgaattaaacacgggttatatgctagactatgcttgtcgcttcattcaggcgacaagggcagccaactggatattgcaaccttttgactgcctaatgttttatcatcaaatgtttaataaaaaggagtgtctatcttaatgtctgcagaaattacttctggcgatctggatcagttcaaacaggatctgcaagccacacccggtgccgctgccttacaaaaagcggttatgaacaatggcatcaacgccacggctgaaaacaccgacagcaaagtggccatgacgccgactttctcgatcgaacttgagactggcgccgttgccaaccaaaagcaaagcggccgctgctggatgtttgccgcgctcaatacgatgcgccacggcatccaggccctgttcaagatcaaagactttgaactttcccaaaactataccaacttctgggataaatttgaaaagtccaattatttttatgaaaatgttttaaaaaccgctgatcaaccactggacagccgtaaagttgcgttcctcttggccaccccgcaacaagacggcggccaatgggacatgttgtcggcattgatcgaaaaatacggcatcgtgccgaagtcagtgatgccggaaacatacaactcaagtaagagtaacgaattaaatggtttgctcaacctgaagttgcgcaaagacgcggttgaactgcgcaagttagtggctgacaaagctagcgatgacgatatcgaagcagctaagcaaaagatgttggcagaagactaccggattttggcttacgctttaggcaacccgccaactaaattcgactttgaatatcgcgacgatgataaaaactaccatatcgatcgcgaactgaccccgcaaactttcttcaagaagtatgttggctggaaccttgacgactatcaaagtattatcaacgcaccaacggccgacaagccatacaaccacctttataccgtagaaatgcttggcaacgtggtcggcggtcgcgaagtccgccacctgaacctcgacatcgataccttcaaggctttggccatcaagcagctcaaggccggtgagtccgtctggttcggctccgatgttggtcaaagttctgatcgtcaactcggtattctggacaccaacatctacaagaaagatgacctcttcaacaccgacttcaccatgacaaaagcagaacgcctcgactatggcgaaagtctcatgacccacgccatggttctgactggcgttgacattgttgacggcaagccaaccaaatggaaggtcgaaaactcttggggtgacaaggtcggcgaaaaaggttacttcgtggcaagcgacgactggttcgatcaatttgtctatcaagtcgttatttccaagaagtacctgccaaccgaattgcaggacgtcatcaaaaacgaatacgccaagccaaccgttctggcaccatgggatccaatgggtgctctggcatcaagatagtgtcagtgaattgaactggcggcgataaaaatagggacagaagtttttcggcacatgggatggtcgaagagcttctgtccttttttgtctggcactgaaaaattaaaaatgaatgttcgttgatttactttgagtcgcgttttactgtcagtcccattcactgggcagtatgtcttgttctagagtaacctctgcttgtcttaaatcctgtctactccggtcactttcaaacgggttgtggcgtgtgggtaggtaaacaagactgccgtcgctacgctgctccaccgtgaactcggttccttcggcgattttgagttctttcgggactgtcagcgtcattgtgttgccgaccttttttgctttgatgatcatgagaatcgcccccttagatattggcagtatacaggtcggctgtcgattttccaattttgttaggggagttattggcggtctgcgaagtttatatcatagaaggacgatactggatgtatttgcggttatacgaaccaacgtgtcattgccttgactgcggcgctaaagactgcccggagttctccgagactgaaacgcgttcgcagtcgcagaaatctacgtgtaaggacctcaagcctaaatggccaaaaaccagccattttggcttgaggccgcttacactccgatttctaaacgctcctgctcacgctctacccattttatggtattctgatggcaaccgaattaaagtcatttttcgaaatggaggccgggcatggggacacagttgggttttgattggcgtcaaatggttcattcgcggaagaatcttgccttggcagggttgtttgttgcggcttttatcattggcttttttgccttgatgtggacgcatcgcttggacgtcggacagacggcgcaggcgacagcgaatgcggcggtcgctaattatgccgaatataacttggacacgttgagcaagtcgcagaagccgttgctggcgaatctggacgctcagaattcagcaaccggcgtgattggcttgggaattaagcttggtgagcccgatacaacgcggaacggcttgctgagcttacgcaatgcgcagctggagatgcggcagcggcattttaaagcgatcaacacgatgccattgccgccgcttcatcagctaaaaggcgatgttttgaccctcacaagactaaaaaatgatgacaaacctgccgttaccggggtgacaaccagcagttcttacatagtcactatcttgccttatctcagttggctcaccggcgcggcggctattttgcttgcctgcgatagttgggtcgaacggcggcgccaccagacattgatgaccgcacgtccgttaacggctggcgtggccggcagcagtcgggtcctgacgttaaccggattttatctgcttattctggcggtcggcttgctggtgatcgttgcgttgccagcaatgtttaatggcctcggcgatactgcctatccgctagcggtcatgggtgagaccttactaccgctttggcaatatcttttgccgttcggtggtctgactctattggcaggtatctggatcattacttgttgcatgttgattaacacatgggtaacaaatgcttatctgacaaccttcattgtgaccgcagctgctttattgccacttatgctgccgcaagtcttccgctggctttggttcctccctttgccgtatctcgatagttacgccactttaagcggcacgctggttgaccggctcaatcagccgcttgccagcgtgggcgtcggtgcagccctgttacttggctgggccatcgtcaatctggggctttttggctatcgcgttaaaaaggaggatgcctgatgcgctattttcggtttcaactccaccaactgctcaccaaccgcaaaaacttagccgtcatcggcattgccttggttgcgctactgtgtcaatttgtcttttttccacccaacaacgtgcctgccgagctgccgacaagaaatgcgctgacccgcgatcgcgataaaaatgtggcttttgtcaatgagcctcatggtcccctgacagctaagtgggtaccagctacccgtgagtttgccaacatcgagacacgcatgttaaacgcccaaaagcaacagcacacgcaatcgtatgtgaaggcaaccttgcattatctggcatttttaggtcaaaacgccgccaatcctgatgcccaatccagtccatttcactatccgctttcctattattttgaaaatcgccagtatccagatgccgacgcggcctttgccaatgcgaccatgtaccgttccctggaaccgctggctaaacaagcccatcccgacacggccacggttaagcaacagaccttttggcaaaccctgtttcgtggtgcgtccggcggctggttgacggcgttattgatcgtcacgattttgtttgccaatgatttgctgacgcgcgaacaacgccatcgcagcattgcccgcctgttgcctatcagtccctggcatgctgtcaatgccaaaacattcacggtcttcaccgcattatctggctttttaatggctgcgattgcaatcattgcggcttttgtcatcccgcaacacggcctggggtcattgtcggccacgattgcgtattatgcgaaagacggcatgtcgattaaactggaccccttagtgcttggcattgcgctgccgacgattctgggcctaaccctcttattaatgtggctgttcattcgcctgaacctgttgtgccagtcgctttttcataacgaattagttgggctggttgtcagtgcctttttactatttggggagccactttatttcatgcacggcattgccttttcggttccgcaaacggcttactatctaccgggttacatgaatccggcggcaatcgttagcggcttacagaattttcgttacgataccagtcgcatgagtccgctggctgccgtcgtcgttattggcagcgtgattcttattcttgaagtcttactgttcatcgtcacgcatcgccggcgcgccgccattatcaagtaaacggaggtctcacaatggaactgcaattacaaagtctcgctttgagttttaaaaataagccgcatgtcattgacaacatcagtctcaccatgagcagtggctcgattgtgggcatcgtggcgcctaatgggacaggtaaaaccaccttgttgcgcctgatcttgaatgacctcaagccgcaatccggtaaggttgtcttagacgggcaaacctatggcagtcaaaagcaaagccttgcgatgcatcggcaaatgtgtcttttcccggttcaagacgacctttatcccgacttgtctggcaaagcgcatcttgactattacgcgcgactttggcataaccggaaaaaaagcgtcaagcaaatcatcacggcactggatatgcacgattatgtcaatcagccggtgcgtacctattcgatggggatgaaacagcggctttgctttggcatggtcatggcggcaaacacgccgattatgctgctggacgagttcatgaacggtctggatacgatcaacgtcgcgcgcatgtcgcgaattctgcgcggcttgcgggcggaaggcaagctgattatcaccgtgtcgcacttattgaacaatctgcagggctatgctgacctgatctactttatgcgtgatggtaaaatcatcaaaacgatcgatcaacatcaacagcagcccttgtacattcaagtggcggccgacaacgccaaccgtctgccgcggatgccgtggcaacattacccgaatggcctattggttttgccggttaatgaacttcccggccaacatttcaatcaattgttgctgggacttgccgcacatcacattgcctttaaattggcaccgctggatcttgacacttacttcaatgaattttacgaagccgagcgttaatagacagtttgttctaatcggccaaaaccgcttatccgcggctttcgttgcttaatgacaatgatcgcacggaattttgtaaaatgaattaagcatatctgccttacattggcgcatgtttctgctacaatggcgttattacttttcagggggtgcacgaatggcgtcaggcttggctgctaataagaagctgcagcataaaatttctgccgcagctttacttgtaacactcggtgttgtttacggagatatcggaacatcgccgctttatgttatgaagtcaatcgttgccggaaacggcggcatgggacactttgataccgattttttggtcggatctgtttcgttgattttctggaccttgctcatcatcaccacgatcaagtatgtgttgatcgcgttgcgggctgataacaacggtgaaggtggtatcttcgccttgtacacgcttgttcgccagcgtgcccgttggttagtcctgccagccatgatcggcggggctgctttgttggctgatggcatgttgacgccggctgtgacggtgacaacggcgattgaagggctcaaaggcgtccacatcaatggcaatattctgattgacaatcagcaacaagtcatttgggtcacgatttttatcatcacctttttgttcttcatccagcgctttggcaccgatctcatcggcaaggcgttcggccccattatgtttgtgtggttcacctttttaggcgttgccggctttctcgcattgtcaaaagactggtcaatgttacgcgccttgaatccttactacgcgctgcgtttgctggttagcccggataataagatgggcctgtttattttaggcagcattttcctggcgaccaccggggccgaagcgttgtattcggacatgggccatgtggggcgtggtaatatttacttaagttggccttatgttaatatctgtctagtgttgaactactttggccaggcagtgtggctggaccgcaattcgcatgtgacggcgtttaacaaaatcagtgatttcaacccattctttcagatgctgccggaaagtatccggctgggtgcgattattttggcaaccttagctgcgattattgcgtcacaggccttgatttccggttcttacacattagtttccgaagccatcaaactgcgcttcttgccgcggttgcacattgtttatccaacccggcttaaaggccagctgtatatcccggttgtcaacaccattttgtgggtggcgtgcctggcaatcatcgcctacttcaagactagcgccgaaatggaaggcgcctacggattggccatcacgattaccatgttgatgaccaccttgctgctgtatcaatacttacgggtccaccacgcgccaactgtgatcgcactgggtaccttgatcttctttggcgccatcgaaacggtcttcttcatttccagtgccgttaagtttctccatggtggctatgtcaccgcaatgattgcctttgtaatcctagcgattatgtttgtctggcaatacggcggtcggattcgcgacgacaacacgtaccgggcagaaatggcttcactattcgcttataaaaaacagctttccgaattacgtagcgatccgaactatccgacttataccaccaatttggtgtatatgacccagattgccaatgaccactacatcaaaaaagaaatcctgtactcgattctggataaacggccaaaacgtgcccaggtttattggtttgtaacggtcaacgttaccgatgaaccttacacagccgaatacacgactgacacttacggcaccgactacatggtcaatgtccaactgttcctaggcttccggatggagcaacaggtcaacgttttcctgcggcagattgtcaatgacatgatgcgcgaaggcgaattgccaacccagccgcagaaatacaccaccatcccggatcggcaggtcggtgactggacgtttgtacttttacatgaggaactgtcaccacagactcagatcaaaggcttccagaaaacgatcatccaggcgcggctatggcttcagcgcgtgaccgtttcaccggctcaatggttcggcctggaatatgccgatacactcgatgagaccgtaccgcttgtgcttgggaagattccgattaccaagttaacgcgactaagcaggtcgcaggttgatgctcaggcggaagacgaagacgattaagtcgaaaatcaaattaattaaaaaggtgcaccacaagtcatgaagcaaattttgctgccgacttgggtgcatctttttatatggtctgaatcgcggtcatttgaccgcgattatttttacatcggtcattgcggattacgaacgggcctttgcctttgtcgtggcccgcaacgttgcctgagccgcggccagtcgcgcaacggggacgcggtatggtgagcaggaaacgtagctgacgccgatgctgtcaaagaaagcaacggaatctggatcgccaccgacttcgccgcagacgccgattggcaattgcgattttgtcgcacggcctttgtcaattgccatcttcatcaacgtgccaaccccttcagtgtcgaccgtttggaatggatcggctggcaggattttcttttccaggtaggctggcaggaatgagccgacatcgtcacgtgagtagccgaaggtcaactgggtgagatcgttggtgccgaagctgaagaaatcggcagcgttggcgatagcgtcagcggtgacacatgcgcgcggtgtttcgatcatcgttccgacttcatacgtcacctgaatgcctttagctgaggtcatctgttcgatttcgttgctaaccagtcggcgtacccaacgcaattcggtttccgagttagtgagcggaatcatgatatgcggcgtcaccgtgacgccttcatcggctaaccggaagaccgcatgcatcatcgcccgaacctgcatggcgtagatgtccgggaaggtaacggctaagcgatcgccgcgatggcctagcatcggattgacttctttcagcgccgccatccgctcgcgtaactggttctgctctagacccagctcattggccacttcgttaatttcgcgtaagtcatgcgggagaaattcatgtaatggcggatccagtaagcgaattgtgacacttttacctgttgccagacgatataaatcgtagaaatcctgttcctgcattttctctaaggcagccagcggtgctttgcggccttccgcatcttttgccaaaatcagccgccgcatctgcaacaaccgctccggctggaaaaacatgtgctcggtccgagttagcccgatgccatctgcaccaaaagccagtgcctgctgcagatcctttggcgtgtcggcattggtgtaaacacccatccgactcgctgctttggcccagtccaacaaggtggctaggctttccttaaccatggcggcggtggttgtgatgcgcccgcgataaaggtgcccggttgtgccatcgaccgatacccaatcgccttcatgaagcacaatgtcgccaactgtggctgttttggcgtgttcatcgacactcagcgcgtgcatccccacgacgccggtggctcccatgccgcgggcaaccactgctgcgtgtgaggtcatgccgccgcgagcggtgacaatcgcctgactgacgatcatcccttcaatgtcctccggtgaggtgtcctgccgcatcaaaataacctgatgaccggcttcgtgcgcggctttggcctccgcagccgtgaagtaaacttcgccggttgccgcgccgggagatgccggcaaaccggtggctaaaacgtcatgggcggccaatgcctgcgggtcaaattccggatgcaacatgtcactcagcgatttcggctcaatccgcattaaggcttcctgccgatcaatcaacccttcattgaccaaatcgacggcaattttaaccgcggcagccggcgtccgttttccgttacgcgcctgcaagagatagagttcgccatgttcgatcgtgaattcaagatcctgcatgtcgcgataatgctgctccaaagtcgtggcgatcgcagccagctgatcgtagacttctggcatttgctcatgcaagaccgcaacgggttgcggcgtccgcacgccggagacaacatcctcaccttgggcatttaaaagatactcaccaaacaaggcgcgtttgccggtcgccggatcgcgggtaaaggccaccccggtaccggaatcttcaccggcgttgccgaaaaccatggtctgcacattaacggctgtacctaaatcttcaggaatatgattttcgcgccggtaaatcactgcccgccgattgttccacgattcaaacaccgcaacaatcgccgctaagatctgagctttgggcgattgcgggaacgatttgcctgcgtctgtgtaaagctgtttgaaggcctggataatccgcttcagatcatcggtggttaacgccagatcggacgtgtaccccttttcctgtttgatcgcggtcaaaacatcatcaaacgcactttccgataggccgtagacgacattgccaaacatggccagcaatcggcgataactgtcataggcaaaacgcgtatccgccgtcagcgttgccagcgcctgcacggtttggtcgttcaatccgatattcaaaatcgtgtccatcatgccaggcatcgaaatcggtgcgccggaacgaaccgaaaccagtagtggcgcggtcggatcatcaaaacgtttcccggtagcctgttccaatgcctgcaaatgttcgtccagttcagccaacaaggtatctgacagagcatgttgctgctgatagtcgtggcaggccgccgttgtcatggtgaatcccggaggaaccggtaagccaagattcgtcatttcggcaagattagcccctttgccacccaataaagcccgcatctccatgttgccttctgcaaacacatagatttgtttcatcacaaatcctcccatccgttaaatatgacgttatatatgttcgctatataatgtattatttagctcttgaaattgcaagcgtttacacttgaaaattggcctatttgttttaagtttttttaaagcacgaaaaaagccgctggcagtattcgccaaacagcttatggggcaagggtttcgatcagatatttaaaaatgcgattcttggtaatttttccaatgacatgcgtgtcaccacggttttggactactggcaatgaatcaacgttgtgtttaagcagcaacttgctggcgtccataatcgtggtatcagccgtcacggtgacgacattgggcatccgagtcatcacgatactggcaggcaatgtcgtgtcgcgaccagtaaagctggcccgcagcaaatccttacgcgaaatcaaaccaaccaaggcgccgtcatcatccagtacatacaaggaaccgacatcggcgataaaaagcttggtcaccgcttcttccatcgaggtcgtgagcttgatttccgttggtggaagcaggattttggcaattgccgttttaaacaacacctcgttgccggccggtaaaatgctggcaccctggtaggcgtaacccactttaggccgagcgtccagaatgccaatggttgtcaacagacgcaaatcggcccgaatcgtggccaaactgatttttaacttggccgctaatgtttccccggtcatggggctgtcagccttcaacagctgaacaattttacgttgacgtttggtaagttgcgtaggtgccccctcctttttataatcaacagtataacatttttgagatatatgacgtgatattcaaccttaaaaagctggaatatgccaaaagaaatccggcacatcgggtaaaccgaccttgccggaattatcttcaaagcgtttgttttttaagaatcttcaagtgatcatcaagtgtatagacaatcggctgcgcattgccgatttcgactttgttgataccggcgtcgctgatgtcttccatgtacttaaccagcgcccgtagcgttgatccatgggccacgatgagctgattcttgcctgccatgagccgcggcgccaactcggcactccagtacggcagcaagcgttcactcgcatccgcaagactttcaccccgcggaataatggtggccgggtactggtggtaacggcgcgaacgactgggatgcgccagcaacggcggatgcgcgtaaaaactgcgccgccagctggcaacctgatccgggccaaaaagtttgcgggtcaggtctttgttgatcccgcgcagtgccccataatgccgttcattcagtcgccaacttttggtaatcggcaggtaattctgcccgatcttgtcctgcacaatgtaagcagtcatgatcgcgcgcgacagcacactggtgtggacatgatcaaacaggatcccggttgtcgcgatcttgctgccggcctcggctgcttgagccttaccatgcgcggttaaccccacatcggaccagccggtataagtattttgttgattggcaatgctttcgccatggcgtaaaaggactagtttgaccaaatcgcaacctccctaaccaaactagtataacaatctcagcagaattagggtagtccgaccgaatccgaatccggcttggcagcaactgctttgccgccaagtcacgaaaatgataggctactatatattgagacaagcaaggcgagcactgccttagcttttagaaagaaggatgctcatggccaagtcgcttcgatcggtcacgatggtcgagcttttttatgatttgatttttgcctatgctgttggtcgcatggcgcaaaccctggctttgccggtgcatggcaggatcgcaccgcaaataatcggggaatttttattgatgctgctggtgttttgggtgatttggacctaccagaccgtcttaacgaatcagttttcccatccccaatggcgccacaacctttttagcctgttcaacatgttctgggtcatcgttttaagcaccgccatcaccagcgatctcgctacaaccaagtggccgtttcagttgagtatggcagttctatttttgagtctggcaagcgaatatggcctgacttggcgaaaaagtcatgcgaccctcgccaaaatatccggactgacacttgcgaccggtagtgtgattgccttgatatcgctctttctgaagccgtacaccctctcgttcgctgtcttttttgtggcaattatcggcgccgctttgatgccatccctggtttggcgaccaaatagagccccactgaccgatctcgcccatttaagcgaacggtacgcgttactggttttgttgatcttcggcgaatcgattattggcgtggcggacacagtctatgccggtctttccttcccggcagcacttttcttcctggtcgtcatgctgttgtttgtggcctatcaactcgtctatgataacggcctcaatcgccggcagaaaaatggcggtttagcggtgatccatctgcattatccgctcatggccgcgattctcagtctcagcacattgatccacttatggttggcgcacttacttgatccgcagtggtttgcttttgccatcaccctcactttggccgtctactatttcagtctcatcggctacctaagtgcttatccgatcaagcggattgacattggctttaagcgctggttctacttgggtttctcactcttgatcttcggtgtttacagcttgatgacatcggttatgccgctacccttcctgctcggcttgaccgcctatctcctcgccgacacactttatctttggcaattcattttgcatcctaatggaccaatgtattagggtgtataatcaaagagtgtaaaccagttcactctgaactgataaatgcatccaagaaaggagaggatgttaccagcactcaaatatgtcgaataatatggaattaagcggtacaacatggacagaataattaagtggaagctgtccgtgtgttcaaaccaagctaatctgcgaaatgtattgacaagagcctgaatcggtactgtatgatggttcttaccaagcgctagtattggtttgaacgtctactccaagcttcttctcaagtagcgtttaaccagctaattgagaggaggtgacaacttttgattaaaacgcataagattaaactctatcccaatgcaaccatgcggcgtgaactggaacgattgtttaactatcgccgattttgctggaatcaagctctcgaaacgtggaataccatgtatgatgcatctttggtgatggcagacaaaacgttgcggcctaatgaacgcaaagtacgggacgaactggtttggaataaagccgattggcagtacgaacgatcggctcaagttttaaagcttgcggtaaacgacttaagcaaggcttggaagaactacttcaatccgaagatgccagatcacgataagcctaactggaaatctaagaaacaatcccgaaaaacgttcaaaacggatcgagcgcaacttgtgaatggcaagttacgtttagataaacctcatggtgctggtgcctggtatgacatcaaactagccgagcaaccccgctggcaaggcgaactgaaacaagtttgcgttgttcaagacgcggatggttactacgcttcgttttcgattgaggtgtcaacctctgttgaaaaacggccggttttatctgtcactggggttgatgccaacattggcaagtttgactatcaaacgccaactggctatgccacccagtccaccttacctgagcgattaccaagaatttatgcccgtattgctcattatcagcgccaattagcccgcaaacgaaaagtaaatcccaagcgttttaactccaaggcttatcgcacaacgagaaccaagttgaagcgtcaataccaacgagttgaacggattcaaacggatttactgcaagagtttacgacgaagcttatcactgattatgatctcattgggattgaggatttggataatcaccatatgcgtatgaacaaacgtctcgccaagaatttgcatcgatccctgtttggcaagttcaaagtgatcatgcagtacaaggctgactggtatgggaatacgttagtactagcggatcggttttaccccagtacgcaacgctgttcccgctgcggttatgtgaaaaccgctgatgaacgggtcacgctaagcggcaacttgaaacatcgtaccggtcacgatgactatcattgttaccagtgtggcgttaagttgcggcgagacgaaaatgcggttgaaaatcttgtggcttatgcaaaatcaaaggttacggggtaggctatacccttaaagttcaggagacggtcactgtcgggctgatttatttcagagtgggaataccgttgttgatgggactaaatgaaatgtaggatgtcaatcaagaaaggaaatatataaaacctttattggtgtcaaagagacattcttccacgttttatatagcagagcttcacatgacaacctatgatgtcaccttcaacacagttgatggcaaatcactgatcaagcgtaacgtcgaaagcgaccacgaaaatgcccgggtttgggaagacgcggtggaacggtttgacgctgatcacctttacatcaaaatgaatgacaagacaatggtcagcctactgcggcgagccgttgtcagaatcgatatgacggaactgccaagtgatatcgaaaaacgcgctaatcgacgcgatgagttccgtaatgccatgtacacactgagccaaatcggcttgtagatcggctgtcaaaacccggtcattgaatgacgtggttttgatgatgaatgaacatatagctgacttgcttaattcacaagcacgccaaaaaaagaatccgcctcggctcaaagccaaagcggattctttttttcgtcttaaggatctaccgacaccgaaactagtcagcgtagttaaaatgggttaatggtgcgtgcttgacgtcctcaattgtcttggttccggcaagttgcatgatgatttcaagttcgtggtcaatttgctcgaacacgctttgaaccccttgagcaccgcctaaagccaagccgtaaataaccggacggccaaatgcaaccaggtcggcaccggccgctaacgccttgaaagcgtggctgccgcggcgaatgccggaatcaaagataatcggaacgcgcttgttgacagccttggcaatagccggcaaaacatcaaaggaagccgggccaccattcaactgccggccgccatggttagaaacatagacagcagctgcacctgcgccaattgcccgcaaagcatcttccggtgactgaatgcccttaacgatcaccggcaagtccgtgtactccgcaatgcggcgaacatcgtcttcaccgatcttctgtgcggcagaggcataaatttcgccgatacccttacctttgccgtcgccttcggaatacttttccaggtttggcattgggattgggaattgaaagttattaatgatatcttcttcgcgatagccatcaacggtcgcatcaacggtgaggataatccccttgacaccggcctttttggcttcatcaagcaagctcttgttaaagtcccaatccttgctcatgtatagctggaacaattgcggcgcaccattgccggctgctgctgtgtcagcaattgatgttgaactgtaggtgctttgtgccatcaagccaccaactgcagcaacaccgcgggcggtatctttttcaccctgactgtgtgccagtccttgagccgctgtcggcgccatcatgactggtgtcttcaagtcaatgcccaagaagctggtcgacaagtccggtgagtcaatattcgacaacgccttcggaacaatctgtgcatgattgaaagccttggtgttctcggctaaagtccattcatcttcggatccgccaacaatgtacccgaatccgcctgttggaataatcttctttgcttcatccgccaatgacggcaaattcaaaatattcagttttttctctgcatcgctctgttcgtaaccattaacaactgtcatgtgtcaaaaagcctcccaagttgcttacttattagaacacttattagtgtaacacttataattagtaagtaaaggcgttttgctgattttttgtaagtgaagatgcaaaggcttaaaaatcaacgtgcaggcgcctaacgaaaagcaaaaaggagaagcccgctactgcgtcttctccttaagtaactatcggccgtcttgtttcagccgttaatcttcttttttccctttggccttatcaaccacgtcattgaacttttcggcaatcttgtccttggcatcgctaagcttttctttcgcttcgcctaccatttgttcggtcttgcccttagcctcggttgattcgtcaccagtcaccttgccagcagtttcctttactttaccgctaactttgtcttttgctgcatcaaaatctgccatatgatcagtcccttcttttttacttactttaagtgtaccaagttgactgattcgctggctattattttgctcgtaaagatatgaattatttttccgggttaccgccatcctgattatcaaattcgagtgaaaaaaagaaccctccatattcatggagagtcccgcgatcatttcaaacctagtgccgtgcacccggccgtttttcttcaggtgctggcggaataaccgccttaccaccttttttaatatgcttatagttcacaaccgttttgttcttcatatcttcaactaacgaagcatcatcaggtgaaaaactgtcaatggtcagcatcgctgcattggcgtatagcttttcaacggttcctttgaaactcaatggcacatccttggttttacgcactgaaactttgtcgcctacaacgatatcttgtgacacacaaaaacctcctcttgaacgcggtgttttaaaaccatcagttggctgcgaaacatcgcactgggacaaaaacttaaataaactaagttaaggtgtggagattcacttagttgcctgcaccttgaccttaatcggtgcgttcagatcaaccgaatcactgtaatgctgcaacaagtagcgttgcatggcttcacgtgcttccttcttggtcatctggtgacagatccgcgaagaatcgtgccgatgaccccacttgtccgtgtattgacctacaactgcataatcacgaagatgcgctgcaaataacatgattcccctaaccaccttttctaattgtaccatgactcggtacgcgtatttgtatcacaagatgcatttatacaccctaattggctccgtttcaaccacttcagcgaaaaaagatgttacagttgtccgcagttcactggaccccagtaacatcaatggtttagcgactatgattctttctcttttaagagtcgattggctacccgacatctctttgaagcggcttgtcatatgttgtgtccagacgatcacttttactctgcttcattttattgaacgcaatgacggtccggccaatcaaatcctgcacgttgaaccgatcgcgcctgtcataatccagaatcttcacgagcgccgcgttttcgtaacatttttcgatttggccgatgaaagcatgttccatattgccattggcttggcacaaaacggtcattcctgtttttgcgtgtttcatcttaattgcctccttgtgagcgtgtgctggctcctgcgccagcgcacgcgttaatgaatttagttaagattatcaacacgaatatcttattgtcaacatagttattattttatatataaatattcatgctttcgtcacaaattgccgcagtagcagacgattgtgacgttgttttgacgtcaattaggcccttttttgtcccggatttatcttgacaacacaccgtttttaagaatgccaagcaaaagatagatcacctaatctgcaattttcaatattgacattcgcactaaaaaagccaacgatgatgtgcagtaaactcttggcaaggcgatgatttttgtggacaggcacgtttttggagcaactttttcttcactacgttcaaccaacttccgccgattttggatcggacagtgtatttcggtcatggggacttggattcaacgaactacccagacatggctggtttaccagatgaccaagtccgcttttctggtcggtttactggctgcggcccaatttgttcctattatggcgctcactttagttgccggcacgctgatcgaccgctatcccaaacgtcagatccttttgctgacacagtttggttttttggtgctgggcgctatcatgacgactctgacttttttaaaaatcattcaatactggcagatccttgcgatcgctttaggctatgggattcttcagagcttcgatacgccgaccaggcaatcttatgtgatcgaacttgtcgggcgaaaagatcttatgaacggcatctcgctgaattcgtctattttcaatctggccaaaattgccggtccgtctttggccgggatcctcatggtgaccatcggcgttgcgccgtgttttctgatcgacaccttaagctatattgcgattattattggcttgttcatgattcaccaggagcacccggttgcccggcacacaccgcgacatattcttgctgatgtcaaagagggccttgtttatattgtgcatcatgacaatgtcaaactgagcgccgaactcatgctgattatttgcacgttaaatttcaacaataacgtcatcatccccatttatgcccaggaagttctgggccgcggtgcccaaggctatgccaacctgttgtcggccactggtatcggttcactcattgcagcatttctcatgagttacctcgcccgattcggtcttcgtcgcgatttatatctgttagtcgcactaggaacagctttgatccaaacgttgatgatttttatccacgtttactggttagccatgatttttatgatcgtcattggcttttgcaatatggtttttctgaatcagtccaatgcggcgtttcagttttcgattcccaacgagctgcgcggtcgcatcatgagtgtctatgttttactcaaccaaggctcgacgccaattggcagtttgtacgtcggtggcctgatggacgttgccggtggcttatggggcttcccttcctgtggcttgctggcactggtgttagtcatcccaaccttgcttggccatcgcacgaccgttaagcactggttgcatgcctaaaatcgccaaaattcgtcatctgatgctgaatacgcaaaaaagagcttccaacgcgcggaagctcttttgcttgtaaatagacgcttgatgacaacatttttaatggtaaaacaatacgctaatcttcacgcacctggccattgcccagcacctgatacttaatcgtcgtcaacgcggccaagcccatcggtccgcgggcgtgcagcttttgggtgctgatgccgatttcggcaccgaaaccgaactcaaagccatccgtgaaccgcgttgaagcattcacatacaccaccgcagcatcaacctgttggagaaattgctgactgttttgataattatccgtgatgatggcttcgctgtgcttcgtgttgtgcgcgttgatatgcgcgattgccgcttcttcggaatccacgactttgactgccatgatgaggtcgttatactccgtgtcccaatcttcgtctgttgccgcgtgcatgcttggcacgatggcgcgcgctcgctgatcgccgcgcagttcaacgccgtgttcctgcaacgctttggcaatcaccggtagctgctcgtcagccacatctgcatgaatcaaaagcttctcggcggcattgcagacagatggccgctgaaccttggcgttgaccacaatcgccactgccatttccagctgtgcctgggcatcaacataaatatgacagttaccggcaccggtctcaatcaccgggaccgttgcctgctccacaaccactttaatcaggccgcgcccgcctcgcggaatcaacacatcgaggtaatcgttgagatgcattaattgattggccacttcatgccgcgtatccgtcaccaactgaaccgcatccctcggcaacccgtgcgccgccaacgcgtcttgtagaaccgttgctaatgccatattgctatgcaaggcttccttaccgccacgtaaaatgaccgcattgccacttttaaaagtcaacgccgcagcatcaaccgtcacgttcggccgcgcttcataaatcatgccgacaacgcccaaaggtactcgcttctgggcaatcgtcagcccagcgtgattcacccaagcacgatcggtttgggcagtagggtcgtccaggaccgccacctgccgcacgcccgccgccatgtcggcaatccgtgcttccgtcaacaccagcctgtccttgaatttgctcgtcatcttgctggcggcttttagatctgcttgattagctgccaaaatcgtttccgtgtgcgtctccagtgcatcagccatggccagtaagccggcatttttctgcgccgtggttaattggccaagaatagctgcggccgccttagccactttgcccatttgttcaagatcgatcgtcgttgtatccatttaaatcgtcccctttactatttgtgagccgcagtggctgacaaaatggctgactttttcatcacgtcatcttatatgtgtgcttttaaattcaactatttgaagcttggttatcaggtgacacttgctccaaaacgttgccaaaccaagttccgactggctcaccagcgacgatgcgcaggatgatccgcggatcacggccgcttgccagcaccatctgtttgccggcacgcatcatcgtttgcgcggcttttagtttggtcaccattccgccggttccaaatcgcgtcgagctcccaccggcgccggttaaaatcttggcagacaaatgggtaatttccggaatcagcgccgcacccgaatgccggttaggatcccgatcataaagcccgtcaatgtcagaaagtaccatcagcaaatccgcatcaatctgctttgcgaccaaggccgaaagctgatcgttatcgccaaaggttgtccgatgatccaactcatccacggccacactatcattctcattaatgatcggaatgacctgctgggcaagcaaagcatcaatcgtatcaagcacatgttggcgagtttgcggataatcaaacacatcatgcgtcagcaacaattgaccgattttggcaccataatcgctaaaccgttgcgtgtataacgtcatcagctctgactggccgattgctgcaagcgcctgttgatgggcaatcgcggcagggcgcgcactcaccccgagcttcgccatcccgaccccaatcgcgccagatgtgaccaaaaccaactcatagccttgattattcaacgcagttaaggcatacgccagccgatcgatcgtctgtaaattcaccttgccattttggtgaatcaaactgcttgttccgattttgaccacaatccgtttacaatgcattgcccgttttaccatcgttacctccgcacactacaactttctcagcattcaaaaaagcaccgttttgatcgagacacccgttaaggcggtaccattctcgttcaaagcagtgctttgcgctttttcatgatttaattagtttaagcttcaacctcaagcttggattcgcgaaccattcagaactttcagctagcgttctgatctctgtgagccgctactatgacttgatgaagtgaattgtatgcggcacacccggaaaagtcaagctttgttattgcccaatatgtatcttttgtcgaccgcaagcgatattgtcttaagtaagcagttagccaaagtgtcacaaaaactgtaacctcttagaagatacatctaggaggaatcacatgaagaaggttgtcttaacaatgaaagaagaagaacgttaccgagtcatcaaagcagtggtcaatggtaagacctccgtgcaacgcgcagccgttaagctcaagcgctccgaacgaaccatctaccgattgatcaagctttacaagcaacaaggcaaagacggctttatccatggcaatgccggtcgtgagcctgccaacaaacgcaacgcgcaactcgaacgccggatcattcatctgtacaccaacaagtatgccggtttcaacatcgctcatttccacgagttcttaaccactgccgaacaaatcgctatctccgaatcctcactccggctcttattcagacaccaccacattctttcacccaaagcccataaagccaccaagcgccgagtcaagcgtgagttaaaagaaaaagaaaaaaagtccaagctcctatccaaacgtgatgaagccaccttgtcagccatcgaggtcgttgaaaacatcaaagcccatccagaacgtcctcggaaacattattctggtgaacaggtacaaatggatgcttcctgggagtattgg

SEQ ID NO: 327 - DNA, 17382 bp, Lactobacillus casei
cgcagatgccaatcggtttttggtcggctttatcaagcgttacaatgaccgcttcgcatctaccatcaaaagtagcatgtcggtgtttgagaagcaactaacacccaaggaaattgacaatattttgatcattgccaatgaacgcagcatcggtcatggacactgtgttcgctttgaaaacaaacgctatctgccacaccgaaatggtgaactggtctacttgcccccgcatacgaaggttttagttatcaaaagcttcacaggcagactttatatgaccactgatgacgaccaggtgtacgaccttttctgtgtgccaaaagaacagttcatgtcagccaaattcgatcttacgccagttgcggcaccagctcctaaacgaaccaagaaaatcccggcaattacgcatccgtggcgccgcgccaactatcgcgattaccttgattctcttggcattaacaggacaagggttaaacagttggtcgccgaacgatatccatacaagaattcacaagcgattcaagtctaatcaggatcatctcgcgtccagttttcggacgcatgttttatggaatttactgtcaaagtcgaaaatcgcttgacagctttgttattgcccaatatgtatctttgtcgatcacttcgtcccacttattcacacggaatgtttgtgctttgcttttcgcacgccgaaccaccactgactaagggaagtaccgcatatacaagccaccaaaacccaccagcggaaaggcacacgaaaaattgccgcaagcgaataccctatcgccaaaacaatgataagggaacgcacaaagttatatcctgtcgttaagccagcgacaagagatcctgtgaaattataatgtttcaagtatccatcacctcttcggagcactgaaagttaataagatcgttgtttggtataagccttggtaatccagctgtgattgtattaaacgttgtgtcagtatagccgctgatataccaaacgtaatgctctttacaaaaatcttcaaaggagctcaatcttttatacttataagtcaatttatatatcttatgtttgctgattatacgttaacatcgctgtctgtcaacccagacaagttgcttttatatatttcgcacttactgccgcgtcactggcacgcgcaatgcataaattcgcggtaatgagttgcggccacgcaccggttggccattgactgtcaacgcttcctgcttcacgtaaacttttacgggtgaaggcagtctcaccgcataacgctcaggcagtcttaatctttcaacgtaaaaatggccatcatctagtttctgagtaattccaacaatgcctagttgatcagcctgggcaaggtaaacccccttggccgttagcgggttaccgacaagctgccactcgccgtttttcatgcgatattgtttgcgtcctttaatgtcgaagcggtaaaaagcaaaaatcccgccggcaagcggtcgctgacacccatccgggaaaaccgccatttgttgaaataacggcactgacttttgcgactgctgcgccacaactgtttgctgtgctgtgagtgatattggtttggtcttgacgccaccgccttgtaaccccatgacggctaaaatggctgcccccgcaatcaaaattttaatgatgatgtgtttcccccgcatttccccgcctccatgtattaatttttaaatatattaacaataagtttatcagtttgactagatgatttgctaacaatacacatgttattgaaaatgattctgcaactcacaaaattgtgcagcgcagcaacttgaaaacaagtaggattgcattcttaccgtgccattctgtgaatttgtcactttttaacgacatcaaaaaatcccgatccgtcaatgcgcttatggcaaagatggatcaggattaaaatatgttgtttatttataaactgcgactaggcgcggacaattttaccaaccgcaattggcagggtcacgtgcgcatcgtagttcatgaccgtgcccttgaccgtatcaggcaacttcagtgaatccggaacaccgtgaatataaatcacacgtttgtcgagttgcaaatcttcgctgccaaatgcggctttgaaagcctgttggagttccttcaaatcaacgagcttctcataggcgtaatgcccttccgcatcagcaaccggataactgtcatttggcacatgcatcttggcaggttcagcatcaaacggcaccatggttgtaccggaaactggctctgtttctggcaaatcaacgaaaccatcaccgttagcatcttgcgccgccgtggcaatttccgctggctttccatcaggaaaaccatggaagtgttcccaatgctggacgtttgctggtgtatcaaacatctcaatatggatccgcagttgcgcaccatcaaccgtaaattcagcggtgccatgcggcttcgtaccgattttctctgcattcaacggtacaatctctgccgtgtatttctcagccatataaatcagctcctgttatgatttttggaacacctttagaataacgtttattttttaattgctcaaattttaaaagaaaatttttaaaggcaggtgctcgtggtattcgttttggacaactaattcagctgaaaatactttagccatgcgttcttgtccataagtgggtatactgattttaaatttactcgcgactgaacgaggggggagtccaatgttagttcacaaaccgaaatactttttctggaaggcaattggtgtttggttgattgcgattggtgctatgtatttggttgatgcttttggtgagcacattaggttgaacgatatgctgcaaaatatataccgtggcttggttctgtttggcattttactgctcctcaactggctgttcattcatcaaaaagttagctggaagccaagcttaaccatcttcaacgctttgctactgggaattccgacctatctctttgtttgctatgtcacgtatataggctcgcaacaacttcatctggactacgattggccttttgccatttccgtggggctcgctgccggcccttttgaagagtatctttgtcgcgggttgctcttaggcctgttacttaaaacttttaatcgccattctaaagtgacccagatctggatggcagttcttatctcaagtctgctgttcgggttattgcatgccatcaatctcagctaccaatcactgaacaccacaatttttcagatgattcccgcctgtcttggtggcgtgttttatagtgcgatttatttgcgaacgggcactatcatgatggcgatgcttgcgcacggactttgggattttattttaaatctcgtgcgccctagtttgttccatatccccgtggctcttacgggcgcagtcgtgatcgcagacgttttagaaatcttgatcagtattttttatctacgaaaatccaagatacgcaccattcaacttgaaaaactgacatagctttactttttcaccgctttgcaacctccaacaaccgttcccgcagtgccggatcggccgcatataggtacaagccatgctttgcccttttcagcaaaatgttaatggcattcatcataatcgcggctttggcatcctgcgtgtctgccagatccggccgctttttgaaggcttccttgtcttggtactgtgccagattaacggtcaggcgatcgcgttgcttatcgtagccgagacttggtcccaaaatcactccggcataatttaagtcaaatccttgaatcgtataaatcgagccgacctcatggagcgtttccggccgttgcgcccatggtcgatcggtgaagttgattttgtcccatggcaaacgcaaggatcccgcagtgacataccaggttttgttgtccaataccgtaaacggatagtccgcggtcgcaatcatgcgcgataggcccaccgccgcatcgcgttgctgaatcagttgatacattggctggccatcagcaaaaattcgaaagtcaaagtttgtcggttgcggcaggggcatgatccggccacggacaaaatgatcaatccagcgattcaccgccgcatcccctacccgcatctgctcggttagccgataatgcgtcacgggataatcgcgcgtaattcgtttgagcagcgctggggtccaaaagcttttgagttttaccagctgatgaaaatcaaagaccagcaccaccagtctcgccaagtgaaggatatctgccaattgattggcgtcccgaaaattgttatacggatctggcgcggtcaaaagcaagtggccttcgtcaataaataccacatcagcctttttgcctgcttttcgataagcgttgataaagggcgtgggcttcatgaaatcctttttatggaagtaggctttggttccggcaatttctttgtaaatcttcaacatttcattgtgattgaccaacagcttattgtccgttcctgcaagtggcccactatctgcacgcgcggcttgttgcaattgggcaaacgccgcgtccagtaccacacttttaccggatcccgcgtcgcctgaaatgatcagcagatgcgtctgactcgttggataattggtagtgatgaagtcatgaatgtgttgcttcaaggcagcctgtgctgaagtcaaagccgcatcctgtggcaaaataaacgttgactgcgctaagtccggcatatgagcacctccgaaattaatatagcattttcaaattaagttgccacacgtcttcgccagatagctgaatagcatgacttttcaaaaagaacactaaaagaaacctatctgtaaagcaaatcacatactttattcatataaagcggttaaactataagtaatgagtttgaactgtgattcaagaactaggagtacttcatatgccttcaattgctgattacccacaacgcccgagtttggcgtcatttcaacaggctccgctgactgagcttgatgccggtttatttgcgcagcttggttatttgaattttaattacctcattggccagccgtatgcccggtttgccgatttaaatgacagtatgcggctgcataaagcgaccttaacgacatgggccatcccgacacatcaagccatgctgcatgcgatgcatcagagtaagcgatttgcccgagttgcgtggaccaactggcttgagacctgcagtcatcgtaatgaagaagatttcgcggccatcacctttacgctggcaccggatgtgtattgtgttagtttccgcggcacgacgaataaactggtcggctggaaagaagatctcaatatgagcttcatgccgaccattccggcgcagcgacgggcgttgagctatctgactaagcaaatcagccgccaccctggcacctattatctgactgggcactccaagggcggcagcctcgccacttacgcgtttgaccacctgccagaacctcttgccgatcaagttgcacatgtctatagttttgatgggccaagtggtgtcccactcgatcccagccatcgcgaccgggtgaccaagcttgtgccgcaaagttcgctcatcggtgtcagtttggatccggcaaccaactttgaagtcgttaaaagtcgcgtcaaattattcggtcagcatgatgtgctcacctggagcattgcagacgatacctttacgcacttgccgacaacgacatgggtttcgcgctattttcaaaaaacctttgccctgtggttagctggtctcgatgctacggcaactgccatcacggtcgacgctttgtaccgaattcttcgcagcggcaacgccattacacttgatgatctggcgaaaactaaaaaccactggcgccactatttccacgccttccgtagtttggacaaacatcatcgcaaacagctaggccgttcattccgcggtctgcttggtgcaatggcgggatcgttggtacaaacgcattaaaagtagcaaatgggtatgattgtcccacaaaatgtctaagaaaaaacgttccgccagacaagcaaccgtcttgcggaacgtttttgtttgtgttgacatttttgggacatgtgcgactatcgaccgctcataaaaatcacacaaaccgcatcacaccagtactctatgattcttagacccgtgctgagcaaaaaagacttgtgcaaaatcaaaaatgctttgacaatgttctcaagggggtaaaggtatgcagttcagtgacaaactcaaaatggcacgccaacagcagcactacacgcagacacaagtcgccgagcaattacacgtgtcaccaaaaaccatttccagttgggagaacgcgcgcagttttcctgacatcggcacactcgtcaaaatcagcgacttctatgatatctcattggatcgcttactaagggaggatcagactatgatggatcattatgaggctatcgacaaacaagcaatacgcgacaaacggatttttcagttcacttacttcactaaccttatacttcttttgggtatcgtgagtttgaaaatgctcactgttatgctgccttgggtgcgtcaatatgctatcgggttaagcttgatattcattgtgaatctgattgtattagcaacacactatcctgattatcatcagtgggttcgttcacgaccgagactagccttattcctcatacttcttgtgggactcacaacgaccttaatttttattggcttatatgaaccaattacagtccccggtggcgataactcgtatgctcaggaagcttatatagccgggtcaagaatgggcattgtcttacgcggcatagcagtgactttcagtaccatcttcatcgtcttcggttctgaagagatcttggacaaaaattaggcttttattcatagcatacctagcgcacaaaaatcacaattctgtttcttgcttggtcttgaaccaagcttttttagttggttatcaattgagatgctttttgatgggtggctcatattccgcgccacaccaacaactctacgattcttagagtcagtatttcgcaaaaagacttgtacatttttagccacaccttaacaatagcaacaggtggtgaagaatatgcaacttagcgacaagctgaaattggctcggcaacaacagcacttgacccaaacacaagttgccaagcaactacatgtttcagcgaaaacaatttccagctgggagaatgcgcgtagcttccccgacgtcggaacattggtcagcatcagtgacttttataacatttctttggatcgattacttagggaggatcgtacaatgatggatcattacgagacaatcagcaaacaggcgcaacgagacaaccggtactttcaagttacatattatttgaacgtcatacttattttaggaattttggcggttaaaagttttccagctaacacacggcaattatcaggatggcttgccatcgctttaatcattaatctagtaatcttagcgactcactatcctaattatcacgcctgggttgacagcttctctcataagcttctgctgacggtactggggattggcttaggtgttgtcttaatatttattagcgtggaaggcagcatgacacttcacatttataaatcaatttctgacgaggctgcttacttattcggctactattcaggcttgcttatgaagccggtagccgaaacattcagtattatttttgtgatctttggcttcgccgaactcaaagaaaagccttaacctccgcattcacagccatcccaaagccagccaattgcgctggctttttttagctaagatatcttgctttacaaggtatctccccatgattatactatgcttaacaaggtatcaagggaggcgaggccatgcaaccttcatcgcaaatgctgaagggcattctagaaggcgccatcttgaaaattattcagcaaggcgatatttacggctacgctttacacgaaaagttggccgcgcttgggtttggcgacattcctgaaggcaccatctatcctttactgttgaagctgcagagaaataaactcatcatcggtgtccgccgaccaaccggcaatggccctgatcgcaaatactaccatctcaccgacgaagggaaaaagacgctcaccatttttcaacaacaatggcatcaattggttcaagccatggcaaatctcaatcaaggaggcgaatcgtgatgaaaaaactaaaccaactccgagctgccaatgaccaacaactcaaaaagattcacggtacagactatagttacacggaatccgtcatcatctatttacgcagcaagttaagtaaagatccctatgccattgaagaggctattagcgacttactggcgactctcattgacgcccaagagtccggccaccgcgtcgcaagctttttcagcgatgaccctcaaaaggctgcggatcagattctagaggagctaccacctgtgcctgcttggtacctctcaaatcaatattggccagtaatcatgttcttctttaccgttagttcttttatcatgttagctagtcaaaaaactcagctatccttaggcaatattgctgcattgttaacggttgcctttgctttcgtcaatatgccatttgcccgcggcctctcattcaacaaactctcgcgtaaaaccgtttatagtgccatgttaggctttgccatgatgataattgcgttactgatactcagctatttggtagctggacgcacacctttttcagtttccagatcaacgcttatgctcttcagcgttagcttcctcgtactgaatctaatcggtgctttgggctttcgcaaggttgctcacttgtttctcgcatggacctgtgtgtggttgctggcattcattggtatgatgttgcccacttcgccactgactgttggcatcgcgattaccggcgtgctcgttgccacccttttgctgttctatcattccgagccgaaatcacagttacctgtctaactcagccaagtttcaaggaggcgacacctcatgaaaaaattaacccaacttcgcaccgccaatgatcaacaactcaaaaagattcacggtacggactacacctacaccgaaacagtcatccaatatttacgcggtgatctacgcaaagacccttatgccattgaacaggctattagcgacttattggcaacgttgatcgacgcacaacagaatggtcataaagtagcagacttctttagtgacgatcctcaggcggcagccgacaatattctaaaagagttgccacacatctcaatcacttaccttttcacgatgtattggccactgctcatgtttctgctcattcaaaatatattaatcatgttgattagccccagtttgcgttttagcctaagcgatgtgatcggcattaatttctttgccttactcatgattggcgcctcgtttgcccgtggcattttctttaacaaactttcgcgcaagacaatcgctgggttatggatattattagtgcttatgtttgtggtgccttttttgacgggatacctgttccgtggcgtggcaccctttgctatttccagtccgacactcatcagattttctgcgattctttgtgctattaatctagcttgcgcactgtggttacggccgatttttctcatcttcctcggctggaccggcgtgtggctaatcgccgtgctcggccttgctttgccgtcttctgaattaacggtcatcctgggcattgccggaatcgtttgcgcgcttggcttgcttttctaccggcccgatccgctgcattcatcaacaaacggtactagcatccattcttagtcgccttttccatctttatctaaaaaatagactaaaaacactcgcctcaccgttatagcgttcacccatcggtccaattgctataaagagtcgtcccgccgcagccggcatttgcaaatggttcagcaaaacgtaccgcgaaatcgtccgcttcaacttgaccgcaactatctgataagctgtcccgttttgcaattcttgggccgccattaataagtcacgccgaatttgtgggtaggccgtcatttcaggatcgttgtaagctgtgtcgatcgcctgaaataactgggtttcttttttattcattttgggcacctccaggatgaatgcagtttagcgcgttactgtacttgatgcaatgttacatcgctttttgtctagaagaacgtgtcgttttgacaacttgaaaaataacgcaacgtttatttgggaaaacccaacgtttatttaaattttgtcacaacgcggcggttttgtcgcaaactgagggttagtaaaagtattcattgcaaagcaacgggagggcgcatatgaccgattcaacctacaaattcgctgtcgaaccaaccctagggcaaaatttacgaggtgtctgctcatcatgaacgcaaaagaagcgcttatcagtacctgtgttttcacggttttcctttttggcgttgatttatttttaggtggccactttcaggtcttcagaaatctgtttactggagtcgtgttctttttgatcgtctggatctcgggatacctattccataaggaggcgtaaatcttgttcgagcctgagcccattgtggattttattgcgatgggtttttgaatgtccagttctggtgtctgcccgaaactccttaatcctcgtgcagccaatcctatcaaatccatattgcatcgacacaaaattatttgtaaagttgagatggtgttacgtctcgcttcgtgaagttttggggggacgaaccttagtgcaatggatagccaccaagccagcgcgatccacttttaatcagtgtcgcgcctgcttttgcaaaaattggaaatcctattcaggttaagaaaggatctttcaagtgaaatatcgtttattaggcaaaaccggttacaaagtcagtgaagtttccctcggcacttggcaattaggcggcaagtggggtgcgccgtttgatgccaaggttgcgcgcgaaactttggaagaagcttatgctcatggcgtcaacttttttgatactgccgatggttatcaaggcggtgaaagcgaaaaaatggtcggcgcctttgtcaaacagcatcccgacgttcatttcacgacaaaaatcggccgtaaagaagaaccattgaccgccgagcattttgatcctgatcatgtacgccgctatgtcgatgaatcattacaaaatatgggcttggacagcctggatattgtcttgttgcactgcccgccaatgcaggtctactaccaacccgagaccttctttgcactggatgccttgcaaaaagccggcaagatcaagcattacggtgtcagcatcgagcgcgccgaggaaggcattaaagctttggactatgacacggctgtcgttgaagtgattttcaacatgttccgtctgcgccctgccgaaaccttcttcccgctggccaaacaacatgatgttggcattctcgctcgcgtcccattagcaagcggcttactgaccggcaagttcgatgaaaacaccaaatttgccccgaccgatcaacgagccaacaatcgtcacggcgagcacttcagcaaaggtgaaactttctccggcgttgattatctaaccggcgttaaagctgcccgtgaacttaaggaacgcctcggctccgacaatctcgccgcaaccgcattgcgttttatcttaatgtatgatgctgtttcagccgtcatccccggtgccagcaaccctacccaaatcgaacgcaacaccgatgctgcggacgtgccgccactgacgcctgaacaaatggcagtggtcaaagatgtgtatgatcgcatcatcaaaaatccggttggatatgaatggtaacagcttcatcactgttgtcaaaagctgccgctcaccgatttatattgatgtaagggtacatttacacgccacccaagtgtgatcaaggccagctcacatgttagctaggtggcatcaggatttatgcaccactcatcgctgccggcagctttctttggcaacagcgctgttgcgacataacgatttgcttcattgctgacaaatcaaatcattcaagcaatcaacgcaacaaccccactttgccaagcaaagtggggttgtttgtgtgcttcggatgactagaggctcaatcgcttttccgccaccgcgaatccataatcagacgcgcggtaaataagcccagtggcaaaaacatgataatgagtgccgcgcgggtcatccattccgcgccaacgccaatgttgttaagaccgatattatacacagcccgataaatataaaggcccggaaccatgatcacaattgacggcacggtcagcgaaattcgcggatagccgtcaacccggttgatcgccgaggcaatcaaaccggccaccaacgcaccgataaacgctgccgcagctggcggaatcgtatttaaatccaccagttcaagccgcaacgtgttggcgacggccccgatcaaaccagcctgaactgccatgcgccgcgggctgttgaacattacggagaaaccgaaaaccccacaaaagctggcgatgagccggaaaaccagtaaaagtgccggattaaggcctaaatcggcaaaattctccgggcgcaagtgcaccaccatggccactaaccacccaaccaatgaagcgacaatcgtgatcatcaaggcatataacagccgctccatgcctgagcgcatatcctgcttggaaatatccaacatactggtgataaacgggaagcccggaatgacgaataacatagcaccgatatagccagcctcatgccgtgcagcaattcccaagctcatttccaggcctcggaaaacaagaaagtaaaccagacaggcaaccgcaacactgaccccgatgcacgccagcaacgtccaattgcgccgaatcatgatcccgcgcagccagttaccgatacccgcaccgacaaaacaacaaatcatctcaatcggaccgcctccaagcaggaaaacgaaggcacaacaggccaacgccgcagcaagacctgcacgaagcggatcatagttgccggacattttctgaatctgatcaagccggtgatgaatatcccgcaccgtctctttggcatactgcgtatcaaactcgcgcacaaatcgttccagcgcatccaacttgtccgtgttcacaccactttgcggcaacgataacacttcggaataagcgtggttattgctgaagcaggtatacgacaatgaaattaagccaatgtcagccgaacacgacatccgcaaggctcgcgccaccgtgttcatggcttcccgaactcgccacgcccctgtgccacacgccagcagcataatgccaacccggccaacaagcgatgcccgttcttcaagcgttgcatgatccgcctgacgttcttcgctaacgatgacgtcataccaaggaatctgcatatggtgtttttctgaaagcggtggattcccctgcgccgcctgattactttttgacgtcataacttgtgccaatccttcttcttataggaatattcgttttgaaaaatgaaaagaaacattcactattttagcacaactttagctggcttattttaaaaatatcgccgcacttgttactggcgattgaacattttatcaacaaaatactgccaatacgtctttgtaccggtaatcacggttgcttctccagcgatgccatagtagagcgactgttgatgtgttttagacaagtgtaccctagcctgggctttaaagtagttgccggttttgggatttacggtcggtgcaacgtcaactgcataaatcctgcccgttaccgtcataggcgtcggaacgttccgagcgattcgtaagcgaacgttttgaccgcgtttcaggctcatgacctcagtcggcgaaactgctagcttcaaatcagcttctttttgcttagccaaatccggcaagatctgggctaagactgtgccggtgggaatgtacttgttgccacttagagttgcttcaagatgcaaaatcccgtcggctggcgctttgacttgatagttattgcgttgatctttgagtgccgtgagttttgcctcgccttcctgaatggcctgttgcaccttcagttgctctgccgcgatggtttgctgcattttgttttgcaaagaagctaactttgcctcattttgccctgtttgttgcgtagaaagatcggcttgcttttggttggcgcgttgggtttttagtgcagcgagcgcctctttttcacttgtcagcagattttgcagctgtgactggtattgaccttttaagttgccaagattagctgtctccgtatttttggcttcggcttgatattgcgcataaaggtaactataaatatggtcggcttttagcggctgatcggttcggatggcgttttgagcctcgcgaatcgctgctattttatcctcgctggcttgcatactggtccgtaacaattgatcaatttccttgttcttggcattagccacgttttgggttgcattcacggcttccgactctagttcgtaaacccggcgctgattgagataatcgcgcacttgttgctgatagccgaacttgtcagcactggtaaaaagatccttattggcggcaatactccgattgagcgtgtccaaatggcctttttgatcttttagcgtgtccaactgttggttcaacacctttaattgtgcatgattggctacatcgtgatacaccagcagcgtctcgccttttttgacccgcttgccttccttcatatgattcgtcacaatccgattcgctgctgtcccctgaatggttacggcagttttaactggggcaatttccgccgcaattgtcacggtcacctcgcgtttagcaaaaattaaaaagagcaacaggcctataaacagaatcgctgtcggcaagataatcatggtcgaaaaattgcggtaacgatgattataaaactcggtggtctctaatttcttaagatcaatcatcgtcaacctccttattcactcaccaaccgcgcataatatccctgcttcgccagcagttcggcatgattgccctgctcaacaattgccccgtgatccatcaccacgatctgctcggttttagccgcgatggtgagtcggtgcgcaacaaaaataatcgttcgatccttcattgccaacaatcgatccacaatccgccgttctgtaatggtatccagactgctagttgactcatcaaaaatcagcactttggccggcgacaacagtgctcgcgcaatcgccaatcgctgcttctgcccgcctgataaaatgctcccgctttccgtgagcttggtctgccacatttgcggcagattcataatatccgtggcaatctccgcaacagcacatgcgtcttcaagttgcgcctgcgtcaaatcggcacgactgcctaacgttaagttttccatcaccgatccggaaaaaataaatggttcttgcggcacatactcgatatattgccgtagcgtcgtgagcgccacatcatcgatctgcgcgccattaaaagtgattttccccctgcctgtttcgaccgggtaaaaaccgaccaataatttggccaaagttgatttacctgacccactcatgccgacaatcgtgtatttagcgtttgcgggcacttcaagatggacatgcttcaaaatatcctgaccaaatccatacttaaaagaaacgtcattcacaatgatggcgccatcgatcaagctgcgatcggtcagatggcgctgttctttaaactcagattcaaccaaataaacctcattcagccgattattcgccaccttagccatttgcaattttggttgcaagttaatgatgctttctaacggattggtgaagtatgacagcaaggcattgaacgtcagcatctgccccaagctcatcttgttagccatcaccagactcgccccaatccacaacaccaccacattcaagacgagtttcagcaaccccttgatggcttgttgaagttggtcagctttcgcgtaattgaatgacttttttaaatacgtaacgaattcacggtcaacccgttcataactgactttttcgcctgtcagcgacttaatggtctcaataccgttcagatcctcaataatcgatgagctcaaaatggcattgctttccattgtctcttgattcagccgattgaaaggacgttgaaacgcgaaaacaatcaccaagtaacaaggcaccgcaattaaggacaccaggaacaatgtggtattttgaatgcccaaaacaatgcctaaaataagcacgatccaaacgtcaagaaacagggtcataatcgtattcgccaaggcatcgataattttattggcatccgaaaaccgcgacacaatctcccctgtccggcgcgttgcaaaaaaggacatgggtaattcatacagatgccgaacgtaacctaaaataacgtcaatcgacaatcgctggcctaaaaccgccatcaagaaattctggccatacgtcaaaacggattggagaatgtaggcgagaatcagcccactggcgatcatccctaacgtcgtccgcatggcacttggaatgtaggtatcaatgatcgattgcagaaaatacgacccaacaatgctaatcatcgtgatcaacaaagccgccacaataatattggcaatgatcactttttgccgcgcgagcaacggcacgaaggcaaacaaactgcctttgtcctctttgcgcggttgatattgcggttcaggagcaataaagatagccacccccgaccactccttggcaaactcctcttttgaaagccaggtcatcgcgactgaagggtcaggatcaccgattaagatatgatccttcgtcgccttaaacacgacataataatgcgacaactcgccgcgcttcaaaacatgaaccaaaatcggatatggcgcatcatccaaatcaaacaacgtcatatccgccttaactgccttggtttcaaaatgaagttcctgggcagcacgaacaatgcctaacgctgttgttccttcctgatccgtctttgctaattgccgtaaatgtgcgagcgaatagtcggacccatgaaacttcagcaacatattaagcgccgcaacgccgcaatcacgctcatccacctgaggcgtgtaatagcgtttgaagtattttgcttggcctagtttaaatttgtatttgaacatccacggcctccccttattggatttcagattgtaaagactgcaacgtcaacagttcgcagagagatgcgacaagtttgctcggagcttacccttttatcatagttgttaaggttaagcatattaactgccacgaaaacaaatttatggtaatatgaccctgctgagaaccaatagcatcttaaaatagag

SEQ ID NO: 328 - DNA, 167101 bp, Lactobacillus casei
tcatagttgttaaggttacgcatattaactgccacgaaaacaaatttatggtaatatgaccctgttgagaaccaatagcatcttaaaatagagaatttaatattaaataaaaatcacaatttactttttatttaataaaagtggcttatccgctgcttcattcatgcatccttgacgaagatatcaggcccaaaagcagatctttttcctgcaccccttattgttttcctcgaaaaagaccagcaatccaactttttaaatcctcaaacggctgactcgagacacgattggtgcctccgcgcacttgcgaaaggctgtaatcggacatggttgtctccttctgaatactcttttggtcagtcatggtaagtttcctcctagacactttattttgataccatcagcctagcatgaatggcacagctgttgttaaacaaaaaattaacgtcgtattttggccaattaacgtcgttttatgacacgaatgcaaaaaataaattggcctattctcaaggaaacgggtgtttttaatatggtcagtcttcccggtcatatatacttttttataaattggccagtcttcatttttggcattgggtttctttcgtatatcttcttttgccgtatccgtccgcttcacgttgctttatggtcaattactggaacgacgctttcgttgttttttctaacttatggagaaatcagtttttgcttaatttatgcatggtatatatccaaaacgaaccaaagttctgacaaattctgggtctttatctttatggaagttaatctcatcatcatcacgattcaaacctgtgtcataagaactttcgctgcggcaggtataaaacacctaattttaatcagtgtggttaccacactgattctaactgcaatattagcagtgattgtgatatggctcttagtaaagaaacaaacgcaacttgaccagctacgaatgctcatcagggagcaaaaccatctccagaaatcagttattctctatacaggtgccacatgcgtttcgttgtactgctttgaggcgatatctaatttagtcaacatcggcatcatgttggacttgcttattctcggtatctttacgctgtcaattatcatcaacttatattcacttttcttgattttgaagtcgttcagttactatgttgaactcacctggatcaagcgggccgaggcctctcagcgggcgtactacactaccctgagccaacagcaaaaaaacacgaacaagcttctacacgactacaaaaatctgttagcatcgcttcaactgtctctgcagcaatcctcttcaaccatctcgccggatacccaagccatcctttcgcgagcccaggcatcgctaaatcaggcagaactaggcaaaagttcattcacatcaattaaaagtgatcctttaaaaagcttgctttatttaaaatgggctgaatcaatgaaccacaatgtcatcatgaatgtccaaactaaaggaatcattcatcctctagaaagtgcccttggttttgccattatcagagcgcttggcatcttgatcgacaatgctctagaggaaacggtcagaattaaacatcatcgcttcaacgtcacgttaattgccttggagcaaggtctagaagtcagcgtcataaacgatgtcgatcctgattttaatctggcaaatctcgaaaagaaggactttacgactaagggcgacggacatggcaatggcttgtccatcatcaatgagctcatgcaacaaaacaaaaatatccttatcagaaaatcggttattaaccaacagctgaaaatcactttattcataggggattcatgatatgactaccaaccgtacaaccttaaaaatcttcatcttggaagacgatgctaccttcctaaggttcatcgaaaagacactaaacaactacatcatgattgaagaattgcatgccgaaattaaaatcgctacccaatctgctacggatctgttaaacgccattgatctacagcaaattaatgacagcttctttctgctggacattgatattcccggatcctctatcaatggtattgatattgccaacattgtccggaaacattcgctatatgcagacatcatgttcattaccagccacaccgaacaagcacttgccattctatcccagaagattctacctttagacttagtggataaaagcgtgcctgcagaagttgaaacgcgactgcgtaccaatcttgttcaagggataaagcgattacggtcacgtcaactcgaatctccacggctattcagctaccagatcggagccaatctcttttcacttccgctagacgacgtgctgtacattcaaaccgtgctcggtacacctagcacgctcgaattgcacgctaaacatgaaaccacgactttcccagggaacttaaaggaagtttcaactcgatatccaaccttatttcgatgccatcgaagtttcctgcttaacccccttcacgttcacaaattgaacgcctctggtcggtttgtttacatggataatcaggataagcttgacgtcagcattcgtaaagtttcagctttacgtagactcatggcagcggctaatcgttcacatgctgaggctaacaatctggcggatgacgcttaaaaaaacgcccgtcaccctcgcggcaagtgcaaaaaaggcccagaaattcttccgttttcgaaggaatatctgggcctttagaaagcttgtcgattgagctgacttttcgccgattctcgggctattggtcgctgattcaaagaacagctgaaaaagcatattaaggaatacaacagccgctcattcacttgcgatccaatcatagttgcctaattgtttgtactcaaagacagcatcccaaaatgttttttctgactcactgaaagaaatactgtcagacaatttgataactgcggtgttaaagaagtattggagcttgttgtggaatgcaagaccatcgcacgttttcaacacttctaattctcggtcaacaaacagtgctgtttcagagtttttatgacacatactcaacttaatggctagcttctccattgcaacaattatctcatctttagatggcatttttctgctcctacccgcagttgcgtgattcttctgcctttataaacaaacttttaaatatggtcattccttgttgtttcgttgtcgatcatacgctcttgtcattgtgaacagttttctcaaaaaatcgtacgaattggatagaattgcaatgaggataatcgcatacacctgccaactcgcatcatcagacatgatccacagtagtgtgaacaaacaaatctggactatccatatagaaagcggctgtctaagtcgcttatgatcaaatgcagccatttctttcatgtaagtgaattcaccttcgatttcgccgataactgctcgtgcaacagtgcgcacaaacccaaagagaatccgagatatggaccggaaaggaaaccctaacagctcttgcttctgcagtgccagagccacattttcctgaacggttatcatcccgtctctcttaagagcacgccgattataaactcgttacgggcttttttctacgatgtttaaagccgtcaatttcctagtaagtgtaatttgccggaatgcctaaaaatgtgcttaataacgcgcatcaccattgcaaaggttgccaaactaattgcaaaaacacttctcaagcctttgaactctttcgctaattatcgtcagtgctttaagttcatcattgagtcgaaaaaaatggagactttcaagaccagaaagtcaagacaatttacggtcataaagctctaagcataggtaataaaccatattgcatttaaaacgtaagcacgtataaaagatatttcgttatcactatcgaggtacttatcattccaaactcgataatgcccgttttttttgctgagtgtatatacaagaacccctaatagatacaccaatacaaaaataactaaaagtaaagtttttgtcatattcatacgtactttcatctctaaatttagcggtgtccacgaataagttgtccgccgacatcaaatcccgcagacactgcacacccacctatggcgtttcctccgaaagcaacacctagcaaagcgcctttagcgcatgaaccgatcactgttcgacaaagcaacagctctgcagatcaaacaaatttaggccagtactagatccacatgctctcgatatgactttgttatggcctctcccagccttgtttaaacccatcaatcagctggtcagcatgattaaatgcatctgtcgccagaatacctagaatcgttgctaccggaatcgcgaacggtaaaaagccacctgtaatctggcaaagttcggaatcttttaagttggtcatgacgctcatcctttcttttgactcatcctatggcaggttttcttttcgtttaagctcgttgagaacatcgatgctaagactcattgcaggtgccacaaaaccaccttgaacccagcttcgtgcaatcgctccgagtcccatgccaatgtaagtccaaaaattatcagtgccgccaccactgatccgttccaggctgctatcatccaacgtcacgaattgttgcatggcgtttcctccatttcttcgacttattcacagccgatatatttaaactttttagggtgctagcttccctaaacacaatatacgataggtttgagttcatctgattaattaattttaaacgtcggtatttttgaacttttcgtagtgaatttaaccaaagacgacaaaattcaacgaaaaaagccgattttgcgacgtttattttttggctggatcatctttagtcgccgccagagcattaaaagcggtgattaattcgacaagcaggtagcgccttgctggaattaatcgccgctttcaacgaacatgctgttggtataatgcgccgtagcacaacagaaccatcagggattagacactatcgacagccaggtttgccatggcaataacgagtcacttaactttttcaggtaggcaactcctataagtgcctaaaagttaaggaaaaatacgactgtgttgacaaccatgtgggcaacaatcgacgcgctgatatctgtcttaccacgattacagaaactgaaaatcaaagccattaaaaaatacaagatgatgagcggagaaagatagtcatgtagcagggaaaagccaagcgatgacacgaccagtccaagaattgatccgcgaaagatccttttgttcaaaatacctctaaacagaacttcttcccaaagtggcccacaaatacatgcgtacagtgggataaacggtgtcatgttgggatccagttgcgagccttggatattcggaaaaagttcagcaaagatcacctccaggattaagacgagtataccgccaagcaatccgatgaatattttcgaaggtgaaggctttagataagacactgcagcgagatacttatatgaaacgaacatataaaagaaagtgagcacataccaaataaccaaaaaaatcggattattcggacgaacaaaaccaatgccccacagcgctacttgcggcatcactagtccaaaccatattgcaaatcttaaattgcttactccgccatgagaatctatccttggattcaacgacacttccccttccataaaaaagcgttcgcatgtcggcagccggcattgcgaacgcttttgtggctaaatacattcaaattagctcttcatttttcatctttgtattttcctttttctcggctttaaaaataccgtgatataaaaatgaagtccaagtaggatgaatccagcgatcaagccaaaagttcctaggtatttgaaaagataaaacggcacaataaacatcggaaccgctagtattcgcggaattcccacagaaatgaatcttcgcatcgagaacagcgcgaatgcaaaaagcgacagtccgatcaggagcgataacggagcatatagtacaccaatggtattggccactagtgcacagacaaaataaagcaaaaattctgtcacagtgacttgtagaaaggcacgtttgctaatcggtaatcgcaaatttgcaaaagaccacatgccacgccagttttttaaatacccattcaagattcccacaaaaaattccccaatctatcatttcttcagcaaaatattaccgatccgtgattgaacttggcaattcgaccgctaactctcctgcaaaattggacggacaattggcaacccgtatcttttccctggcaaatggactggttctatcaaggtcttattccagagtagatcgtcaaatttcgtgaacgcattgccgcccacgactttctcaagtgtacgtcgtgttaacgcatgaaatggttcaccgttcagtttagtcatttagaatcacctttctcaaaattggagatgttgaagactaaaaggcattttaacgtaatgaccttagttagtgtctcttagccatcccaattgtcactttctatccacttttatcttcagcgttgaatgtcatcgctcgaccatcattcgcatacggctcatctctttaatctattaatcagattcgtcccggctataaggatgaacagaacgagtaaaagccaatagtaacgatcgattaatgaaacccgcggcaatacttttaaatcacttaacattaaccacatagttgcggttaaaaacacggcccaaaccagaacaatgctaactgttcttattttcatagaaattctccgttaattgcgattgacgatactcctacttaaaagccccaaactgtgaagccatgcagtacaacgagatcctctcgaatcaaattagtaggctagcttccctacacacaacatacaacttaatgcatacttttaggttctcaaattttaaacgttgaaatttgccgttttttcgttgccttcttttctaaaggcgtcaaaagacgacgaaaaaagtgcttttcattgcgtttactttgtgagtacgctagtcttctgaaattttcacgccaaatccatcttcactaacatccaatcagccttccccattcaaccggttaccgccataggctctcttcgatccctaatcatattaagattcacctttctttgaaacttcggccttgcactaacttcaagcataggcaagcgttaataaataactacactaatctaatggaggctattttatggttaaaatagttctaaatacatgctcatttttattttgtgtgttattatatttactgggtagaggcaatggcccatcgttaaatgttgtaagcatatttttgatcagtaagtctttgtccccttttaaaaatttatttcaagggtcttaaaacgctaattccgtctttgctatagtattcgaatagctgcgcttaatgaatacggtttttaacaccccagaccaatgcttaattataaagtctcattatgcccaacgaacctccatgttaaccgtagtcgttattaataaatagtttagcagtatgttccataaggttacttccggattaagctaacaaccgttgtgtttgctggaggattgcatatgttgcagagtcaaaacgtacttcatatttacattctcgaagatgatcctgattatcttacatttttgtataagatgttacagcgtcgcatttcatttgaggaatggcccgccaaaattgaacttgccaccacatcaccaaatgaattaatttcaaatattgatcagcggattgcaaacgatagtatattttttctcggctttgggttcacaaattcattgaaggatggtgttgatgttgcacttgccattagaaagaaatcactatatgcagatatcatcttcgttaccggtcacactgagcaagcattgacgattctatcgcataagattgctccattggatctgatcaccaaggacagttcgatccctgtagattcactcgttcaagacaatgttgaatattcccttaaacgccttagagcccgaaagctaatgtccccgaggttatttagttatagcatggattcaagcgtcttctcgtttccattgaatgaaataatttatatacaaacaatcccagaaaaatcaagcatgttagagttccacgtaaaaagtgagtccgtacctttctctggtaaccttaaggatttgactttaaaatatcctacgttgtttcgttgtcacaaaagcattcttctcaatcccttacatgtcatcagtgtaaacacctcagaacgatttgcttacatggacaaccacgacaaagttgaagttagtttcaggaaaatggtcgctcttcgtcagatgttgcgataatccatagtattttcggacacgtcaatcaatattacttcgtcaactccaccgtgttatgtaccaatatccttgatcactcaaacaccgacaccctttaagtcaagactattttaaaacttctattcacttgcatcaaagaacttataaatccacaaaaacagagaagtctcacagtcaattaagcaattatcttgcgactatgaaacttctcttattcatttggcacaatggtgaagcaactttttccaaaaaaatacgtttcagaaaagattagcaaaaagtagcataacccaccattgctccaccccaatatccaactggtccgccagcgcttcctaataaagcgctcccgatcgttcccgcataacatttaacccaattctttccacccataatgttcgccatttcttcggtattcatctctacaaataactcattcatattaatttctcctcttctttagtcgtcgataagtgatgatttctgcataaataaccaaaagcaatccagtaattattagaatgccgtttgctgatagaatttgattagcatagaacaacttgccaagagtgacaaatcctatcaatagaagcaaatttaggggtaaaagttgtctatactctttaggaatcatatcaatttgcatagctcatcgatattctttttaaatattgaagatcagctagagttgttgctgatccgacaaactctttttctgcaaccccatctataagcaattcaaaagttggagtaccgtaaaaatgaatctggttatttaagatgtttaacatcactgcttctttggaaccttcaaaatcatttaaactagtgtccaaatcaatataatagatcggacgatccatttgagggataaagtctttgagaaccttagaaaactcccgacaatatggacattctttgtaacctataaacagatagaagcttgtttttgattttaataattcaatcaacttccaaccgtcgattttgacgacaccctggatatttgacacatattgagtctcagtaacatctgtttcaaactgctttcccaaaacatctgtttgacccacattactagcatcaacaacattaggtttcattattgtcgtcaagagtgtcatggagagaatgaaagccacgaaacctgttatacattttgggcatttcacttcatgagtcatacattcaccacctttctgtgtcttcataataccgtgaaaacagagcgatgaattaaaaagatttaaacgtatgattttaactaattaacgtcaaatcgagaccaaaataagctttgattcttgcaaatctttcctaataagaaacatttcccccgtggatcatctaataaagaccacttgtttcaaatctcaggtaaagctcgaaggaacatgttgtgttgacggctcaaccttatttctgattcaaaaatttataaagatgcgcattcacaactttattccgctgatgcaactgactatgctgcgcccgatgcctgatttcgtgttccgtgtattctctgacccgatcagctacaaggtaccttagtgacttggccgagccaattggcactcggccatcggagccgtcaccaagattgccaaaaagattgagcaccttggctgtttttgggaaaaactggcggttgcggtaaaaatcggcatactgcttcgacatcttttgaagctgccccttcgaatttttggtaactgtcttaccgctattgactcccattcccggaatggcattgaaagggccaccaacggccgcaaattttttcaaacttggcatacccgtcttattcgcttgcgacgcccagtatgtccatcccagcgaaccggcagaatggccaaccgcgttaaaatacctgacaccataacgagtcttcagttgtttgagaattttgccgagtgcagaggcatcttccggattgccgctttcaaaaacgaccgcaattaacggatgcttcacgtttggtcgccatttccccttaaccaccagccggccatctctcttaatcagataataaagcacttcctgatagccggcatactgactaagcccgtcaatcatccctttttccgaggcatagctgccgccaaaaccatggacaaataaagtcggcacttgattggtcttacctgtttgaccttgtgcaactgaagattggcgatttgattgaagtccaaaccaaccagccgtcatcatgaaaaaaatcagtgcgattttagcgaaaaacttcatggtcttactccttgtctacttaggcaatgggattaactacttggactaccattgtatcatgcaacgttttttcttttaattattttgcctcgtccgctgataaggcaccatctttcctgaaacccgacttctaagcggttcatcagattccgtctaaacagtcttcattgaaaatagatttaccatcctcaatttctaaatttgccataagatcgaaaaagccacttcatccaaacccaacatgtacggggggttgaataaagtggctatttgtaacgatttgtttcgactaatcgcggtctgagcccttagccagatcagcgaggctggtattttttaacaccttcagcatcgcttcttcggcttggttcaatacctttgagctagcatcaagccagcgctcaacccttgttccattgacaaaagcacttggatccactgcttcatgaattttaaatagcggtgttctgccttcaatggcgatcaagatatcgtaaatggtaatcgcgtcagcaggtttggccaatcgcagtccaccattgagaccggttttggagctcaagatgccattctttttaagtgttgccgatattttcttaatgctgggcaccgggatattcaacatttcggaaatcttttggatcgataaatattggtcacgctgatcttgtgacttcgcattgacataggcagcaatgtcgagcgcttgcgaaaatgcaacggaaaaggccatcgaatataccctccaattaatcgattaagtatattccattataccaattatctgatcaagcactgcgcttttctgcgggaatgatcaaagtcagcacgaggacaatgccgacaagggtcatcccgacgccgattaacatggcctgaccaaaaacatcggcgatattcgtcagccttccggtcgttgccgcaaaaacagcaagtcccaaagcaccgccgaattgacgcgctgtgttgtagacgcctgacgcggcacctgatatctgcggccgaattctagctaagcctgaggtggctaatgtcgcgaaagccagcgcaaacccaacagcaaatcccagtgttccgagcaacagtaaccaataattggcaaagcgtgagacaactacgagttctgccagagaaagtgaaacaaccacgaatccgaaaagcatgacactcgaattatgccagcgatcgacgaatgttcgggcccggactgccacaataaacagtaaaattgccattggcaccataccaagcgctgtcatgaacggtgtcagtccaagcgctttttgcataaactgcggcgtatagaaccaaaagccgatcgccgcggcactaaataacagtgaactgacataggatgccatccgttccttatccgtaaaaatctccagtggcattgtcggatgggcaacgcgtccttgactgataataaatgcgccccataacaccaatgaaatcaacaatgtcattactggccaaggactgccatcaagaccatatgaaatcgaggtcatcgccaaaactgataaaattgtgccaatccagtcaatcttcccggtttggcgcttagcactaggcaaataccgcgctgcaataatcaccatcagcaacgcaatcggtccgttaatgtaaaaaccgacccgccatgaagcaaaagtggcaaaaaaaccaccgatcaccaaaccgactgctgcgccggcgccaatgacagacgcataatagccaattgcccgctggcgtgcttttccttgaaaggtatcggttaagagcgcgagacaattcggagcaagtactgcggcaccaatcccttgaatcgcgcgaaaaccgatcatgatcggcgcattggttgccgctccgacaacaagactaccaatgccaaaaatgattaagcttgcaataaaaagcggtttacgtccataaatatcgcctaatttcccgcctacaagcatgaaccccgcataagtcaaggcatatgcaacctgcacccatgacaaggcattggcattcaactgtaattgtgccgccatcttaaccgttcctgtataaacaatcgaggtatcaagcaccccaagaaaagcaccgatcagcgccagtcctaaaatgatacgctgtgtgatcgacatgatgttagttttaatcggcttggattcagtcaagtccgtatcttcaagtgattcatcagctaccagcctatctgcagccgcaacctctttgtcttctgttttattcatatgcgattctcccttccttggttcaattagtatattccgtatatactaatattgcaatttttttttgtataaaaatagccgtagactgctccacggccagttgcagcaatgatttatttgggtaaggttgtcattttcaacgattccccagtcagtttaccccggatctcacaccagtattaatgaccaccccaaacaatcggcatggcacctaatcctgctgccagcgcctgttttcgataacgggcggcgtcagcctcgcttatggcgacatctttcttaatgaagttgaaaatgtccaccagctcttttggcatcgtatgatgaatgagataatacattgaaatatcgtgggacaactgggtcaccgcagtcacataagctttgtcatcatcgccttcatcaagtttcttggcattgattttgattagcgcctgtaaatctgcctgtgctttgatcgttggactcgaataagccttgcttaacaagtctaataaggtttcacgtttgtctggcatcttgcacttcctcacgaaaatcggcttgcgtaatttcactcttctgaaatcttgtctactttccaagtacccataggatgctccgggaagttaatgattgaaagtccaacctcagcgctcttaagtaggcacgagatattaactttttttaacgcagtaaaatctccttttttcgtcgtcatttaccattttaaaaacctcagacgacgaaaattgccaaattacctacgttaaaattttttgattcccgaagtcatgctgtcatcgtatactgggtgtaaagaagtctggaggaactttcaaatgatcataaccgcagatatggtactaagagtgattacatggatcagcgccatttccttggtgctgtatatcgttgctgccgcgttcaaatggctgccttcatctgattttgtcgtcccgatgctattgttatcagccctgatttcatattttgtctcatcaatcgatgaagaatgaaaagatcaacgcatagctttttgccgcgtaagaattgatgtacggttgcaaatttccattttgctaagggattccaacgaaccaaaaagtccgacaagattttgacatttagtcaaattttgtcggactttttaacgagccacgtaaaattaaaatacttcagttgcgtgcccttaacacgctagctgatgtttacggcaaatcattgcctgccgcaaagtaaatgttgtaccactcttgccgcgtcagcgtgatgtccgcgccagctgcactttccttaatatgctcaggattcatggagccgaggataacctggacaccaaccggatggcgtaagagccaggcaacggcgatggcatttttattggtgtggtagtggtcggcgactttttgcagttcatcgttcagatccttgaacttcgggctgtcgatgaaggtgccttcaaacattccgtattggaacggtgaccatgcctgtaatgtcatctgtttgcgctggagataaggcaacagactgccatcatggtcgatggaccgatcgtcttccatgttcgtgtgcatgcctgcgttgaccatgccagtatgagcgaccgagaattgcacttggtcgattaacagatgctggtgaatgccactttgtagtaaggcaatttgctcgggattaaagtttgaaacgccgaagtgacgaactttgccgctttgctgcaactcgtcaaatgccgccgccacatcgtccacttccattaatggatccggccggtgcaataacactgaatcgagatagtcgatttgcaggcgctccaagatcttatcaactgcgcccagcaagtgttcctttgaaaagtcatagcgccggccaaaaacaagactgccgtgtgaacgatctgggtcaaccacgataccgatcttcgactgaatatagagttgatcgcggttaacaccggattgcttcaaggcttcaccgaaaacttcttccgacttgccttgaccataaatatccgcggaatcaataaagttaatgccgtcattatacgcactgtctaaaacgatcgcagctttttccggcgaaagtacattcatgcgcatgatgcccagtgccacgcttgaagcctgccagttagaaccgcctaatcgcacttgtttcatgtcttaaaaacccctttcaatgcaaacttaaccatcgtgatatcatctatcacaaccgtaaccgcctctagtttagcccctaaagtccacttgaggtcaagccattattagaatttcaatataacgacttgtcatcatctttttcgcgcggtaatttaaatatatagtcacttattttttatcagcaaaagtcccttattaggaggtcaattttcatgactgttaaagataaagtcgttgttattaccggtgcatccagcggtattggtgccgcgaccacgcaagtattggcgcaagccggtgcgaaattggtgattggtgcacggcgcacggagcggctcgccgaattggctaagccttttggcgatcaagttcgttatcaagcaaccgatgtcaccgatcagcaacaagttaaagccttagttgatttggccatcaacacctttggccacgtcgatgtgctgtataacaatgccggcctcatgccgctgtcggaactttctgagttgaaggtcaatgaatgggagcggatgatcgacgtcaacatcaaaggcgtcctttacgggatcgccgccgtcttgccacatatgatcgctcagcatagcgggcaaattattacgactgattcggttgccggccacatcgttcatcccggaaccgcagtttattccggaaccaagtgggcgattcaggcaattatggatggtctccggcaagagcaggctgccaaccatatcaaaacgacgatgatctccccaggtgctgttaacaccgagctgttcagcaccatcagtgatcctaaacggcgcgaagcagttgagtccgatgaaaagaataacggcctcagtgcaaccgatgtcgccaatgcggttttgtacgccattgatcagccggccaacgttgccgttaacgaggttctgatgcgcccagttacccaacagcgttaacccgtacccttgtcttttgcaaaaggagctttaaatgtcagagtattcttttttgaaaccattcacttttaaacatcaagcaatccagttgaaaaatcggattgtgatcccaccgatgaccacgcgcctttcgtttgaagatggcacggtcaccagtgatgaaattcgctactaccaagaacgcgctggcggtgtggggctttttattaccggaaccgccaacgttaatccgctgggtaaaggctttgaaggcgaattaagtgttgcggacgatcggttcattcccggtctcagtaaactggccgctgccatgaaaaccggtggcaccaaggcggttctgcagattttcagtgccggccgcatgagcagcagcaagattttgcgcggcgagcaaccggtcagcgccagtgccgtcgccgccccacgtcccggttatgaaacgccgcgcgcactcacgactgccgagatcgaagcaacgattcatgattttggtcaggcggtgcggcgcgcgattctcgccggatttgatggcgtggaattgcatggtgccaacacgtatctgattcagcaattcttttccccgcactctaaccggcgaaccgatgaatggggcggcaatcgggacaagcggatgcgcttcccgttggctgttgttcatgaagccgaaaaagtgattgcggcaaccgctgatcggccatttttgctgggctaccggatttcacccgaggaattggaagagccgggcattacgttggatgatacgctcgcccttattgacgccttgaaaaccaccaagattgattatctgcatgtttcacaatccgatgtctggcgaacttcgctgcgtcagccgaataaccccgcaattgtgaacgaagtcattcgggatcacgttgccggtgccttcccgatcatcgtggtcggcgatgtcaaaacgcctgccgatgccgaaaaagctgcgcaggcatttgatcttgtcgctatcggccacgagctgatccgcgagccacattgggttcaaaaagtgttaacccacgacgaaaaggcgatccgttaccagatcgcccctgaagatcttgatgagttagggattgccccgactttccttgacttcatcgaaagtatttccggcggcgccaagggtgttcctttgacgaccgcactagctgacgaccattaagccgttgcaatttaaaatttaagttcatcatgcgagtcgagccgtaatagctcggcttttttcttgttgtattcgtcttgcgtaatcgccccagtgtcgagcagatccttataggctttcagcttggcaatggtcgcctgttcatccgcttgttcctgagccgttttggctgcctgggctgccgcttcctgctgcttgcggtggtagtacaagtaaagcgcgacgcctaaaacaacgatggccaaaacaatgtaccaaaattgaatcagaatggcgatgacgaccagaatggcaaaaaggcctgcgcaacccattttttgatttttcatattgtcctccatatgtgccgctagtaatcgttgcaatcgtcatgatccggatcagataccggtcatttttgcaggatccacccaagcatcgaactgggcgctagtgacataacctgacttaagtgcggcagtttcgagatcggtcccttcgcgttcagctagttgcgcaatttcggcgcttttttcatacccaatgtgtggcgtgagggccgttactgtcatcagcgagtgcgccaccagtgccttcattcgcggttcattcacggttagctgatctaccagcttggtcgtaaaactcgtcacggtttgggtgagcagcgtggttgattcaaggaaggtgctgatgattaccggtttataaacattcagttcgaagttgccttgggaagccgcgacggcaatggtggcgtcgttgcccaacacgcgcacagccgccatggtcaacgcctcggcctgggttggattcaccttgcctggcatgatcgagctgcctggttcattggccggaatggtcagctccccatagcctgcacgcggaccactggccagaaaccgaatgtcgttagcaattttcaacaagtcagcagccaaagttctgatgccgccatgaaccagactgatttcggaatgcgccgccaaagccgcaaatttattggtctgcgccgtcaacggcaacccataaacatcgctcaaccggccagcaacgattcggccaaagttcggcgctgcatttagtcccgttcccaccgccgtgccgccaatggctaaccgaaaaagtgccggctgcagttgcttgattgccgcctgatcgtggtccagcatggccgcccatccgctgacttcctggccaaacgtcattggcgttgcatcttgcaggtgggtgcgaccgattttaaccgttttggcatatgtttcggcctttgtttgtagagctgcgtgtaattcggccactgccttcaacaattcatccacagccaaggctgccgtgatgttcatggccgttggaaaggtatcgttggaactttggctgcggtttacatcgtcgttaggcaaaatcggcaaatcgggattgagctttgctgcctgatgactgacaacctcattcacattcatattcgtctgcgtaccggaaccggtttggtaaacatgcaacggaaagtcctggcgtaactggctatccggcaaggccagcagcgtatccaccgcgcgggtaatgagttgacccttaggcgcaggcaaaacgtcggccgccacattggcgcgcgctgccgcctttttgatctgcagcaacgctttgatcaccgccagcggcatcagcggacccgcttgaaaattgtgccggctacgctcggtttgcggcccccacaaagcagtctccggaatttcaactggtcctagtgtatctgattcggtgcgtgtttttgtcatccttgcctccgtctgcatcgccaccatgcctgtcgcgagattgatagtcctattttacacgatccgccaaccaagcgaaccctaggaagcaaaaaagtgcgccgcagaagctgatttttccagacttcaggcgtacttttctaaataatttcagtgtaatagtgccgcaacgagctgggcggcatcttttttcaattcaacggaagacgaggataaaaccgataagtaatagtgaagcggatcagcttgcggcgttggcattccggcgtgcaaccagcggctgaccagggctgggtcggttgaccaggtttggatgctgactaagcggcgatcaggatgatccggtgtcgaacccgcaattttgagcgctaattcggctttcaacaagcggtcataagctgattgcgaaacggcgtacatgagtggctggtcgctgccaaatgttgcggcttgcagcatgactacaccttctgtatgaagcggaaaattcttgcgatccaccccgctcaacttcaataattcggcaaacgtgccagcatcataggttcggctggcccgcaccggtgacgccatgatgccgttaaattgcttgaaaatctgccaaggcgtttgcgctaagtggtagtgcttgtgagtttgctgttgatccgaaagcaacgccccacaagcctgaagctcccaccgcgctctttttaaggtggtgcgatttttgatccctgtcagtggcgcaaaggtagcaaaaaaatccttgccaccacgaaaaatcgtacgctgttcgtaactactctccacatcgagatgatcagcatacatcaacccaatcagcaaatccgttgcgtgttgcgacaacatagctgtcccttcgtctgtttcaacatcattccctaattctttcgacgattccattccatccccactttcatcctgcatcattcaaaaagccgccctgatcacgttgagctgatcaaggcggctttttgaatatacaacaatgcttaacaactatctcaacgatcttttggcgttaacgtatcaacccacccgattagaatttggagtgtgcggccttgaacgaaatggccgggctttaaccatcacgaccaagtgccatgatcaggtcgattaaacacgttcatgcgcatggacttgggttcgtgtatgttccaatccgagaatggcaaatagccacggatcgtaacctactgactcttcaattccatcgcaactcatcaccaaagatgcaacgagattattgtacgtcatcacttgccttcgcctcttttgcatcggctacagcttccagatgtgcttcataacgcttgttccctttgtaaagatcccagacagtccaagctaacaaagcaagcaccgcaacaatcagagcatacgcgatgtcgttcgcaatggtagtttgcgtagccgttggatggtcaccgaagaatccggcgattgaatctggcaggcctttaaggttcagataggtcaagccgagaacggagatccagccaagcactttgacccagccagtgttcttaaaccgatcacccatttcgactttactattggtaaacattaacagtggcaacattgagaacggtagcgcgaaggccaggaagacctgcgagttattcatcaatgtgttcagcgcctcatgttgctgaatcggtgtttctctggcagtcaacataacgcagacaataactggaatgacggagataatccgggtcaccaggcggcgtgcccacaacggcattttcatgtgaatgaaaccttccatgataacctgccccgttaacgtaccggtaatagttgaattttggcctgatgccaacaacgcaaccgcaaacaggatggacaaaataccggacttggcaacggcaatcagaaccccattgctgagggtcgaggaatctgacaatgcttcaaacaaaccgaagaaggaaggatctttaaccgcaccgctcttgaagaccgcaacccccataaccagcagcaagcagttaacaacgaacgcaaatgataactggatattggaatcccatgcggagaacttaaccgcttgggccacatcatctgggtcgtggtgatcgattttccgtgtctgggaaatcgcgctgtgcagatacaggttatgcggcataaccgtcgcaccaataatgcccaacgccccttgaattgggctcatgccattcactgaaggtgagttggcgaaagtttcgcttgtcggaatgaaaccttttagcagcgcccccatgttcgggtccgataaagccacttgataaatgaacacgaacaggatgacaagaataagtgcaacaacaatggcttcgattttgcggaacccaatcttggtcagtaacagtaataccaagacatcgagcaccgtaatcagcaccgaaatgactagcggaatgtggaacaaaagataaagcgcgatggcggcaccgataacttcagcaatatcagtcgccatgatcgctaactctgtcagaatccataagacaatccctaatgtcttcgaagttcttgcccgaatcgcctgggcaagatccatttgactcacaatgccaagtttagctgccatgtattgcagcaacatcgcaatcaaacttgacattaggataacggaaatcaataggtactgaaagttttgtcccccggtaatggaagtggaccaattacctggatccatgtaaccaacggcaaccagcgcccctggcccggaataagcaaatagcgtgcgccaaaagcctttcccgtgcggtacctcgacagtaccgttaatttcttccaatgatggcccattcgcgtattggatgagcttcatggaatgtttcttcttgtgatcatcactcacaatatgtctccccctcttgaagtcgcttgctggtgcaggagattgcgccggtaagtgctttttgtagacgcgttcaccagcccagaaacctccgtttaaggacctttggcttaaatggccaaagcccagccatttaagccaaaggccacttacactccgggttctaaccgggctggttcacgctctgaaaaaagttaagtccctggggaacaaggccttttaggtctccctaacttaatcctctaatagaatatgccttgaagctgatatcgtcaaccgtttcatgaaaataatttgtattttcagtgaacaaattgtgattagttaatttaataatgctggtgcaagaatgccggcgcatgggcatttcgcagttttcccttgtccagcttgctttcagaaaacttttttcaatttcaccgtgacctttttttaaaacttggaaaatgtgaaaattttcctgcgtattaaatcagttatacaaatttattgcatcaggtttaggcatcccatatgataaggatagtaacagaaaatttatatcacgaaatgaggaattacgtatggaagaagttcctgacgcgcaaccgcccgccacagcacacagtatcaaggatctgcagcaacagttgcaggtcccatcccttgaccacggtctctccaaagctgaggccgctgaacgtttaaaagttaatggtccgaacgccattgaatcgcatccgacacccaaatggctgatttttctgcgacagtttaacaacctgatcatttatattctgatgattgccgcaattttgaccacgattattggtgatgtcaccgatacttcagtcattgttttggtgattatcgtcaacgcgatcatcggctactatcaggaaagcaatgccagcgattcgcttgagaaaatcaaaaaaatgctgacgcctgaagccactgtctatcgggacggtgaacgcctcgacatccccagcgcggatttggtagttggtgatgtcgtgtttctagaagccggcgacaatgtacctgccgacttgcgcctcgttgatatcgataacctcaccattcaagaggctgttttgaccggtgaggctaattctgtcattaagacaaccgccacgctgccggctgatacgccgcttgccgatcaaagcaatatggcttttgcttcgacagccgttgcaggtggtagcggcatcgggatcgtggtcgccactggccacgacacggaattcggtaaaatctcccaagccgtctccgatgttcgcaagggccgctccccgatgatgcgtgaaattgacggcatcgggaaaggcatttcatacgcgattatcgccgcggcagttctgttgttcattttcggcctgatcatcggtaagtacagtctgcctgtgttggcactcgccattgtcacgatggtcgtcggctcgatgccagaaggcttgccggccaccacctccgtcatcttggctatgggcgtttccaacatggccaaaaagcagcacgtcatcgtcaaaaccttaccggctgccgaaactttaggctccgttgatgtcatctgtactgacaagaccggtacgctgaccaaaaacgagatgaccattaccaccgttgtcacgccaaaggctacctatgaggtcagcggttcgggttacacgccgaaaggaacctttacccttgcaggcaaaccgattgagccaaccgcccatccagatttaattgctttgttgacggccggttttgaagcgaacgacaccgagctgcatcaagaagacggccggtatgtgatcaacggcgagcccactgatggcgcttttctcactgcctattacaaagtctttaaaaaggatccggacaacaccgaacgcgatttaatgccgtttgattccaacaatcgctatatggccaagttggcaaagtgtgctgacgggaaaacccgcttattcgttaaaggatccccagacaagctgctgcccttagtggcaattgctcatccggattttgacaccgaccattatttaaagttaaccagtcagttcagtgtccaaggccagcgtgtcattgccgttgccgaaagtgtcgtcgcgcctgacacaaccgaaattacgccagcgctattaaaccaagggctcgattttctggggctcactgcgatcattgatccaccgcgtgaatcggtcatttcggcgattaagcaaatgcggcgtgcgggcgttaaagtcaaaatgatcaccggtgatcacccggaaacggcgctcgcgattgcgcagaaactggacatggccgattccccgaaagccatgactggcgcccagttagccgcactatcagatgatcagcggcaacaggccattttggacaccgatgtttttgcgcgaaccacgccaaaagataaactaacgattgtgaccgccttacaggatgccggcaacgtcaccgccatggttggcgacggcgtcaatgatgcaccggccctcaaaaagtcagatgtcggcgttgctatgggccaatccggaaccgatgtcgccaaagatgcggccgacatggttctgaccgacgatcgctttgcccgcatggaaacggcgatcgcccaaggccgccggatttaccaaaatatcaagaaaagtattttgtttctgctgccgacatcgtttgcagaaggcttggtgatcgtgttcaccattctgacgcaacaagccatgccattgcgtgccagccaactattgtggattaacatggtcagcgcgattaccatccagtttgccttcatcttcgaacccgccgaagccggcacgatggatcgtccgccgcgaaagaagaacgcttcgatgatgcacaagcacgatgttttccagattgcgtatgtcgccatgatgatcgctggtatcgggctgtgggcgtttgattggttgactgccaaccatttgaccgaccgcgtgactgccagcaccatgatggtcaacatgattgtcttaggtaaaatcttctacctcttcaacatccgcacaaacactttggcgctttccaagaacttcttcagtaaccctatggcgtttgtcatcatcgcggtcatgttggctcttcaatgcttcttgacttacgtaccgtttatgcaggatattttccaaaccgcgtctatgtcttggcgggaatggggcttggcagttgcggcgggatccattatcctgatcgtcacggaaatcgacaaaatcattcgcatccgttgggaccggctacatggccacggtgcctttccttctgtttccaaaaccaatgaataatgtttggttgacctaaactttttcttttctttttgcgataacaatggtaataatataagtaaggtttccctaacaaaccttatgcgtattcagaaaacccgccgagttggttaattatcccccgacttgacgggttttttgagtgtttctttcttttcagtgccagtgacgaagttgagtacatccgcatcgtgttgccgaaaaatatttcaggcaatcctaaattcggccttttaaataaaaatacagctggtatactggaagtgaaaagaagaggagctgatcgttttgaaattgtaccaaggtctcacgcaagtccaaattaacgaagaatttgctggtgaagcaagtggctataagattaccacgacccttgataaaccgctgaactacgagccaacgattttgtatcagtatttggataccgttttaaggccaggcagtcggcatgaccaaaataatttgcgttatgtgactgacccggcgttcatcggggaaaatttcgattatcaaagcgttcctttcacctcgcatatgactgatttcgatgaaaaaatggcatttgcacgcaaactggttgccgacctcaaccgtcatttgtcagtcaacattaaaccggccgacgcggaaatcgagttggtttttgttgactgaagcaaccgcgttacctcctttcctagtcgcatcacggcttctctcctgatcactgcggctaagtcattcagtcaagcagcttagttgcaacaaaacgccgcctaactttttcgggttaggcggcgttttgttcatacaagtatgaaaatgtttttaagtctagatcctatattgcgtaaagccggctttcctgcgcagggatgttaccctcgtgacaggaagccgtctttatcgtcttattgcgcttttgcgaccgttttcggcaacgtcaacgccagtaacaagccgatgagtcccacaccggcaaagacagcaaaggtgacaacgaacccgccagcattgctgtgcagcgtcgtttgcatgttagacagcaggaccgttgcaaacatgacgcctgccgaaccgaacagctgccgggcggtcgtggtgacggcggtgccatctgccaccaagtcattcggcaaggcgtttgcaccagcggtcactgatggcatcatcacaaatgcattacccgcttccgtcgccatcgccaacacgatagcgccaattagtggtaggtgatgggcaaaaatagccagcaaaccaaagccgccggtaatcagaaccatcccgatcatcgcaaccaggcgcggcccaaagcgatcaagcaaccgaccgctaaccgggttaagcagactcagcaaaaccgctgccggaaccaaggacagtcccgaaaccagtggcgataagcctaacagcgtctgaaagtaaagcggcattagaattgtcgtgacaattaacccgatataagaaatgccggttaagaacaccgctttggtaaacattccggtcgcaaacacccgcatttgcagcatcggtggctgccggtttaactgtcggaccacgaaaatgcctgccgctaaaacccctagaatcaacagaccaacaaccccggcatgtaagccttgctttgaccaagcgctcaaggcgtacagcaggattggaaaactggcagacaagataaacgaaacccagtccaatcgggtcggcgccatcggcataaccgaagcaatcgtcaccgtcgaaactgccagcaccaacagcgacacgatcaggaagaataaaaacagtgcctgccatggaaaccacgtcaacagtatcccggaaataatcggaccaactgccaacgctgagcccattaccaagccggcggtgcccatcactttgccacgctccgaatgcggcgtaatcgttagcaagacggtctggaaactagggaaaattatcccgacagcaactgcctcaagcaaccgcccgatcatcaaaacggtaaaattcggcgcccagatacatagcccggtcccgatcgcaaaaatcagttcaatcgcctgaaataaccgttgaaacggaacgttatgcaaaagccacggactaaccggaatcattaacgtcatcaccagcataaaaccggttgtcagccacgcgaccgtatccgcgcctaggccaaatgccttcataaacgccggatacgcggtactcaaagaagactgcgaaattgacatcgagaacgttcctgtcagcaaagttgccacaaacgcaccgcgatgtcttatcgttgaaacactcataacatcatcgatttctatttagtatggttggagcctcacattttcatgcccattttttcataggactgcataccgcccatccataattcagatggcttgacgccgcgttcttttgccaacgccttcatcaacgtatccatgtccatcaacttgtattcctgtttcggcttattcggatcaaacgtttcaatttgtgccatcatgccgccatcttcatgctcgaggatgtggcagtgatacatgtaaacgccgggcaaatcaaaccgaaccagtagccgaaccgtttcacctgggttgacgccaatggtatctttgtagccatgctcgttcggataaggcgcatgaccgttacgtgacagaaccaaaaattgtgtgccatgcacatggaacgggtgaaccatgcccggtgcctcattgctgttagtgacatcccaatactgggccttgccaatcggttgagtagcgtcaattcgctgcatttcaaatttcttgccgtcaatggcgacactttcatccatcccctgcatgaccacgtgccgaattggcaaagcaggatccactgccggtgcgttcacggtaaataacttatccggcaactgggtgtgatccggcttaaatgcatgaatccggaactttaagattggcacgtcatccgtgaacagggtcacttcgtcgccttcatgatactgaccaaaatcaacgatgacctcgtcccgctcggcacacgtcatcatcaaatgggtcaatgaaactggctctggcagcaacgagccatccccgccaatctgggtaaatggcagatcatcggaaaaatgcagacgccattcacgacgattggcaccgttcaaaaagcgtaaccgaactttttgcgtcgtgacgtcaaaataaggattaactgtcccgttgatcataacagtcgggccggcaaccccatcaggatcataatcagcgcggtaatcccactgattgttctcatgaaagcgccgatcctgcaaaatgaccggaatgtcatccacgccataattccgtggcagtggcagacgctcctcatggtcatctttgacaatgaccatcgccgctagtccatgccatacctgctccgccgtttccgggcacggatgggcgtgcagccacagcgtcgtagccggttgatccagcgtgaaatcaatttgcttactttcaccaggataaaccggcgcgtgacagccgccgtccacataagggccactcacatcggccccatgccaatgaaacgttgttacttcaggcaacgcatttttcaacgtcacgtgaacgtgctgaccacgacgataaacaatggtctgccccaacaagctggcattgtatccccaagtcttggtcttgggtcccggcagcagttgcgtctcacccgcttctgccgtgactgtgtaataaacatcagttgccgtctctttgtcaggcttcaacaaaggcggtacgttcaagggtttggctggcgcatcgcttacctcaagcggcacatagccgccatcatgcaagtcaaacgccggctcatcaaagaaatagtcggtataggttttcatcatcggtccccccttaatttgaattttagcactttttagggttgccataaatacaatttagaattaatctaaactaggcgcgtatctatcagcgttgtttggggaacttttttgaaaaaggaggaaatgaacatgcaaacaatgtcaaagtcaatgggctggttcatgctggccctcaatgtcgtgttgctggtgctgattgctaccatgcacaacatggctgcgatgtggttaatgggtattatcatgtcgcttgatgccatctcggggttaatctcagcctatcacgctgaccgcgaaacgcatcatcaaggccacgctccgcaacattaatgtgcccaaccagctgtccgatttcggccatcgatgaacccctcgatcagttatatatgttgacacatacatatgttaaatgtatcatgtgttagcaatcaagatgaacaagggggggaacgggcatgcaaccactttccatcactgcaaagcgtgatatgaccgctgccattcgggttgaatacttctcgacggcttggatggcttttgaattcatcatcggtttctggtcaggtcttcaagccggttcgattctattaatcgcatttgggctagatagttttcttgaaatcatttcgggagcaaccttaatctggcgacttaaaaaagaaaacagcggtgcacccgcagccgttgtagccgaggctgaacggcgctcgagtcttgtggtcggcagtgttttgctactgctgagtctttatgtagtcggtgtttccggcttcaaccttgtgacccatgctgccgctgaaagcagctttagcgggattggaattgccattgcctctgtgttgctaatgccgattctgacgttgaaaaaacgccatcttggccaaaagctggcttctgcagcattagtcgaagacggcatgtgcaacatcacctgtgcgtatatggccgctacggttttgcttggcagtttgttaacctggctgcttaattggtggtgggctgattcagtggctgccttgattctggtttactttgttgcgagtgaaggttgggaaagcctacaaacgggattagaccgtgattgaattcatggttcattaccacctcgaatcaaaatgaccttaaagtaacatgccttgaatgttaagacatcttgctttaaggtcgttttatattcaaaaaacaatccgcgaaacccatttcagaaaagagcgatgacatttatgactgccaactcgttaaaattagtcgaatcagctaagcttgtcgaagccgaacgtatttttaagctgctgagcaacccgatccgactacagatgttgaagttactcgaacagcaggaactcaacgtcagcaagctcggcgacttattggggctcgaacaatcggttgtctcccatcagctggcactcctgcgtaagcatcagctggtcagcgccaagcgagtgggcaaggcgaattactaccgcttggacgatcctcacattatcacggtgatcgacgccatgctcgcccacgccgaccacgtcgcccgtggtaaacgacatggtgagtaacaacacgcgtagcaaggcccccttatgccaactaaacagcgccacccgcagattcctttacgaaaatccgcgagcagcgctgtttttgatgtgaatcagaccaattactagccgacttcacacatgagcatgtctctgtactttatcaaaggcttcgagcgctaccccgccaagccatcgtggatcttgtcgagattccacttcatcatcgtataataagtgtcgccttgcttgcctttcgccgcaagggagtcggtgaagatcttggaatagattgaaagtccggtttctttagctactttgttcatcgacttcggtgagaccgatgtttcgacgaataaatgtttaacttctgacgaccggatcttagccaaaaccgtttgcatttgttctggcgtcccttgagcttcggtgttgatttcccagatataggctggagtcacgtgataagccttggagaagtacttaaaagcaccttctgatgttaccaaaacgcgttgcttttctggaatgtccaggaagcgtgattgcgccgttttatgcagcttttgtaacttggcaacatactgatcactgttcttctgataataatcggcattcttggcatctttttccttaagcaccttggtgatggtcttaacgtattgaatcccgttagccaaatccagccacgcatgcggatcttcttccttgacgttggttgtcaaatgttctggtgtgaccccggcacttgcggaaaagacgtccttaccaaaagctttgtgtgatgttttgactagtttcttgaaccagccattgccaccggtttcgagattcaagccattatggaaaacaagattggcttcgctggttgctgcaacgtcggttggtcgcggttcgtattcatggggatccgttccgcgtttcacaatactataaagcttgatccgctcaccaccgacattttgcaccatatcttcgagaatcgagttggttgtcacaacccgtaacttttggccggtgctggcagcgtctttttgcgcattactgcggctattgacgaaccaaaatacgccaccgatcataacaattaacgcgccaactgtgattaaaatctttttcatcgaacaatctcctccgctgtctgagtcgtcgcggcttccttggtccgctgacgcttgctaaaactaaagaatgcttgttttggcgagaaaataaatgagatagcgaataggacggcggctacgagcacgatggccggaccggatgcccagttcaaagtaaagctgaagtacaggcccgtgatggatgagatcacacccacactagctgccatgacaagcatggtttcgaggcggtcggtccacaagaaggccgttgccgccggggtgatcagcatcgcaaccaccagaatgatcccgactgtctgcaaggccgaaactgtcaccaaagtcaaaacgagcatcaaggcatagtgaattgctgtggtgttcaagccatacgtcttggcgaaggtgttatcaaaggacgtgatcaacaattccttataaaacagaaccacaaacaggacgacgatgcctaagacgatcgcggtggtcatgatgtcgctatcgctaaccgccaaaatattaccgaacaaaatgtggtgtaaattcgtggcgctttctgccatcgaaatcaaaatgaatcctaaggcataaaacgcactgaacacgacgccaatcgaggtatcggttttaatcttgctgttagcggctacaaaaccgattaataaggcggcaataattccaaatactgaagcgccgatcatcacgttgacgcccagcatataggcaaccgctacacccggaagcaccgcatgggagatcgcatcgcccatcaacgacatgccgcgcaaaataatgaagctaccgatcaatccggacatgataccaaccataatcgcggtcactaatgcgctttgcagaaagtcatacttgcctaacgcgttaaaaaattcaatcaatgagttcatgcgctcgccccctccttagttgcaaacaatacattggaaaggtccgccgagaatgcccgttcaatattccgagccgtataaacttcttcaaccggtccttcagcaataatgccgtggttcatgacgacaagttcgtcaaaataattcgataccttattcaaatcgtgatgcacgacgattaatgttttaccggcatcccgccactggttcagaatcgtcatgatctcttgctcacttttcatgtcaataccgacaaatggttcgtcgagaatcatgatgtcagcttgctggacgatcgcccgtgcaacaaagacccgctgtagctggccaccggacaactgactgatttgacgtttggtaaattcctccaatcccacttgttcaagcgcatcataggctgcctgacgttcttttttcccgggacttttcaataaacccaagcgcccatacgtcccggtcagcaccagatccagaacattaatcggaaatgtcagatccagatctttacgctgttcaacataagcaatggcttgctggacttctttgagtgttttgccagaaaagtccactgttcctgattggaccttgatcaagcccagtatggctttgatcaaggtcgatttacctgctccgttaggcccaatgatcccggtgatcttgcctgcgttaaaatgaacggcaacatcagcaaacaccggtgtgtcagcgtaggcaacggtcaggttcttgactgttaacataagaacctccaattttagggtgacctaatttgctttcatctttagcttacagaaaaccacgcctactgacaagtgttttttaaggcatacttaaaaaatattggcaactcatttaaagttataactcgttaaccaaatttcttcgtgatgactgctgattaagctaaattaataagcaatgaaatcgaatacataaattcatcgctattagccataaaaaaagccccatgagcaatctcattgattgttcataggactgtgtttatcactatgttattttaagcattttcacggctcaatgtctcgctaaaagcaatgaatcttttcagcggtacgccactactaccaactagctttgcggacacccggaatctgtcctttgtgtgccaactcgcgaaagttgagtcgggaaagaccgaatttacgcatatacgcatgcgggcggccatccaatgcatcacgatggtgtagtcgaaccggactcgaatcacgcggcaatttgctaagtccgatgtaatcaccttttgctttgagttccgcacgcttcgccgcatactgttgaactaatttttcctggcgctcggccttggcgatctttgatttttttgccattcgcttacctctttctgttatgaagtgaccacactgtcattgctggtttcgcaaattgacaggcgtatacttccttttatcgattcttttgttgtttgcgttttgcctcatgtaaaatcttcaaggcgcgcttacgggttttaatgtttgggcttttcatacgccgccgtgcactcgccaaatcggttttttccaaaatttttcagctccttttaatcgtaatcattacgcttaaacgacggatttaaccttatcatgccggcctttttgctgtcaatgaaattttggcagcaattgttttcggattagaatttaaaaattttgcttgtcaatttgcttcgcttgctttatggtttaaagcgtaatgattacgttttggaaggaagcgggtatttatgatgaagcgattacttgcaggtatcagtgtcgtactgctagccattttcggcgtagcgtgcggcaataatggtgccgcaaagcaatccaactctagcaacagcaaaattcaggttgttgccagcgtcgatttttatggtgaggttgccaaagcagttggtggtaacaaggtttcggttcagtcgattatcgacaatccggcggtggatccgcacgattatgaaccaactactaaagtcggcaagtcagttgcacaatccgatttagtggttgccagcggtatcggctatgacggctggatggacaaggttgttaagtccgaaaacaagtcgaaaaattacttaaaagttgctgacgatctgatgggcaaaaaggaaggcgacaacgaacatatctggtatgatccgcgaaccatgccgaagttggctaatgccttagccgacaggttcgccaagaaggacccggctgacaaggctaagttcaaagccaacgcgaagaagtatatcgcctccttggatgatctcaacgctttaatcaacaaactaaaggctaatgcaaatggcaaactcgttgacgtttccgaaccagtcttcggctatgccttggattacatgggttataaagtcaacgatgaacacttctccaagtctactgaagacggtaccgattacagtgccaaggatatccacggtatcgaaaccgacattaaagaaaagaagattgccttcttcgttaataacatccaggcatcttccaagactgtaacacgtttggttaaattagccgaacagaacaatgttccggtcttaaaggttaccgaaacgctgccaaaaggtaaaaactaccgcacttggatgacaagccaatatgagcagcttgaaaaaatccaggatcagtcatcatccagcgccacttcggtaagcaaataacctctttctggccacgagggtttgccacactttttctcctttacttttaatttcggcaagacacatcccctgtcgaattcgtcaatcgcttagctttgattacatgacaaaccatagctccgggtcaaaagcaccggacaaccccggccagaaggaaagcacgcatcgtaaacggtgcgtgctttttttgtgtgagcgtgagtcggcgcgtttaggggtcggagtgtaagcggcctcaggcgcgatgacccgggcttgctcattgcgactgaggtccttacacgcagactcctgcgccagcgaacgcgttatagaagccaacacctcccttccgccgccttccacccaaaatcgacagtgttacaataaaattgacttacgaacaagaaaggaagatgaccatggcaaatgtcatgattctaggcgcccacggacaaattgcaacattggtacgccagcgcctgttgaaagaaactcagcatcatcttaacttgtttctgcgtcacgctgagcggctgcaaaacgttaatgaccagcgggaaaccgttgttgacggagatgtcaccgacactccccttctgacaaaagccatgaacggcagtgatcttgtctatgccaatctaggcaacaaaggcattgaaaaccaagccaagtcagtggtccaagccatggatgccaacaacattaaacggttaatctggatttcaacgctgggcatttatgatgaagttcccggtgcatttggccgctggaatcacaaaatgttagacggtggctatctggaaacttatgcggcggccgctaaagtcattgagacgtctgatttagcttatacgattatccgtccggcatggctgtccaacaaaaatatcgtgagctacgagatcacccaaaaaggtgagccgttcaagggaacagaggtttcacgccgcagcatcgcggatctagtcgtcaatttaatcaacgatcctagccagcacattggtcaatcacttggggttgaccaaccgaatacgcaaggtgacaaaccttccttctattgaaacccgttctttgccaattaaaaaagatttcaccggaagcctgctcagtaggtagcaacttttgaagaagactcggcgaatttttttatattattaattccataaaccgcgatctgatataaataaattggaatctaatttttaagagggaatgtatctatgcaaattcaaaaccgcatccgaaaatatacgtcgagttggttactgttaacgctgctgcttgcaagtctaacgttcttgttcagcccgctaatcagcccgccgaccgtcgttgatgcgggaaagaatgtcccggtttctggtttaaatcgcaatgatgcaacgattaccgacattaatcaaaaagatgtgacccatacagcgcgtctttcacgaggccagctttattacttaacgtaccattggcaaatttccgatggggtcaccgttaatgccggcgacactgccgaattttcactgccatcatcggtgttgccgcaatccgacattagcttcaaaatattaaaccccggcacccaggaaacgattggcaatgtttttgttaaagcaggcagctcccaagggctcatcacctttaccgactttttcagccaaaagacggtcaaacgcgaaggcaccttaaaactccaagtcaatggccgctttaacgatcccgatcaccagcaggttagctggtatatcaataaagccggctgggtggtgacgccgcctaagggtaatcatgcagctgattcgaaccaatatgtcgattcactgggcagaccaaaactctttcaatggcaaatcacgttaaaccctcaaggcaaaactatccacgatgttgtcctgcacgatactttggatgcaggtcagaaatttgatacttcgcatgcattgaccgcagccactggcacgtacagtcagaatgcctttcatcaaaatggtacgattaaagttgctcctcaagtaaacggtcgggaaatgacgatccccttaggtaccattaccacagccgttgaagtcagcttatggaccaatccgctttcaaccagttttggcagttttagcggtgacaagaacacctggaacaatcaggtcacggcaacaggctcgcaagatagcgggctgaatccaactgccaagggtcaaatcacttggaataacactggtgttggtattggctcagtcagtcaggtgaagctaactaaagtaggtgcgacaagaccgcagcaaccattaaaaggagaaacttttgcactttaccgcaatgatggcaaacttgttaaaaacgggctgacgactgacaagaatggcagcttatcaatttctcagttactggctggtcagtatcagtttctcgaaaccaaagcactcgctggctaccgactcaaccgacagccaattaaattcactttgaccaaagatcatccgcgggtggccatcaagtcagctgatatgccgatagcacctgcttcatcatcaaattcatcgagcacttccaattcgtctgcatcatcggcaaagccatcttctaaagtatcgagcagctctaagccatcaaaaccttcgtctgaagcctcaagaagttcaaaaccatcagagccctcgtctaaggcatccagcagttcagaaacttcagaaccttcatctaaagcaccgagcagcagcaccaagccgtctaacctgccgtcaatgccatcaagcacgcagtcatctgcatcttcctcaagccatcaggttgcctcttctaaatcgagttcgtcagttcctgaatcagcttccagtactgggtcaagtgattcatcagcaagtcttaagccatcaatgggcgcttcttcatcagcccctactagagaatccgccagttcgacctctgaaagtcatacgtctcagccagccaaatctgcagtaacttcttcggtagccagttccgatacagctttgccaacggactcagacacgaacacgcaatccgggcaaaacgattcctcaactgaaacaattaatccccacggcaagcacgcctccaagcgatggatgatcctacccaatacaggtgaacgccttgtaagcgccctgtccactgcgatcggcatcgtgttaactgtactcggtagcgttctgttctttaagaatcatcgataaacatcaattcaaacgcttttactgaaaagaataggccaaatcaagggcttattctttttctcgtctttagaacaaaaccgcggtcatctttgattcgattatggatccctcaagactgacagctgatcaaacgaatattttacttgcgtctatagccctcagtacgctacgcttatgctcgtaacgattacggttaaaggggttttacgaatgatgaaacgagtattgacagtcatcagtctactattgttgtcggttgtggcaggcgcttgtggcacaaccgctaagccgtccggtgacaatgataaaattcaagttgtcgcttctgcagatttttacggtgaggtcgccaaagctgtcggcggcaaacaagtgcaagtcacttcgattattgacaacccggcaattgatccccacgattacgaaccgaccacccaagtcggcaagcagatggccactgccgacttagtaattgctaatggcatcggctacgacggctggatgaccaaattgatcaagtccgagaacaagtcgaaacagtctttacaggtcgcggaagatatcatgggtaaacatgaaggcgacaatgagcacatctggtacgatccgcgaaccatgccgaaacttgcaaacgcgctagctgccagatttgcaaaacagaatccagacaaaaaggcgacgtttaaagctaacgccaagcactatattgcttcacttggtaaactcaatgacctgatcggaaaacttaggcaaaatgccaaaggcaagaaagtagatgtttccgaaccggtcttcggttatgcgctcgattacctcggctatcagatcaacaaccgccattttgcccaggcgactgaagaaggtaccgattatagcgctaaagatattcatagcgtcgaagaagacattaaaacaaagaaaattgcctttttcgttaacaatagtcaagccagttctaaagttgtcgatagtttcattaaactcgcaaaagaaaataaggttccggttctgaatgtcaccgaaactcttcctaaaggcaaaaactatcgcagctggatgctcggtcagtatcagcagttagaaaagattcaaacccaaacaggtgctaagtaattttgaccgccaatcgctccgatttcgctgtttattttaggaacttttcttggtcgcttgtgaaacattgtaacatctgcaatcttttcgtaaactttttgcaatgaatgcgttttcatttgccccagaccgattgaatttccttgacatagctcctacaatgtaattgtaaacaggagcaaccaaaggggagatgtttctaatgtcactgatcaagcatacttttaaacgcgttgagcatctgatcgccacaccacgcgatccccacgaagaagaacaagcccgtttgcaggctgacttgttctacacaaatctcagtagcctacaaccaaaaacaaatgcaagattttgattgatggttaccacagttgtggctgtctcgacgttggttgaggcggcttttttcttttactaacaattcggtgcagcaaaaacggcacgaaaaaacccgcattcacctgaacacgggtttttcattttgccatgtacatcggatttatgtttccggtggccatggtttacgttgtgcgttgttccgctcgttgcggcagaattgattgaattgggagtgaatcaaatgacaacgctctctaaagccttttttgagtagctgcgtgaacacctcagacgatgttgttgtggccccaaagatggtcatacttaaatccggttaggttttcaacttgcgctttaaccttcggatcaacatcggacatcttaccaccggccttcagacgatcgatttcgtcacgcagaaccttgtgactttcacgatccaatttgaagaagtaagaagtgacaaatgccaagagcagcatgagagcggtaccaagcagcatccataagatcaaaccgtttaacgcgcctgcactttggcttttggctgattcattgaagccaaatgctgatagcacaatcccggttaagaacggtgccagtgcagaagtggtcttgcgagcaaacgtcatgatgccggcaaaaataccttcgcgccgttgtttggtgaccatttcatccacatcaggaatgaaggtgtaaaccgtccacggaacataaccggtaccagagtttgaaatgccccacgtaacctgaagtgcgtacaaggtcatgatgccccagctggtacctgcagccgaaccataataaagaccggcatagcaagcaaccgtaaagaacatcattaagtacataatccgcaataacttagacgggccaagtttgctcatgatcttcggccagaacaggttacatggaataccaatgattgaaccaactgtcaggatgttcgaagcttcggttgggttactctgcatcgcataaacaatgtagaagacatacgtcgcacccacaatatcgcgggcggtaaatgaactaagataaataactaagtgaagtgcaaaggacttgattcggaaaaccgaacccatatccttaatcatgttccaaagcgttaccaaaggattttcgcctttgttgcggctttcttcgatgatcgctttacgttcttcaggcgtaccgtcagtttcccgctcgaaagtggagaagtaggttaagccgatcgcaagaataaagatgatggctaggacaataccaagcgttaagaacgcgttgggattgtttttacccataatagcaaagatccgacctggcaaccatgatgcaaggaacgttgcaagcgctgaccaaagcatccgggaactggacaaacgagctttcatatcgtaatcatctgtcatttcagcagctaaggtctcataaggaatcatgaccagcgccgtgaatgcttccatgagcagataggtaaacagataataccagaagcccatatgtgaaacccagatgacaacgtagataaacattaacggaatggagatcagcaggaagaatcgtctgcgtccaaatctccgtcccattttagttgcgccaaaatgatcggttaaataccccatcaatggactaattaatgagtcagctacacgagcaatggcaagaatcgtaccaccaaggactggtgacaagccaccaaaggatgtgtagaagaaaagcatccacgttgaggcaaccgttagcgccccattaccaaataaatctgcggcgccgtaaccaataacattacgccaccggactttcctcttcacgatgaaagacctccctgtttgattaacaacaaatatgaatccgaatccgcttttcgtaaacgtttacaaaaatgagattaacatcgttttcgtaaaaccgctaccaaaattaggagattttagtaaaagagacgcgattgctattgatatgtcccaaaaccggaacaaatctacagggtccgttcattttgagccatctgtcttcatatttgtttaacaatgacgactagccaaaaatcgataccacttactcactaatagccatctgtccaatcggcagggtttataatccctgtcgcgaaaacttgtgaaacatgcggcaagtgcttcttaaaacatagacctttttactagaatgacccggaatttaccggtatcgaccattgtttcgaagtttctcttcacgctgttcgtcaaaaaaagcgcctgttttggtcgcgtattttcactttgggacaatgaaatactaagtttggaacaaatacacatttcgccaatcctactattctcgagaataggtgatattacgcaatttatgctcgcctagtcgctttgatttttagtaaacgcttaaacgccatattgatttttcaatatttacaacgtacgctaagaaaaagcgttctttacttataaaggagtaagttaaatcatgtcaaacataacagcagcattgtacgcgccagatcatttaagcgttaacttgcagcactttgcctataacgttcagcaacatccccgcttcagttggtggaatcatagtagtttctctgatgcctcccaagcggcgtatcagctagttgtcttcaagcggcttcaggatcgcgatcaccaaacctacctatacgacagcggctgggtccattcagcacaaaactcagccgtcactgctgcagacttagcagacagcttgcatcctggcgatctctattactggcaggtccggattaaagacaatcttggccataccagtgatttctcacagccagcgaaattcatttgtgctgaccccgcactgcccgttcagcaaggcatctggcggcaatcgcaaccaaaatctggtgaagaactagcccatatcggtaacgtcgtctttcttcacagtccgcagttgaccattgacacgaacgatgtcgacacggcagttgtggttgccttcgcgcgcggcaatgaaccgatttttgcccaaagctttgacctatacgttaatggccactgcctcggggtcggttccgcgcgtcagcaagaacacgatcacggcacggaccgcacggcagtttactataatgtctacgacgccactgattacctggaaagtggtaccaatacggtagcagcgctggcaaccggcagttcagaccgacgcgctttttggtgccagttgattgtgtacaaacatgacggtaccaaagaagtcgtcaccacagctgatcctagctggcgggcgctggacggcagcagtgcttttggcgacttcggggtcaaaatccgctcccaatattttggcatggtcagtgaaaatatcgatatgcgctactacccacaaaactgggcaagcaagaccttcgatgaccatgattggccagctgcttggcgcaacccgcaaccgatgatcactgatgacgaagtgctggttccctatcgcagtgaaaataccgagcgcattgaggtccatgacgccaataaacgtatcgtcactttttcaccgcaaaatcggttaatcgatctaggtaaagaaattatcggcggcttgaccgttgatcttgccagtgacacggatcaacgcgtgactgtactgatgggtgaacaactcgaagacaacggccacgttcgccacgatatggcttgcggccctgactatgttgaaaattggacgctggtcaagggtgaaaatcatttcaccactttgcaaatgaaaaatttccgctatgttgaactgcttggtttcgaaggtgacctacacctcgatgccattaatggctgggccatgcagcaacattttccggatgacgaaagcagttttcaaagcgatagcgacctgctaaaccgtgaatacgagctatctaagtacacgattaaggccactaatcaggatgtttttgttgactcgcaggctcgtgaacggcggccgtatgaaggcgacttgttggttaacgcgaatacaagctacacagtatccgcgaattattcactggcccgccactccttggattatttaatcgacaacccgacctggccggaagattacaagctgttcgcaattgaaatggcttggcttgattttctttacaccggcgacgatacgctactcaagacccgttacacggccttgcaatacaagctcaaccgcggcaagtctgccgaaagttttgacggcgcatcgcagagtttcaaaggctcactgaaaaatagcaaaggtgtcgacaacttcgatgaaaaagtcggattagtcactaacgacggtctggttgactggccaatttcggaacgcgatggctttgtggaaggcacctataataccccgttcaacgccattttctacggtgcttactcgaccatgggcaaaatcgccaaggttctgcatcatgacgacgacgcagcgcactatcaagatcgggcagcgacgattaaaaagaatctgatcgataagttgtacgatgaccagacaggccgattctttgattccctgaatgctgaccaaaccatcaaccgccatacttcgcaccatgcttcagcctatgcgctttgctatggcgtgtatactaaccaggcaatggctgatcgtttgagccagtttgtcgctaacgacggccaattcgtcggtagcatttactttatctacttcatgctcaaaggcctgttcgaatccggtcacgcggcagacgcgattacgttgctgacagacccgaacgatcaaaaggatcacaaatcattcgccgcgattctcgacagtctgaaagccaccatcgccccggaagcttggagcaatcactacaagccgaacctaacattgtcccatccgtggggtgccaccccgggattgaccattgttcagggcattgcgggcatcatgccaatcgaacccggattttctacattcagaatcaaagttcgtgcgggcaacctgacccacctgaacctcaccaccccgtccgtgaagggcctcatcaccgttcattatcagcaagacgcaggcaaccaaactctagaagttgccgtaccgatgaatgcaaaagcacaagtcgaactccccgcccaagcccaacaagtagccgtgcaggatcaattcggcaaggattggacaatcgctgtccagcgcgatgatcagaccttgaccattccggccggcagctaccggattacttatcaacaaggtactgtgcgtaagtgatgcgcatgtgtttaaaaaggcacttgatcaaaaagaagacaccgtagtctctgtgtctacatgaaaatgccctgaaattccattttatttggaattccagggcattttagtttgaagttgatattacgagagtggatcatagttctgctgacttggttttaatttattttcggatatttcgatttcctcggctgaataactgggtggtgttgggattttccgggtgtggtatacaaaaccggggtcatttccagctagtagtgcttcaagctcgttaatccctcgccgcaccttgctggttgattttacattattattcattctaaatactcctcagctttttgctttccgatgcttagacaaaccgagtgcaccgaagaaactcgaaacgaccaacaagtgacgcctactgtgcttatctcgttgagctaagaccgattaacgattggaccgcttcttttgagcctctttgaagcgcgtattgaaacgatctaggtcgatttgatcacgtggggtcaaatgtccgatttctttaaaatgcaagccatgcttaggaaaactataaagacgaccaatatcaatccacgagggttgtctaagaccgacgacctgccagtcttgaatctgataatactgtcgtcgaataaaaactgacttatttgcatacttagtcgtgatcttgaaacccgtgacgcgcgtttctgtcacacttcgaactaacaccggccgctttttacctccgctaccttcgacaaaagcaacataaagactcacgagatcattcgtcttcattgagccactcatcgacttctttcgcgtccttgaaaactgttactggtgtatcttcagtgcttttaaggaaatgtaaagtcgctttctcattctcggttaaagccggcttaaacggtagcgcaccagtagcaacaattcgcttatacaacatcgtgattgctgtcgtttgcgtcaatccgagccgctccaagacctgctcagtatcgtcggctagttccttatcaacttgaacctgtatccgcttcttctcttgaaccgccatggtaaacatcaccttcttgtagtttgtactcattatatactactttttcagtataaaacagtatcaactctgcgtctgcataaaaaagtgccttgaaattccagattgttaggagtttcagggcattttagtttgaagctggtattatgtacccagcctctttccgtagttcgtagaaaatcatatttcgccacattccaagaaagtcagataaacttgcttgcttctttggaaatctgtgcaattacctgaataagtctacgtgtgggaccctttagacgatgcttaccagattcccatgcgtcagcagtttttggtgaaactgcaataatttgtgcaaaaaccgttgcgtggctgggatttgtttccagatttttttgattttatcagccgagcaattgagtggtgttgggatttttcgaatgcgaaatacaaagcctaactcttttccatttcagtagtacatcaagctcgttcatttctcgctgaaccttaatggctgatttgacattgttgttcaccttaacgctcagctttttgattaccgtttccaagtttgttttctttcgcgcagtatatttaccttgtcgcccttagtaaggctgacaaaaacttgcttggcctcgtaaaaattatgatatctttttgtgtccggacgaagatgaatgaaatatagctcaagggggtgactgctggaagtacctgttgcttttgcacaaactcgttagaaatttcgtgcaaaataccaaagtatgacaagttgaataaaggtgaaagaaagatcataggccaatgcccattgattgttctccgctgtcaggaaatacgcaccaaagttggcagtaatcaacaggacattgataatccagattaacccctttgtccttttatcaagtttgcctttggatgttttaagaatccaaatgatgacgatcgtggtaaaaacaatttgagttgcatcatcaatgttcattcgcccacccctagacatctaagtgacgttgttcaccacgcgtcttccgaaagtgacttcagacttttaaaatgaatctttagaaattccttgcaaaagaccacatgatgactaactggataaaggcaaatgtgtaattataggcgatcgcccactggcttcgctcagtcacaatgatatagcctgcaacatttccaacaatcactaagatgacaacaatccaaatgagttccttcgttctgcgatcaatcttgcccttcgatgtcgcaataatccagataatcacgactggggcgaacataatttgaacgatatcccagaaagtcatttcaagtcagctccctgtatcctaatcgtgccagacatagattcttcccagtacaaagctcttgcacaaatgtaatctatacccatccattcatatcggtcaacaaattatacccgttcttccattattgatttatcaacatttaagcatcttatatttaaaagagaatctataagttttttattatttatacatcaagattctcactatgttgatgctctagctttaaacttctccaattctaaactacccgaggcaaataactttcaatttcacctagaaatcgctatcataaagtcaccggagcacagactccgtataaatttattggacttcgagtccgtagtatcggcaacgatacttgatgcctgccataatgatggcgaaaggcatttctgtggcttgataaacaaaccacagtggcaaccttatccttttggatggggttgcttttttggtgagcgcgaacagaagcgtttagaaatcggagcataagtggccccaagcataaatggctgggctttggccatttatgcttggggtccttatgtggagatttctgcgactgtgagcgcgttatagaaagcggaagtctggtctcacatttgcctaaaatagaatcatcttccactgaaactatttggcgattgcgaccaaggtccttacacgcaggcttctgcgccggggagcgcgttatggtgagcgtgaaccgacgcaattagaagtcggcgtgaagatagctttggacgagatgacttccaccctggcaagcacatcatattaagcattcaccccttcccaatattcacaccatcaagccaaacttcgccggcggttcgcaagctccgtcaacgccaagccgacgatgaacagccccgcaaagacaacacaaacgatcaaggaaaaatgcgttgggctgatcattccggtaagaccattcatgtagaaaaaccagaatagcgccatcagcaacgctagcaaatgccctgagtttagcaagcttcccatcccttgcgccaatgcaactgtcgctacggctacgagtatcagctgaagcgcgacactaggcttccggacgatgaaaggtaccatgatgaccagtgccaatccgccgctgaccaacaattcggcccatttttggtgttgaatcgctgccggcaccgtatgcagccatgactgccagccgcgtggtgatgagcctaatgcactcagccatggcaaggccaaaagccatacgatcggcaagcccgcttcttgttgtgctgcggtgggaacaaaccagacaagcaaccaactgcctagcaaaagcgcgcgataacgccacgaaccgatgtgccactgacgttttgcttccacctgcaggagttgcagccactgaaaatgtccagcctgaatgggaacatagtctgctggtactgaagcgctagatgctggcgcttggacttgatgtcttacttttagtccgccggtttgccgcgccttgtgcatcagcaatgccgccaccaacgcaatgcctaccgcaatcaatacctcaccgagcataaaggccaatgttgtccggtcaaatgccacggggccaaaatgtagcgacagcttgccttgctgtcctgcataactgctgaacatttgaatcccatcgatcgggcgaccgatgacatgttcactagcgcgactgaccgtatcttgcagtgacgtcaagccgctgagactcaacaagcgatgccaaaatgcatgcggctctgatagctgcgtggcatacacatacaagaggccgaacataaagactgtgaccaacccactgctgcgtttagccgtgacgctttcgaccagcaatgccagcgccgcaatcaacgccatacttggcaacaaggccagaaacggcgaaaggaaggtagcaaaactgataccttgtccgggaaaccggatcaccaccatcaaacctgtagccagcagtgttacgaaccacattgacagcaacaccaaaaagttgccaacaaataaagccagtccatacgatatccgcgcaaaccgcgttgtcgcaatccatggccatacgccactggtacgatcggtttgcagcgcattttcaaccgcgccgacgccaaagaatggcaacgtgaatccgaaaatcagggcagcacagattggcaaccaagtcggattatccgcctgccgaaaaatcttaggatctaacgataggattttaataccggtgttaaaccgcggggtacacagaatcgctaacacgaccactgtcccgatcatcagccagaatgagtgctggcgggctctttctttgaacgatgttttgatcatggttaacatgctgatcaccggctttccaaagcacttaacgttgcatcttccaacgtgggcgtcaccgctactgcctgaggtgttggtgattgcttggcaacggttcgaatatgaatgccatcagtggcttgccgcatttcgctcatcgcctgatcggtctgcggttccgttccttgtggcagcacatactcccacacgtgacccgttgcggcttgaatcagtgccggtgcggtgccctggaagaccaactgcccgtcttttagcaacaacaattgactggcaacggcttcgacatctgaaacaatgtgcgtcgacaacaagacaattcgcgtttgggccagttcacttaataagttgcgcatcataatccgctcaatcggatcaagtccggcagatggttcgtcgacaataatgatttggggattgcctaacaatgcggccgccaaacccacacgttgccgcataccaccggaaaaaccgcctaaacgtgcatgggcgacaccttgcaaatgcatttgctgcaacaacgccttgatttggcgattagccttggtcgttggcaaccctttgagtgcggacaaatattgcaaatactccgtcgcgttcaactgcggaataatcggtacagtctgtggcatataacccaatacccgccgcattttgccaggatgccgtaaaatgctttgaccattcagcaaaacatccccagccgtggggcgcattaacgtcgccaaaattttcataaacgtcgacttgcctgcgccatttggcccaatcaagccaaccaaaccgccgctttcaatcgtcaccgaaacatgattcaatgccattttattgtgaaattgcatggtcaaattttttgttgtaagtttcataaaaatcaacctccgaacgcgttatttcacctgattgtcgccattgtgcgtgactaagcggagctgcgtatctgctcgtcggttataagtgacgttgttttcagttgtggcgcgtgtaaataccttgttatcaccggaaccggtctgtaatgcgtagccactctgcttatctgcgccagtgacgacattatcgccataggtattgttaacctgatttttccctttcagctcagtgtgcgtcatgtgaaaatcgccactgctcaaagtaaattgcccctgattgatcgtgctgtcggtgacaaacagatcgccgtatttcgtcgtgacttttggttcatgcaatgttgcgttcgtcacgcggacattgccggagtctgactgcaattgcaactgcgcctgctgaacatggctgaccgtcatatccccgctggttgcactgagcttaagtcgagtggttttggcaacggcatacgtcaagttaccggagctagtgtggaccgttgccgctgtgatggcttgatcgcgcggaactgtaatcgtaatttgcggtgcgcgtgtctggccgagcatcatgccaaaaatcggctttcctttttgcgttaacttgagctgaccggaacgaaccgtctgcataacgtgtcctgatccaactgaggtgacttcaacgcgatactgcgcgccggttttcacgaccacgtccatatcattagcagtcaccgagagtcgtgagaacggtttgacctgttgcgttttggtcgtcgggttggcaataatgggttgcccgtgtaccaccgcaattggctgcaacccatcgtgagcggcaccgatgccaagcatggccaagccaagtacaattagtagcgccccaattgcgagtaatcttttcatcataattgggtcacctccaaatgttgcttgcggatgcgtcgatagatccaccggaagaagcgggccaccacgttaaacatgccttgcgtcgtccatttcaataacggtatcaggaatagtcccacgccaatcgctgctatccctaagcccatgtagctcaacgccaccatgggatgagccagcaggaacagcccggcgaagatcgagaaggcgccgacgcccaagcccagaccagtggcaccggcaagcaccagcagaatcgccaaactgactgcggcaatcacaatcaacagtgccaaaacgataacaaacaacgcaatagcaaccggaaccgtcatcggtgctgacaaaatcgccaatacaatggtcttgatttgccgagcatttgctttaggcgacgccgcggagccagaagccgtgctgcttttaatcgcataatctgccaaaatctgacgaccaagctgctgcggtgtgccgagcgccttggtaattgcatcgccgtccgtcaagccgccatcttcggcataatcctgaaaaaaggcaacggcttctgtccgttcatcgccggttagcggtgacagtatttgcattaatgcctgaaaataagcttcactactcatgaccgtttctcctccttcgcttggttacctgcgtcgggcagaaaatgctcaatctgctgcttaaaagtctgccaattggtttcggtttcctgtaacaacttggatccgacaggcgtaatccgataataacggcgattgcgcccttcgtatggctgatcgtaagtcgttaacgcaccttgagcttttaggcggcgcaacaccggatacaacgtggaaggggaaatgctgatcaccgcttgtatttgttgggtcagtgcgtatccgtatgcatcggattgttgcaacacggcgagcacaatgccatctaatagttccgcactgagcggcatacccatgaacccaacctccttccttattacatcatcgcctatattatacgtcatataatatcatatgcaagaaagctaagcgaaaaagtcccaaactctttgacagttataagcacgaaaaaacggccaactccttcataccaaaggggttgaccgcttagtgatacttagcgatttatcgtaaactttcatttattaggtctattcgtcgactaacgttgttttcatatccacttccttagtgacaacgccagcttgatacagcgtcttggcaatggcgttttcttcagccacaatcgtgctgttgccgttaatcagggtcatggaataggttcgtcgttcgaccatcttttggatcacctcatccgaaagcttgagggtcttgcttagcatggcaatcagttgggtatggtgcgcattcgcccacgtcatgtcgtcattcaacgctgtggtcagtaacttgcttaatgacgtgtgattcttggcatagctttgcgtcgaaatcaggaagtcccggtttttggacaggccggtgccgtttgtcagcaacttggcattgttgttcacttgcgcggttgccgtgtacggatcccaggtgacccaggcatccacaccacctttagcaaaagcaaccgacgccgaactctgatccatattcaccaacttgacatcattggttgataagccggctttcttgagcgcctgaatgatcagatactgagcagcagtacctttttgataagcaatcgtcttgcctttgagttgcttgaggctggtgatgccgctatttttgccaaccagaatgccgctgccgtattctttcgtggcccctgctgcaatcaaagcgatgtctgtgccggacgccttagccgttactggcggcgtatcaccaactcgcgcatagtcaatggcgccgcttttaagagcggtcatcaatgcagcgccatccgagaattccttgaagacgacttgatagccttttgccttcaatttcttggctagttcgccgcgttggcgggagatgtccaccgggtcggctttttggtagccaatcgtgacggtttcctgattggtcgaagccgtggtggtttgggtatagccatacacggcaacgctaaaccacgcaatgagcccgactaacagtaaaatgaatcgaaatttacgcttcataaagtttcccgcctcgcatgagttggtcgcgtagtttcggtcgcaaaaccttgccagtggtattcactggaaaagctttgacaaacacgacttcggtcggacattcgtaagcagcaaggtgctggcgggcaaaatcgagtaagtcagccttggcttgttgcggatcagcagttggatcctgccgaatgaccacagccgtgacggcctccccgtacagattgtccggtaatccaatgaccgccacttgtgcgatccaatccaattcattaagcacattctcgactttggctggtgccaccttttcaccgccacgattgatcatctctttgcggcggcctttgacaaacaggtagccgtcttgatccagatagccgatatcgccggtcaagaaccagccatcggcaaatgaatcaggatgcggctcgagataatcatgaatcacgtggtcgccgcgaaggacaatctcgccttcgacaaatggttttttggtcaacgtgccatctgccaatctaatacggaggtccgtgccaactggtttgcctgctgacccgattttgggtgcctgaatcggattcaaggtgctttggctggccgtttccgtcatgccgtagccttccaaaacctgcgtgtgaaaccgcgattgaaacgccacaagtttgtcttctggcaaggcgaaagaagaactgcggacaaaccgcaaatggatattgtcgtgatacgcttttaaggcattttggttcatcagcagaatcgaaatgatcgtcggaaccaccgacacccaggtcacgtgattgtcttcaatggttggccaaaaggcacttgccgaaaacttaggcgcaatgaccaacttaccaccggatagtcgggtggccaaaaccgaaatcacctgcgcattgatatgaaacatcggcatcacgaccattgccgtgtcatccggcgttagtgcgtggctcataatgtcatagtgggcggcgttaaccagcattcggtgcgtcaggccgacacgtttcggtttaccggtggtgcctgaggtgttcaaaattaaggccagatcatcttcgcggggcgccatttgtggggcgttgatgcgataagccagctgacctgcatcggttagaatcgccaattccggcatggtatgcaagcgaacccgcgcccatgggatcaagggtgcttccatggcttctcccagggctggcagggtgataaccgcttgatagtgataagtggtccactcgtcaagcaattccggtaacggcgttttagccgcgatcggatgggcgaccgcaccaatttcccaaagcgcctgattaagcggcaggaagaccggtgaattcggcaagacgatcaaaacctggtccccagcgccgattttctgttcggcaaattgctcgcgtaaggcggcaacatcttcttctaagtcgcgccccgtgtaccacgtattggaagcaacggacttaactaagggataatcacgatgattgatgagattctgagataactgatcggtgagcttgctcatgattcaagactcctttcgcagataacgacaacgattgcggacggcctattaaccatccaaacggtgaaactttgtaacagaaccaggcgatcccaaaagagacgccgagaataccgagataaccaagcggcaacagtaacatcagggtcagattgctaagatgcatcaatcccagcaccccgcttaataacgacagtgcgatcgtttggcaaagatagaccccaaaagaaacttgggcaccattaccaactaagcaagcgaaccagtgggtaggttgcttggcatgccaggtagcatacttttggccaagcagtgccacaaaagcaatcatcaccacgtcatagaccaacatataaggttgatgcggtgaaacggcggcgctatgggtcatgcccaaaatctgtttattaaagacataaagcccaattgtgccaaaactgagtatcaatgtgctgatgccgatgagcagttgatgatccagcaaccaatccttgactgccttagcatgtaagctgaaaaggccaccggcaatgaagaagaattgatacgtgaagacattgacgccataagcacggaaccaccatagccaaccactggtatcgatgtggggcagtccgtatttaatcccggccacaatcagcagttgtaagccaaaactggccagtgccaaagcaccgtgatgcccttctgtctttttaaacagccaaagcatcgccggaaacaacagatacagttgcaacgtgactaagacgtaatataggtagaactgatcgccgtgcaggatagcgctgagatagtccggccagaaattggcaatggtaaaaccgccaataccaagcaagatggatccgatcatcagcaacgtattccacaaaacatagggaatgccgacagttgtgaaccgttttttgaagaacaacggccaattacgtttccgcgaatagtaaaccatggtcagaaccagtccggtcatgaacatgaagcccatccgcgtgaagtggatcatcaagtgagtggcaagtaaggcggtgcttgcgaatccggaggacagctgatgctcaaacgcggttgtcgtatgattcaacaagaccccggcaatgaaaatcagtcgcatcaagtcaatttcatataggtaacgatgtttcttagcaggcttggcagcagtagcggttaatactggctctttcatgaggtcaccggctcttctgacaagatcgcttgcaatacccgggcagcggtttgggccactacttcaggcgactgcccgcgggctccggtcgtttcggcaaccaactggccatccctgacgacaataatccgatccgccatccgggctgcttcgttgacatcatgcgtgataagcaacgtactcagcttttgctcggtaaaaattttcaaaatgagatcctgcatccgttgccgcgtcaacgcatctaacgcgcctagcggttcatcaaggagcaacaattgcggcttagccagtaacgcccgggccaacgccagccgttgcttctgcccgccggaaagttgcgccggataaccggtgcttttatcggttaagccaactgcatgcaagagacttttcgcctcgctgatgacctccggatcccgattcttaaacgagacattatccagattggtcagccacggtaacagacggtcattttgaaacatcacccgcatcactaagcctttttcacgacttaggtgaccggctgtcggcgcttcaagcccagcgatcaagcgtaaaatcgtgctttttccgccgccgctcatcccaaccaaggccaggaactcacccgggtacaagttgagttgaatatcgttcaggacggttttgtcaccgtatactttttccacatgttgcagtttcacaattgggttggtcatgcgtcaacgcctccttgtcgccagctgaggaaaagtcgttccagattcttagcaatcacatcagaaagttttcctagcaaggcgtaaatcaaaatacaaagtagaaccgtatccatgcgcataaattcttgggcgttggtggccatgtatcctaaaccggaagtggccgaaatcgtctcggcaacaatcagagtcgtccacatgacaccaagtgcgtagcgaacacccatcagaatgttggccaaggcacccgggaaaatcacgcgggtgaacaatgcccgtctggaaagtccataagcccggcccatttccagtagctccgggtcagcgcccgtaatcccttgatacgtattgatatacatcgggaacatgaccccgatcgccaccaacgcgatcttagcgggttcgccaatccccatcagaataatcatcaaaggaatcaatgacagatgcgggatattgcgcaacatctgaatgggactatccagcagcgcgcggatcggtttgaccaagccgttgatgaggccgagcacaaagccgacactgccgccgatggcaaaaccggccgtagcccgatataggctaatcgcaatattctttggcaattcaccgttttgccacaacgtgatgccatcttggataacggtcgtcggagccgggatcaatgaactggtgatccagttaaaactgactgcagcctgccagccaatcagcaccgccagtggcacgatccatggcagtaccttcaaccaattcacggatcgtctcgtccgcttttttggctgttgcgtcagtgtcgttacttcttgcatcagcgccatctcctttaagttgatggtgttcatactacgggcagcgacttaaagctgacttaagtcaatttgaagagtttatgaccaaaccatcatgaaaaaatgtcttttcgggcgggaaacggcgttgggccagtaaatgagcgggttgaaggaaacgaaaataacggttttatcccttaaaagccgttttgctaaatcacgaagagccaaaagattttgtggcagttcgtttttgtagacgctttcataaaacctgaagtacactaaggaaaatgtcttgctgttggggtaaccaaggcgatcgttatacttcgaacttgtgtttatggcagcgtcaaactgcatttaagggggagcacgttcatgaaacggattgtcagcatttttctttcattcatggttttactggcgtctttattcgtcattaatattttccagactaacgatcagatccgggtcgaaaacattgagtcaacgtcgacttcatttaaggtctatctggccaacaccactaaaagcccgcaagcaacgctaagctttttcgagcaattggccaaaaaccagcacgcctcaattgtgcgaactgactttccgaaccaaaccgttttaaaatccgccgttgttgatcagtcaagttttccttacaccaacttcttccagaatcctcaacccgttaagcttttcgaaaagcccaatgccacttatacccaaactgcttcttctaaaggtcagccgcatattccggttttcggaaaaagcatcaacattcgcctccaaagcatggcagcttattttaagaacggtgacaaatcggcaaatggtatttacactatcatccccgccactggcgcttcgaaagataccatcaccaaggaatttgcggtatttttcgacgttcccgagtcagagttgctgacaccaaaaacacaatctgagaaagaatatgtcaatcgagacttgttgatgtacggtgttgcttttggtgttttggcgctgctgtctttattaggcgtgctcgccttagccatgggccggatcaaaccgattggcgtttggaagattgtcgggctgtcaactcgtgatattttgcttcaactgtatcgattgccaatcatcacgacacttgcatcaagtgtgctagtgctggcggcttgctatttcaactttgactattttccaaaaggtttctggacattgttgggcgcctcccagatagctgttctattgatttttgtaattgccattcttattgtcctcgtactgatccgcagtattaaagtcgttcaatttcttaaaaatgcgattagcttcaaactcggcactggcctccttgccattttgaaagccgtgatgattattttgaccactgttctcttgattggcagtctggccaacatcaaagacattgtcgccgcgacgaagcgctacaatcaggtggctgaagtcgggaaaaaactcaccattaactcattaggatttgaaggcgaagcactgaaaaacttcgagctgaacaacggcaaaaacgaagcaaagctaggcgccgttttctcgcaattggatacgcaacttagcgcggaattcatatccggaggcaccgtgtatccgcgccgaaatttgactaggtaccccgcagcaagtaccttcaaaccgcaagacgcctatcaagttgttcgggttaatcaaaatgccttacgttcgtttaatctttctactaaaaagcatttgtctaaccagtttttagccccaatatctcgcaaaaatgatcggcatatcaagcttttgagtcagctactcgcctacgatcgactgtccgaagctgaacaaaagaaaacgacgcctagccagttaaaagtcactatccagtactacacgccgaccactgaaagggctaaatacttctccagtgatggcaaatggcacgccacttcgaaccccattttcgaagtgatcaacccgcaaaaaattgattacaaaagccaaaatcaattgctaactgcagacgtttcaaatccgctgagaatcacgaacaccaaacaaaaccggcaaaaactcaaagcaatgacaaacgcgcaaaagcttggcggcatcgaactgcgctttgccacgatcggctcgatcttaaacaacgaaaccgattcttcgcgactaggcttacagatttctgctggcctcctgatcatcaccttcctgatctcgctcatcgtctctgcctttgccagctttttgtacttcgaaacgcacaagttcaaattatcggttctgcgcgttctaggcatcaagttgtttgaccgctaccaacagattatcggcttccttcttctaatgtacgtgacgcaaatcatcgtcgcctttatgcttcagaaatcagcgctcgccatcgttgttggcctcattttagctgcttgtgatctactcgtgtctttcgccatgctttatcacgaagaaaataaaaatatcgtccaggttctgaagggggaataagccatgatcgacttgaccaatgtcaccaagacgttcgcttccaaaacaatttttgataacctcaatctccacattgagacaggtgaaatggttgctattatggggccaagtggttcaggcaagtcaaccttactgaacatcatcgggttgattgacgatttttcctcgggcacctacgaattcgatggcgtcaagaatattaagcccaacagccgccaagccaaccgcactattcgcgagaaaataagctatatcttccagaacttcgccctcatcgatgacgaaacagtcgggcaaaatctggcaattgcccagaaatacctcaagctaaataaagcgcaacgtcaaacccaaatcgacgatgcgcttcaaacagtcggattgaacggctatgctgaccgcaaaatatttgaattatccggtggcgaacaacaacgtgtcgccgtcgcccgctgcctcatcaagcccagcaaactcatcctcgccgatgaaccaaccggatcactggatggcgacaaccgcagcctcatcttaaacgaactcaagaacattaaccggctaggaaagaccatcattatcgtgactcacgatccgctggtggccaaggaatgctcccgcacgatcgcgattgggtcgtcatcagaggattagttgtcgatatttgagttctgctgaagaaatctgttgctaccgaagaggtgggatgttatcgtgacgtgggttaatttagttaccccgagtccaccacttttttcacttgatcagcaaggatggtgacaatcataagagtcctctataaaggcaaaccggcctctgtttgggagatcagtcaaaccagtgaacgtcctgattgggtaaaggatgctttagccaaaaatcaaatctattggttagacaaccgcgttcgcattctgatggcagcgttgagaccgccaatcattaagaaaataaattttaccgccaatgacactgatgctggatttggcgtttacgcgtatgggtatacaggcgattttttggacgcaacgaatcagcgtgtggtgtcgcggagaaggtttttgaaggaatacgaggtactggagtagaaaagaaaagctgaatagtgacagaaagcctcggtcatgctagactttttgccactgttcagctttttagtttatgccgtcaattttaacaagaggttctatcagcaaaccggtcacaattaattcagcaacttcccctgtccgccaagatacttggtcgtcaaggcgatgacctgttcagccgtctgatccacaaaatcttggctagtctgttgattgccttgcacaatgtagtacagatgatttgtttctgcggtcacctttgtcttttccacctggcgcgtctccaagtggcaaatgatttcgttgctgtcatcaatgtaagcatattcgcctgctttgacaggctcgggttgaccatttgcaccgatggggatgaatttctcggtgccagtcgtgagtcgcaaattgacattgccatctatgcggtcaacatcgtgggcgccaagcgctaaatggctttgaatcgaaatcaaattatataagtcaacgaccgggttaatcggtgccaactcaccacgtttcaggatgagcttcagcaacgttgctggtgccggcgtgttattgcgttttggcaaatgcaccgcgcgatgcaaatcccaaaagccttgaatgaccggatccgttttaatttgttcgcgatccagtgttgtcaggacttgtttaatctcgttggcaatcatttcttttagcgcctgcgggtacgcgtggttatccacgccggttaattcaacgccgcgaattttaacaccaagcgccaatactctgggatctacgataaagttcatgtgaatggcctctttctttttgcgttgtgtgggttgacgggggtgttaaatgctgctttcgcgttctataacgcgcaagcagtcgcagaaatctacgtgtaaggacctcaagtccaaatggccaaagcccagccatttggacttgaggccacttacactccgatttctaagcgctcctgctcgcgctcacacaaaaagagcacccatcccctattatcaaagggacgagtgctgtcacgtggtaccacccaaatttacattaccttcacaagcaatgcctcaacgacgccgcaatagaatgccgctgcagcacccattgtgaggtccggaaagttaacggttccgaccggctagcctgcgtcaacaagctaacaatatcgcaaagctcatcttcacggctcgctcggttatcctttcccatctcccggactcgctgcacacctgcatcgccgttactcttctctgcatttttgaaggattaaattgcttttatactagtgtcaaagttacggaaagtcaatgtcgcaaaataggaactttttaaatagcgccatcttccgatcaaactcaaatttagcttctaatcatatctctgtagaagccccttatttgcttggaatcgttgtaacggcctggcgattctgggaaaagttttgaatggagaccggcaattggccgttaaagtactgcttgccgatgctggcagcttgactgaagaagttcttgacgtccgactgaaaagcattggaatcattcccttgcaggctcttcaaggcatcggtggcggtttggctgtatgtaatcagcgctttggttaagtcaccattggtattttttgtgccaatccccgacgcgggctgattgttctgcaattccaaggtaattttatctaaatcgtcaacgccttttttagccgacgccataatgtctttttggtcgtctttcaccgtgatcttggttaaggtttggatcacagtatccgagatcttggtgtagcgtttctgaagcgccttttggtcaaacttattggtcgtcaccatcgtcgaagatttttttgccgacgaatctgacgattttgactgacagccagcaatgccgacaatcgtcaccattaagaccaataagctcattaattttcgcacgttccattcctccaatgcgttgtcattcctgcatgcctgataatttcaccatgtcaatggctacaataccattttccatagctcccagccagtcaagccctgcaatggcttggccgctgcaagcgcatgattactgacttcctgccaccaagtttgatccgtcaataatttcaatatatcagtcgccgcatcaagcacttgctcactcggcttgacaattcccagctcaccattggttgcgccattcagcatctgatcggcagtttttgcaaacgtgatgaccggcgtgccataagtgagcgagctcaacaaatcagcatcccccaagttgcctagatccgctacgataaatgccattacctgccccaagtcgcctgagtccgctaatgattgggtttgaacatccaaaagtgaagacaatccgagcggctcaattctttttagcaattgctgagccagcgcttgatcttgatgcttgacgaaaagatccaacttcacttgattttctttgaccttaaccattgctaacgtgctcagtaactgttcaaaaatcgccgagttttgattatccagctccatcgccactcggtcaggcaggcgctgttcccatggcttaatttccggaatagtggactgctggctcactgttgccgcaatgggcactacatttccatattgcgttaaagatgacgcaaagggcgcttgaggatcagcaatcaattgcccaaaagcagcgcgaccaacgtttgactgctcgacttgcctgatagcactgacatcctcttcggttctgacaactggcacaaaatcagtcattgttgcttgtcccaacatgggcaaaacgcggcttggttgatccaccaatagtttacccggctgttgcttcatcacatgtactaagcagtatctggcaaatgacgcccaatccgtaaactcggctgattgcccagccaagtccaacactgtcagatgttgcaaaatgccgttaccatcatactggcaaaacaaaagcggcattccattcgcataaaaatacacggctagtcgcacttgcccatccgcttggaaatacacggttttcaccttattgccttgatgatcataaacctcggcataacttttacggttgttagcgccaaagaacgtaatggtatgaatccgctgtgcggtcaactcagcttcatcgtcaaaagctgtgacatcatacatcaaatggtcaccattcaaaaattgtaaatggtgatcaactgtcttggtttgataatcgttcagcttcataatgtcgccaatcgtgtaaagcggttttccttcacttgtgtcaacgccacgtaaagcatcaatcagtgacataacctgatccgactgtaaacgagccttttgaacctgctcatccagatcttcttgcgcgctcaagacaatgatacttgccggcacttggtgatccgcaaataattggagtcgttgtacctgctctttaccactaggtgtatcgccttcaaatcgatatgttaaaaaataaaccatgattctcctccgcattcattctaccgataccaacccgctcaatgaggcatatattcatgccaactcaagatcggcaacacctcgcctgccaacctcttaacatccggttgatcgacaaattgctgactgattaaatacgcctgtgccttcacattcgccagcagcgcagtgtcaggtttgtcataaacaattggcaccaaatgcggatgcatggccggctcgtcaataagttgcgcaaacaggtcactatcagcatcgatataaagtttacgttttgtatgctgaaagttttgcaacaaccaccaaaccattaactcttcctcatcatctaaggccttaatcggttccccactttccgactctacccaaaactgattaaaagtcggcaatgccacaatgactggacgcccgctcatgtcaaccagcatacggtgcaccgaagtcgtcacaaaaaacggatctgttgcattttgccgatggatattcggcatttcagcgaaacgttcagtcatcatcaagcgcccttggtgatcgtagctatcttcgcgacgcaacttaccatcgcgaaaataactaacaacctgcacccgctcctggtcatcacgttcgactttaatcgcagtttgcccatcttgatcgacataacgcgtcacatgactgcccaaagtttgcttaggcgtcagttccttggtgaattcactaccaaatgtggccgttgcgcgactgacactgccgcgttggtgtaatgatgtataaaaattatggtatgacgttggcggtaaaaacagcttttctttgtcacgataacgcatgaaccgggaaactttgccaaaaccgaacccgccatcaatgatcgctggggccaaccctttatttttaaaataattcatcaccgttgcaatctttgcccacagctgctgtgacatatcttctggcaaagtctctaagtaaaaaaagtcttgcttatcatcgcttattacgaaatcattcgttttttcagtcgcattcgttgtttcctgtttcttttttgatctattcgacaaccagcccatgactgcaccctaccttcatttaataagtgttctttggtgaaacaaaccagacgcacatggtcccgtcataaacaaaaaaagccaaaagacacttatgtattcattatttggcaactttccttaatgtctgtgaacaaagaaatgttttgcgcctgtcacagtgaatggcaaaagtcaacaacactaataattataacatgatcgtgattcagaacgcacttctacactcacttttggattggatatctcttgaaatgccagacaagatcaaaaaatcaaaaagaattttcaactttagagtaattaatattcaacaataaaattcttttttaaatcggctctttgctgtaaaataggcacatgggattttgcctgtttctcattatttaattgtacttaaatgaacgcttttatttggctgatcgtcatcacgccggttaatcagacaatgttgttgcttgatgctaatgttttgccagaacctttggagattaaagacaacaagtttaataatacgtgcatcggtcatgcaattatgccttataatacgattgagattaggtaatgtgtcaactagaatcagcaatctgggcgaaaacgatgccggactggcacaaagaacaagacaattagcaggtgagaaataatgcttcaattgtttagtagaaatagaaaacttaatttatggggtggtttaaaaatgagtatctttgggaaaaaagggcggatccagtttttgcgcaatcagccaaacaagctccaacaggaaagcgaacaaaactcgagcgcggcgacaggggatagctatactgatctgttttcgtctgcttcatctgttaagtccaaacaagaagctgcttccaagccgcgggtacttccagaaactggaacgaaaaccgcggtggcggatcgtccggttgccaatttgcgttccgctactgcgtctaccgcaacgacgactactgccaagtcgacatcttcgtcgctgaccgaatccgcttcagcatcaacctctaacacgcacacaggctcgcaatcatcgtcaaccgcttcacgcaccagtgtggcaacttctgcaaaatcaacgatgtcagctaagtcaccagaagctagcaaaccggcgatggcaaaaccaacacagagcgagcgcaaatcaggagaggtaccaagttcggctccaaaaaccgaagcaacaaacatcaccgccagctcggctaaaattgacaatgccaagaacaccttgaaacaagcgatttctacatacaatgaggcccggcgaacgcttcaaacgaatatgtttgctaaacgtgccgatttgcaggccgccctaacccaaaacaagttgacgttggctcaaacacaacgcgacatcaaagccatgcaaaaacgcatggcccaaaatgatggtagcgagttagttcctgcgcaaaatacaattagcgatttacaaaaccaagccaacaaaattgcgagccaactcaagtccaaacaaggcattcttgacgatctcaaccgccaacgccgatctctagaaaagcaagcgcaaatgacccttgagcagggtaagaaattcaagcaggatgaagaggcaatcatggccgctttttccggcatcaaagatccggaaaaagtcctcgcctttgccgatgctcaccgtaagcaaatcgatgacattaaggccggtgaaaaaaagctaaccgcaacgcagctcagcttgaagaagcagcttgaagatattatcaatgaaattaaccaagctaaagatgaaatcaccaaaatcaatagcgaacaaaatgccaatggccaagctattaccaatgcgcaacgcaagcttgatacattgaaagctaaagtggccagtgatcaggctgacgacaaagcccaattagacaaacttgagcatcaacaggccgatttaacagacgagtcaaaacgtttgcatgaccagttgcatacgctcagtgatggcatcaccgcatggttgaacttctcggagccggttcatgctttgggtgaagctgactatgcaccattaattctggatattgattcgttctctgcacatgattttgaagcgctggccccgctaagtgacatgttacaatcaatgccaaagaaacaggttggtattttcacgacctatttcaacatcgatttggttccgaccatcgatgcctggtcaacggctaacaacttcaatccggatgaaatccaaatcatcaactgcctttatcaattgcaaaatgctggtgaaggcgccgagaatgccgcaacgttacctgctaatatcaaaaatcgccaatggaatgaaaaccacacggccgaaaccatcaccatgccggatggtcaaaccaacatgcttgtcacctatcaactcgacgcccaaaagaagccgaccaagctcattgcaaagattgcctatcgccaaggtgacaaactcacgaaagaaagtttcttccgtaagaatggtgtgctatcggccaacacattctatgacgttgccaacgggatcacacgcaaagagttctaccgtcgtgacggtttgctcgtcgtttcagcaacttatgaaggtcagaagttaagcgacattagtgtcttcaacgaagccggtctgcaaatcaactctttcgactcccttacggctctcaacgtttggtggctacaaaagtcattcccacaggaaggcgctatgatcggcaacttcaagtccaaagcctaccgtgatttgaccgccaaatccggcgtcaagttagtgccatttgtcgatgaagccgttgtcgacacagacgactttactcgctggatggccgatcacaagcaacaggcctttatcaccaacaacgtcacgacacaaagtgccttagccaaaaaggccaagctgccactttatgttaatgtactcaatcaggcaccattaccggttcaactttcgatgcccgctgattgatcatcaaccaaaatttctatagaaaacggactcggctgcaagccggtcgcaataagaacccagcgctgcgctcacttggatgagctcaccgcgctgggttcttattgttgtctcttctggtactgaccgaaaagatcgtctattcagcttgaatcattttactgtcctcaatctgatgttgtaactgcaaattttcaaaacgcagattgttgaccttatcttgcagtgtctttgtttgctcttgactttctgcatacttgtcggttaatgccttgatcgacttttgtgcctcttggagtttggcctgcaattcagtcacaagcgcatgttggctttcgttttgaacgttttggcgattaagcacctcttcatgggtttgtctgacctgctcgcgaatcttgccaagtgcttcattcgtatcatttaaatccttcttggtgttttccagctcgttcttagtcacaatcaggttgattaaaatctcactgagtttattgaccgtcttgctatgtgtgcgctcgaattcagcggaagcatccaagtgttgcgcaagttttgtggacagagccgccacttgttcttggttcatttggctttgttgctgaagtgctttgatggcgaccatcacagcggtctctgtctctgagctgcgacctgtagcactatgcacttcagttgagtcggaagtttggtctgatacctttggcttttcagtagtgacatgctcaacactcgattgattctccgaaacttgtgtcatctgttggttaggtacagatgcgccagcgttaccctcagttggagcctgtgaatgggttgagtttgctgttgaactcaattcttcattcttttctgatgagacttcaataactttttcaactgcggcttgtgaagctgacttggctacattcatttccggcgtcgagccattctccccatcctgaagttgttgtgttgtttttgccggatccgatgaggcggttgcagctatctcggtacgagtatcacctgctgatgcaatggccgcagcatcggaagcttgcgcatcagcttcagagagacttttatgattgaaatgatcaatgtcaatcacattgtccggtttaaaggccatacctgctgccggagttgaagcttcgccttcttttttctctttttcattagcagttactttcaaatccgcagaatcattagcatcggccgctgaagccgattgactgctcgcagattgttcagaatcaacataaagtgttaactgatcgttagcaaagctcagttgcgcacctttggaaatgctcattgtccagtttttgcttttcactacttcagacttttcaggaacgtcatccgcctgagcctgttccgcgttaccggatggctctgattcactggctgtcgctgtccctgcaatccctgtctgtaaaccgttggcgtccgttcggggcaacaactccgcaaggcctgcgagaccgtcatccccagccctacgcaattgcttctccaacgcaccaagaaggtcattctgatctgacgtttttttcttagcaaataggcccatcttcatcttcctttctaaaatcggttcacacgtttcattgtcagtaacttttaaagcaatgacgtgtgagattatctcgcaacgttaattttttgcagtaaatagccaaattacgcgaccgccacggttttaatcgcagagtcagcattcggcgcgatcactttttgttcagcttgcaactgcttcaattgtgcttgaaggcttgcaaattccggcgagtcaacataaacaaaagttatgtctggaagcggcaccgtctggggattagttttcgcattggccattgccaaagctttatcatacagacttttatcactgtaagttggggcttcaaaagcgtaataatagctgtactgatttttttcgctcggcgattgggtaaatgccaatcccatcgtcggaccgccatacagcaaatttgcccggtgaccgtaatgaccatcgccaatcggttccggattatctgattcatcataccaatccatgaccagataataggcaatctcctgattagagtgcatgtcctcgataatccctttgctggccccaatatcttcagtcgatccgtgagaaccatcgtgactaaagttcgtcataatctcttgaacccgcttagtggcaaaagcctcttcactgactgaataagtcaaaggtttttggccatttagcgtgcgtagctgattcacgtattgtagaaattcagcagcaatttctttggcgtcaggcttaaagtccggatcagcggcaagataaactgcttctttgctcggatagttagtggtggaagtgaatctggaggcaaggttgctgtcagagtgcggtaaggattggatagcattctttatactagcaagtgtggcactgtcagaagggatggtgtacgattctttacctcccactctgacttttcccattttggtaacgatagtgccgttgggatcggtaaattcgaaacgttgaaaataaattcctggtaatgttaccggaaccgtaccatcaattctgatgtctgacaagctaaccgctttcccggtggaattgacagcagctattaacattttagttggattccaacgcgtgcccaagggaatgctcatatcgaaaagattaatgtatggtgttagcgtggtgcttttcgatgtgtctgtactatcactatcggtgacatcaggggttttaggggcaggcgtctttgagtcaccattttgatggtccttgccattattgttatttgtcgctgcaccggtactggatgagcccggaaacaatccttggatcgttgttttcacttggttaatcacccattgaattggtgccatgatgccgccaagaacatctttaaacatcgtcattgccgatccagcaaacgaagcaattccgttgaccactgacacgctgatattcagaaccccttgcagtgcgttaataattgttggtgcaactgtggccgtgatgtttgaaacaccggtcaacacacctgaaagtccaacaacccccgccaccgccttgacgatcgaagcaggccctagattcgtcgcagtatctaaaagcgggttaatggagtttgccagattctgaccaataaatggaatggattttaataccggtgagatcacgccttgaatcgctttaccaatcgtgttaatgccaaggtttagcgcgccggaaaccaaaccggttgggtcaatgccaagcgaattagcaacagtaactgcatcttgggcagctttgattgcaccactagcaagtggcaaaatcacattaacaattggcagggagcctgctacggaccgcaacccggaaacgattgcggaaagcccgtctagagcaccattaacgccatttttgatggcccacttaacggcatctccaagtgtcaaattgtagacgtcactaatttgcttaaccagctgactcaggtccggagccgtaagccacggttgcgccgccgacgtactcgttgcgcccagtatgattgctgacgcacgattagcagcagctgatgatgtgatttcttctaactttgcttcatcttgactctgattgatactggatacgtactggtcgatgtgaagactggcattgatggcttgacgaatccgggcttcttgatttttttctacttcatcactggttacgttagaagtgattgatgtggaaccttcagtgaagctagaactagtcttagtttcactttcagcgatactttgaagttcagcgctcaccgaagaccctttttcagtatatttatcgtttttagttaattcggcggtggctgcaggctgcgaaacgttttgtgcactgcgacttggatcgttttcggaagttgtgaaagctaagtgaacaaccggctcttctgtcgttgttgcaaccgtttcattcttttgctgcgagacagatgcacttgcctgtgatgcctcttttgttgtcgaaacttgttgtgtctcttgctgcggcgatactgttgctttttcttggttgtcaacagttggttgattattttgctcgcgagttacttgaaaaccagcattcttgtcccttggcacttcagagttctgtaaattgtcagcttgaatagccgttttctgaacctgatccgtcactttaatagcagtttctatatctgattgtgtatctgcattgacgtgatttgtcatgactgcatccgccaaaaacgccccgcttgcaaaagttacaatcacacttgaagcatacaaccactttttcccagatttccatcttctaaaccgggtgatcttagtttgttgattaagccacctttgcccgctatgattccccattatctaatctccttctccataattgccagcgtcaacgtttaagcagtccgctcataaccgcaaaaacagtctccttgttcgattcatgatcttttgcactgaaacttaaaaaaagaagtcaacccaaaagctcggattaacttctttcccgccttcagtgaactgatgtgactgttcacataaaaactttcttactcaacttcgtgaactgtgacaattgtcttttcttcaactctcttgccagatacctcgtcataaaatgcaactttaacaggatagaaacctggattagtaggccaaacctgaccttcgtattcaagcttagctgatggtacgttggcaccatctgaatacgtagcgtttacaacgacatcgcttggatcaaaccgcaatccaactggcagcgagattggttttagtttcaattcttcttgcataaatatcacctaggcgaccgtgactgtcgcgtaaccggtaacaacctcgttatcgttcatttcgttaacgaaggagtacttaacataaaacttacctggcaaattagtatagatatttccttcaaccttgatgttagattttgaaatatccttaccattaccatcctgagcgctgacaatcgcatcaaaaggattaaaacgagcaccacggaacaacttaatgtcctttgtctttagcttgccagccttagaagcaaggctttggacggtgttgatcaaatcagaaataccaggtaatgagccgacatccttgatcagcaactgaagatttggcaattgaagcttcaaaccaagcaggcttgcaacagcgccgataccgccaccaatggcaccgcctataactgatccgattggtgtaccaaccagcgttgcaattgtatccgtcaaggcagtaacccagccaactaccaggaacatgattggatcgacaataatcccaaggccgatgacaccaataacaccaccgatgaagccagcgatcccatcaacaagtgtgccaatagggaacgaaatgatccagtcgcctagggtttccccgacaagcgcaccgattgcagatcctaaagccgtaccactgacaacggtgtcaaggttaccgtctttgtcagctaaaccagggcccgaggtggcgccgtagtacgcaccaagcggagcaccaatcaaaccggctaaccagcccgtaatccccggcgcccaaccaatatcaccagcggtacttgcattggcgacaatcccaacgattggaattaacccaagaattgagttcagaatcgttccagggatcccggcaaccagaaaggcaccgaagcccccgacacctgttgcaattgtgccatagaacgtgctaccaatggcgccgccaaccaacgattcaacaaacttaccgatttcaccgagtcccgtcagatctggaacaagtcgcactggattgatattcgtcgccagccatgaaacaacattccagattgttccggtaatgccactcacaatcccgcctaaatcaaaacctgcgagtgaagttgacatgcttgccttcgagatagatgatttcagctcattggcaacggcatcctgtgcatcattaatttgcttggtcattgccttgtaagaatccttggcttcgtatttctgcaaatcatcggcaaaagccttaccgatatctgttgcgaagaacgatgcagctaaggattgaatcgctgtcgcatctgaagccttttctgctgccgtcatagctttgctaaacgcggcaaactcaggaatatctgcatacgacttcaaggtttccaataatgccttaccatcagcagtctgcagatatgccgtcacagccgcagaactctgagcagcacccgaatcggctgccagcttagcttcatcaagaagcttcttgccggcatcggttttcatgaactcagctaccgcggcagaattggctgctgcttttttagtagcgttagcagatgctgctgaaatactcgatgacagtgagttcagcattgcttttgcttcaggcgtacttgccagtgattctaacgatgctttgactgctgctaacgaatttaacgccttgccttgcgacgttgtgttaaattcagcaatcaatgcccgttgcttggcaggatcagcagctgcatctgatagctgtttcttaaaagccaaaacagcagggtcattcgccaacgaaccagcttcactcaaaagacttgctgcactctggagcttatcgccaagctgggcaaaagcggcactgccagccggcgttttcgcgtaagatgccgccgatgataagagatcagcaaattgctgcgaagttggtgtcccggaacttgctgttgtcgcaccaattgatgctgcaaagtccattcctgcctttgtggcggcaactgcagcagcggatgataccgcattggtcgtggttgccgcgccactgtttgcaggtgcaggtgttgcggcggttgcaacagttgcttgtgaagctgctgcactcggcgcctgcgtcgaagttgcgactggcgcggctgcagaactttccactactttggctgtctctgttgccactgatgacgcagaaggctgctcaacgtttttagttgtctccgctgaagcctcactttggacagccgccgatgaagcagctttagcacttgctgcagcctggtcgacttgctgtgccacttgaatcgtgtcggttgtgacgtcggccttaactgttttccctgattctaaggcacccgcaccgataattgaaaccaccagcgaagaagcgaataaccacttcttgcctttcttccaagaacgaaaatgcgtatttttaatctgcgctttttcgttccccctttgtctttgtaaatttttcttcatatgattcggccccactttttcattgtttgcccttagttcattcaagcaaattcagaccacattacgcttcatgacgacggtgacgtgttgcaccgtaaagagataatgcagccatcaaactaacgccggctaacgcaatagcgcctgtagcttcgtcttcgcctgtttgtggtagtgaatggtcgccactagtagaaccattgccaaactgatttccattgtttgcggttgatccattcgtaacaccggttgctgacaatttacccacactgttggcaccggttgttgaaccactaccattcgtgccattgccattcagaccagtcccttggctattgttaccattactgttcgaaccgttgccattattagtgccattgctaccgttgtgattagcgtcagcgccggtacctgtaccgttagtaccagtcccttggccgttgttaccattaccgttcgaaccgttgccactagtagaaccattgccaccgttgtgattagcatcagcgcctgtacccgtaccattagtaccagtcccttgaccgttgtcaccactaccgttcgaaccgttgctattagtaccggaaccatttgtaccattcccgttaccattggcattattgccaccgctattcgtaccactaccattgccattagtatcaggaagtgcaccattgttagcttgagtagccagatccttagcaagatcgcgatcagcttcagcacgacttgccgcatttgcagcattgttagcatcagcaatcgcagcatcggcgtaccgcttagcagctgctgtgtacttagcagcttcatcagccttgccagcttctttaaagacgccagctaaggactgagcaattttggctgaatttgcattggtcgcggcatctgttgcataagatgcagcatttgaactagctgtcgatgcatcagtattcaagtatgcgatttgcttattattcggatcattctttgcaatagcggcagtggatgctgctgcatcagaggctaaggcagcggacttcttagcagcttcagcggcattagttgctgcacttacataatcttgtcctgcaacagcattggtggcagctttagttgcggcgtcattagctgcactggctgcagcatttgcagccttggctgcatcattagctgcttgagaagctgcagatgcgtcacccttagatgctgcatcactcgctttagtggcagcatctgctgcgtttgaggcggcatcactcgctttagcagcatcactattgatggccgcatcggaagggttgttcttcgcatcatttgcagcattcttagcggcatcgcttgctttcgcggcatcgttggcggcagctttggcagcattgttagctgcctcctgagcagctgtctgtgccgcatcacttgccgtcttggcatcactagctgctacattcgctgcatcactagccttgcttgcatcgcctgctttagctgcttgttcagcagttttggcagcatcagccgcatgactggcggcatcggaagcagtcttgtttgcgtccgcaatcgtcttgtcatttggatattcatttgcatatgaaccggtttgcttagcagaatcagctgcatctttagcagacttatttgcagcatcggcagaaccatttgcggctgtgcttgtgccactattgcctgctgacgaagcggccttcgcggcatcctttgccgcattagctgctttcacagcatcggcttcagcacgacttgctgcgtttgaggcggctgagacatcgccagtcttggcagctgtatcagcatcttgtgccgctttggcagcatcagcggcggcatcggaagcagttttgtttgcatccgcaattgtcttgtcgttcggatactcatttgcatatgaaccagtttgcttagcagaatcagctgcattcttagcagacttgcttgcagcatcagcatagtcatttgcggctgtgcttgtgccactatcgccggctgacgaagcggccttcgcggcatcctttgccgcattggctgctttcacagcatcggcttcagcacgacttgctgcgtttgaggcagctgaaacatcgccggtcttggcagctgtatcagcggcttgtgctgctttggcagcatcagccgcagcagcggacgcatgcttgagcgcatcagcaataactgcattatcagggtacttattagcgtaatcacttgtctgatttgctgaatcagatgcctgatttgcaaaactgtgggcgttagctgcgtaatccttagccgcgttcaatgcagcttgagaggccttagctgctgccttggccgcatcatttgctgcattagaagcccttacagcatcatctgctgcacgacttgccgcgttcgacgcatcagcaacgttgccactcttagcagccacgtcagcatcttgagcagctttggcggcatcggtcgctgcgtctgaagctttcttatacgcggttgaaacatccgaatcttgaggatactcattcgcgtagttggcagcctgttttgctgaatctgctgctttatctgcagaactatgagcatcggttgcataaccttttgctgcgttcgatactgcttcagaagctttggcggctgccttggctgcatcatttgccgcattagaagccttcaaagcatcatccgctgcacgacttgctgcatcggatgcttccgccacattgccactcttggcagctgtgtcagcggcttgagcagccttggccgcatcagctgcagcgtcagatgctttcttggcagcatttgaaacagcagaatcgtcaggatacttgcttgcataatcattagcctgagttgctgagtcggaagcatcattcgctgaactgtgtgcattatccgcgtaacctttggccgcgttcaatgctgcttcagaagctttggcggctgccttggctgcatcgcttgcagcattagatgccttcacagcatcagccgcggcacgacttgctgcatcggatgcttccgccacattgccactcttggcagctgtgtcagcggcttgagcagccttggccgcatcagctgcagcgtcagatgctttcttggcagcatttgaaacagcagaatcgtcaggatacttgcttgcataatcattagcctgagttgctgagtcggaagcatcattcgctgaactgtgtgcattatccgcgtaaccttttgcagcattcaatgctgcttcagaggcttttgcgccagccttggccgcgtcgtttgcggcattggatgctttcaacgcatcgtccgcggcacgacttgctgcatcagatgcgtctgaaacattaccactcttagctgccttgtcagctgcttgagcagctttggcggcatcggtcgcagcatcagaagctttcttgtaagcagttgaaacagccgcatcatcaggatacttgttggcgtaatcgcttgcctggcttgcagcggctgcggcatcgtttgctgaactatgcgcatcatcagcatattctgtagctgcctgagaagctgcttcagaagctcgttgtgctgcttttgctgcgtcgtttgcagcatttgctgctttcgcggcagcatttgctgcgcgtttggccgcttcagaagcactagctgcatcatggttcttggcagcactgtcggcatctttagctgcgtttgcggcatcggttgcagcatcagctgctttcttggcagcatttgaaacagcagcattgtcaggataattatttgcaaagtcgcttgcctgactcgctgaatcagaggctgcgtcagccgatttgtgagcatcggatgcggcattgtttgccgcacgcgatgcagcgtcactcgcagccttcactgcagcattagctgcgtttgaagcgtccgtggccgctttagcagctgtcgaactatcgccattacgagcggcatcactcgctttggcagcagctgaacttgctgtgcttgctgcagcgcttgcgttatttgcatcgttttggatattggcatctgacggattatcaaaagcatttgaagcggcactggcagcagcatcactcgctttggctgcgtcatcggctgcagctttagcggcattgcttgctgcacgtgatgcagcatcactagccgcgtcagtcgctgccttggcagcattcgaagcatccgtggccgcttttgaagccgtagaactatcgcctttgcttgcagcgtcactcgccttggcagctgctgtacttgcctggcttgccgcggcatttgccttgtccgcgtcactttggatattggcatcagacgggttgttcgcagcgtcactcgcagccttcttggccgcatcgctagctttggctgcatcatctgccgctgcttttgctgcattgttcgctgcgcgtgatgcagcatcacttgcggcttcattcgctgtctttgcagcgtttaaagcgtcattggctgctttgccagccgtggaactgtcacccttgcttgctgcgtcacttgccttggctgctgctgtacttgcctggcttgctgctgcatttgctttgtccgcgtcactttggatattggcatcagacgggttgttcgcagcgtcactcgcagctttcttagctgcatcgctagctttggctgcatcatctgccgctgcttttgctgcattgtttgctgcgcgtgatgcagcgtcgtttgcggcttcacccgctgtcttggcagcgtttgaagcgtcagtagctgcttttgacgcagttgcactgtcgcccttgcttgctgcgtcacttgctttagctgccgcagtgcttgcttggtttgctgctgcatttgctttgtccgcgtcactttggatattggcatcggatttgttgttggccgcatcgctcgcagctttcttggcagcgtcgcttgccttggcagcatcatttgccgctgctttggcagcatcactggcagctttagaagcagcctggcttgcagcttctgcagctttagccgctctgttagcagcatcggaagcaatgcgcgcatcactttctgctgtacttgcggcattacttgcttttgcaacatcccccgttttggcagcatcacttgcagcatcagctgcttttgcagcgtcggcagccgctgaacttgctgtgcttgctgcagtagagacagtgctatcagaagggtacttgttgtgatttgcttccgcctgttttgcagaatcagatgcggcattggcagcttttcgagcagcatcagcatagatacctgcctgcgaattagaagtgctgccgccactatcattgccgccgtcaccgtatgcagcagctgccttcgcagcgtcactggcagctgcactagctacctgagcagcgttggcagcctcataagccttctcaagtgcggttggcacatcaccactctttgcggcgtttgctgcatcacttgctgcagtggatgcaacagcggcggcagaggtcgcagtacttgtggctttagaaattgcagcatcggaaggatattgttttgcataaccttctgctttagtcgcagaggccgcggcttggtcagcagaattctttgcctgaccagccaattcttttgctcgcaccacattagcttcacttgtagccaagcttgcagcatcggaagcatcttttgcaaatccagcagcctgattagccgcgtcagatgctccggaaacgttgccgttctttgcggcggttgcggccgctgtagcagcatcggaagctttagctgcagcactgcttgcggtatccgcagcatgaacaatcagtggatcgcttggatacttatctttcgttgatcctgcctgcttagcggaggtagcagcagcatctgcagacttcttagctgcatctgcaaattttccggcatcggtaacggcagcactgctgttcgcatctgatgctgcagacgctgcttttgccgcttcagccgctgcatcagatgcggttgcggccgcttgggaagcaatagcagcctgactgaatgcagtatgcggatcggtctttgaagcggcttcatcagcagccttagctgcatcagaagctaccttggcagcggcgtctgctttggcagcagctgcggaaaccttcgcatcagaaggatactttttggcaaaatcatctgcctgacttgcagatgccgaggcttgatttgcagaagctttagcattgtcggcatagcctcgcgcctcattggcatttgcctggctatgggccgtgacagctgcatcagaagcaatttttgcgtcgctcgccgcgtcactcgctgcattggaagcagcagattcattgccattctttgctgcatcagacgcttgagttgcagcatcagacgctttagccgctgcagaagaggcagtacttgcagcattagaaatcaaagtgtcagaaggatacttcttagcgtcagtgcttgcttggcttgctgaatcagaggccgcatctgcggatttcttagcatcactcgcaaagtcttttgcatccgctgctgcgccaattgtcttagctttgtccatggcatcggtcgcaaccttggcggcgtcagatgcatctttggcttcctgcaaggcttttgcagcttgttcatttgctttggcagcaagtgacgatgcgttacttgctgcttttgctgcttcgttagcgtacgaaccagcagcatcatagtcgccggctttattggccgcgtctacttgagcaactgcactctcaaccgccttatttgcatccgcaaccgaagtggccagtcccttagcgcccgcagcgtcactagctgctgctgatgcaaatcctgctgtcttagtgttagcagcagacgctacactattgagatctgctaggtccttgttatctggatgtcttgatgcagcaccagaggtataggcgtacgcagaactggcagctgtacttgccgtgtttgcaatatcagcggcggaatttgccgtcaccgttgcttggcttgctgaagtgcttgctgtggaagcatcagacgttggtttcgttgtgtctgcagctgggataacccgaataaagaaatacccagtaaaggctccgacaaattctgtcgcaccggttgcctgtgcagcttgaacggtataaacaactgcatacgtacccggcttgttgtagtcttcaacactgttccatactggaatattggcatctgtctctggacggccaacttgcttggcaagctctgtgctgatcttaggtaaaggcgtgatcgccgcaaatggcccatgaaactggccatcaccgacatcggtagtctgcgaatagtcaatgacaccttccgctaaacttgcactgagcattaccccattacctaattcaaaggttacaagttgttgaccttgtgttgcagcactggcgactgcattatcaggaaaggcgctcttgaaagctgcgtcccccgcatgaatcgtcaagttgttggcagtcatcaaaacagacttatcgccattttgatccatggtcagcgatttgggaaaatcaccgctatcactcgcgacagaccccgaagccagcgtaaccgagcttgcggctgctgggtttgcagttgctgaacttgcagctgctgatgaagccgtcgcagatgccggagtcgttgctgtttgcacctgtgacgccgtactttgtgtctgcacattggtagcagccgctgaacttggtgcagccgcttgtgcctgggaagctacctgaacgcttgcctgaattgcagcatcattagcctgactctgttgggcaaccgcactttgcggcgcacgactctgcgcgctggaagctgctgattgttgtgcaacagatgatgttggcgtcgaagtattgctgagtgccgccgctgccgcaatggactgctcaacattcgagtccgcatgaaccggcgccgattcagaaatagcgacgccagcaccgccggctaagaacgcaaggatactataagcaaatacccaacgcttccccgccttatacattttgaagttcgtatttttctttacgagcttctgctttttattgaacttttccatttgctcgccccacttaattaaaaaattgggacaccattgaccacattcttgattaaaaatgtgaaaacgatgtcgcataaatctgtggttcagtggcaaaatcgagtctcaagttcgatttaccattttttacaaaagctgctgaaataccgacttaagccggccgaccaccattagtcttacgtgaagttttaaaatccgaaaagggctagtcaggtattggcgttctagaatgaccaatattgctagcatttggcgatcagcaagcccacagcaacccacccaagagctggtatacgtcagacagcttgatgattgcatttgtggtttcgcttaaaatttgatgacaggcaagtcactattcatttgcctgtcattacgatcacctccagatattatgcctgttattttgacacattcacatgttataacatttctcataccaccacaactccaatgttataaaaagattttttagtattttgacaacgtgttatttactttaaaaaatattgtcaaaagttgataatgacagcctttttgtggctgtttatgagccttttacgattttttgagttctcaaaggttcttaaaaagtccatcaaagccactattttataattattaatatttcaaaatctaaaatatcagaatcttaactgaatgttattttttcaactttttgactatctgaaattcttgatgcattcaatctagctgctttcgaattctagttgcttactcattcgcctcaaattttaaggtaaaaaaagagatggtcattgccatctcttccatacgttaacaattcaattctaagggttcctacattttgaaattatagtgcttctgctgccaacactttcgcacgctttttcgcggcgtagtcgaacagcgtctgccattgttcaaacgtattatcgtccgtaaagcgcaacgcattttgataagcttcctcactgaaggctgccagcttgtccttatgcgtaagcaaatcaatgatggcgtctgccaagccatcaatatcgccgtttttagtcagaatgccgcttttaccatcttcgagaatgtctgccggcccatagtgaatattgtttgcgatcatgggtaatccatgcgactgagcttcgattaaggttagtggaaaaccctcagcccttgatggcaatagcccgacttgagcacgattgtaaacctctgcgatgttgctggtgtaccctttaaataaaacactatcttctaagtgcatttctctgactaaggcgcgcatcttatcacccacatcaccgttagcgtaaccccacaattcaagcttagcatcaggaataactttgagtactttttcgaaggctttaattgaactgtcctgttgcttctctggtgctaggcgggcgacatggacgacgagattattttcccgttgtgcaaacggcactttattggcttcaacatccgcagccttaacaaatgcaaccctaatattgaagactggcggcttggttccccatcgtgcctctacgtcctttttctgctgcgaagatggcgcaataataccgtcccacttatcaagattgttcagtgagctggcatagaaattgttcaatcggtcatgcatgatatctttgtcatcagccaaatggttgttgtgtaaatgcagcactttaaatgctgccgtctccatatgtcgcaatccccagccagtctccgtagtccgatcgctaataaacacattgtacccaccatcgactttattcagctgatcgtagaaaaaccgtgtcaaatcatgtaggccatcgaacaaatagtccacaccgtcaaaatcatctaacttgtacgaaaatttctccttgtttgcccgattgagataatggagtttttcgatcttaacgttaccttccaagtctagataatgttcttggaagatattaccggcattgtcaaaatactggttcaggcaaagaaagccacgagaattccaccagctcatctttgtcgtgcgaccggttgtatcaaaatattgaacattactgatttctcgtggattgacggcgccttgacgcaaataggcaatccgatagagtttattgtcttttaaatacgtgattttgttgtcttcggctttctgcgtgatgtcatccccaacggcaatgacatcatcaaccgtggttacggttttttcgacatgtgtggtgccgcaaaaataatcgaacagattcacaaaatgatcgtcgctgatcttggcatcagtggtcacatcatgcagattcatggcaaaaactcgcgtcacgattttcgccggaacttgatgctgattgaataagttcagtcgctgaatttctgcgccttcaatgcctgatttagcaaactgcatgttctcatttaaaaaataatacataacccaacctccattacagacctaagacttgctgccactgcttgtagacatctgcttcatccaaacgtcgaccgacattttccaatgctttttcaccaaaagccgcgcgcttttccggatgttgcaataaatcaacaatgagctttgccatgattgccaaatcattttgcggaaccaaatacccgtcttctttgttggcaatttcatcgcttgggccgtaatggaaccgatagctgataaccggaaggccatgcgtctgtgcttccaagattgccagcggcccaccgtcagttgccgcagtattcaatagcatggcgtactgctcataccgcttatccaagtctgtcacgtagtctttaaagtgaacctgcttatcaagtttcaaatctttggctaatgcttcaagcttcttttggtaatcagcatccccataaccgtacaggtccaattcaacgccaggaatcttattgttgaccaaacccagcgcccggatcatctggtcaagctgccgttcttcagcaattcggccgacgtacattaactttttattgtcgacagcagttgtagcttcagtaggtttttgcggtaacgccttgggatcgactgtgactgctggaatagctgtcacttttgctgccgggaaccgctttacgatagcatcacgttgacttggtgtttgaacgatgaaaccatcgatcttggctggatcggcaaaagcgggtttcaaataaccatctacgggatccgtttgtggattgccgttattcacgacatgattaatcggaatgtaaatgaactttttagccgcctgctgcatattccttaatggcaaaacgccaacacccggtcggtcgctgataaagatggtttcacctggatctgcatctgccagttcatcaagaaaataggtaaacaagccgtccagatcatcaaattcccgattatcaagaattgtcttgcctttcaaaacaacccgagtgagctgcatttgatcggcctgattaccggcataataggtttcaatgaccggcttgccatccaaatcataatagcgctcaaatgtcagcagcccgtcacggccaaaatattgcgtagcagaccgaaagccgcgtgcatcccataaatcgcgttcgacttcattgccttgatcatccaaataattctggtaaaaaacgtgcccaaaggtttccggtatgtaccctacttgccgacgaagccgatcgccatcagtcacttgactctgattagcatcaactgatacctcgtcaagtgttggcagattcatttcatcgtttagcaccgttttttccggcatatcactaggaatgtgctgaaaataatcaaacatgttcaacacatccgtttgcgcgatcttcatttttcccaacgttcgcacgcttagccgatcaaaattccgggtcaaaatgacagccggttggttgaatcgcttgaacaatgccaagcgtttggccgccgcgtgttcaacactcgaattcttttgtaataaatactcatccaagaaaaaaatcatttttctcctccaccatcccaaatcaatattggcaaagcatcatctgctcaacaacctgcgatcatcacctgctgatctgtatttcgaagttgaacatggctatataacaacagctattctcatatagcgcaagcttaatataacatacccatcctgatgacaaaattatgaagactcgatattataaataaatttgtcatcaagtcgtttgaaaaaccgccacgtcgatctctagactacttttgtggcgtatctgtcgggaacttaatcccaaccatttggcgcaaatgatacaccacattgttgacatcttctgctaactgcaaccattcccgatactttttacgattttccgacgtatacgggtgttccagcacttcagtaaaagccaataactcgccagtaaagtgatacatataatcggctgacatcagcggcgtcaccttcttttgggcatcataatgctgaaccagatgcatttcggttaaatcatcaacctgaatcagttcatggtggccattaacttccgtgggcatatatgaatccgtggtaaacccaaagtgaagcgtcacataaaaatggtcatattgcaggaaagctactccggtaccgtcaacaccggtttcaacagcagtcgcaaagtatgttgccgaggttggccggccaaatagctttaaagccacatagatggcataaacgcctttttgctgcaacgcgccgccaaaggaagccaaggtaaagccttcaggttgcgctccttccaaaatggcgtcatattccggttgttcccgcattgaaaccaaagtagccccttgaatcatggtcattttgccaaccgcagcttcaatatttttaaagtttggcatgtgaatcggataagccccttcaaaaaataaagctcggggatgatcggtcaacaactgttccacctcggcaaactcagtgggatttgtcaaagctggcggctgcacaatgacatgcttatcagcctgaattgcctgcttaatatggctaaaatgatcgccattaggagaggcaatgaaaactgtgtcaaaattgccgtttttaaaaaaatcagcaatgtcaaaaaaggtctgattcgtgccatatttttgggcatactgatctgcttgatcaacatcactggcatacaaagcgccgagttcccatttgttcgtcacacttgccgcctgcacgaaatcgtcagttgcctggttcgtgccaataagaccgtaatgtatcatttgaattctcctccaaaaacacgtcgtataggcgtacagcataacctaaagataacgtttaataaagctattatattcggcattttataatgagtgtcaagtgttcgatatgcacctcctgatcatttgattcataaatgaggctgccgcaccaaccagataaattgttgagcctatcaactaaagctcatatgttaatagacaatgaaatatttattgatagtccaatatcaagatttcgatgcctaattttaccgtccttgtacagacttgtgctaccatttataccaacaacaacaggaggtatttaatcacatgaaagcatacagctctccctggttttggtggtactttgtccagggacttatattaacagccggttatttactagcggcccaaggcgcacagttctggttatgggcgcttgtcttaaccattatcgaaggtggcttgttactggtcagcgccatttcggcacccaagcattggatcagtcgcttattcaagctgctagccgttttgattcagcttattgtgtatccgcttattgttttctacagcggtcagcaattcttgcgtgttttgccaggcaatttaagtttgattctgataacggtgctgattttactggctcatgttccatttgcaaaagttctattcacgccggaccagcactatttgacgcgggttatcacaacactggtggttgcgtttatggtgatttacgcaggaaccacttttactgaaggtttgactaaatcggcgtttgcttcgcctctttggagctttgccgaagcaggcgttttggcggcaattgtttcagtgctagtcggcgctatcgccatgcgtcagtgggggctaccgctccctagctggcgtttcaacccgaatatgcaagccggggtcttgattgttctggttgtctttattatttactttacgctctggaatgcttttagcacgaatgattcgtttcaaagcctgttcatctggtcttggcattcaaatcccctaacctttaactggtttgctcaaggacttgaaccgggtattgctgaggaatgggagtaccgttatatggtcttaactttgctgctagtctggttaggccggcatcggttggcattatcgggcagcatcttcataagtggtctgttgttcggtgcttcccacctgatcaatgttttgggggaacaaaattggtttgatacactttcgcagattcagtttgccgttgtcttcggctggtttatcgccgccgtttatctttacgttggttcctttagcatcccgatgcttgtccacgcggcggtcgatattcttagcatggtcgtcagcaacactgaggcttcaatcaccggatcaataacggtctatttattccaaactattgtggaagtcgtcatgattgggttgactgtttggttattgactgggcgacgtcgccaaaccatgcaatggacactggatcggattatgccgaaacagagctcactagccatttgaacccaatgttaaacgccgacataccttccacaataaacgtgtgaaaagtatgccggcgtttttatgtcgtcatcatcaaaagccgctatggcaaactaatcatctaacgggcctttcccaaggtacgcgtttaacatccaaatgtttttgtccgtttcttctttgtacccgttgatcatgtcttgagttggaaagtcgcgctcttgatcggtgatttcaatggctttctgatactggtcagccaaatacttaaactgcttaacgagacgttgcattaactccaccagcgtgtactggccaaacgccaccttttcatcaggcaacccagtatgttcgataaactcatgggtggtcgcatacggtgagccgcctaaagcaatgagccgctctgcaattgcatccaacgcttcggctagttgatctttgtaatcatccatcaatgggtgaagacgaaagaagttatgcccgcgcatataccagtgaatctgttgcacatttgtttgaagctgcatcaaatccgcaatcaattggttaagctggtcaatggtttgcgggtacttaacatcagacatcaatcattcctccttgtgtttggcacatggtttgcaacaacaacttcattatggcacagaggaattgtgaggttctagcaaaaagctcggaacaacccacatcaactatcaatcagtcttttccagaacaataaaatcattttcggaaaaatttattcaatacatttgatcctaaccatcaactaaaaatcaatgcgaagtgctgctacagcaaaatgtttgacttgatttcgccactatggcatcaataaataaagatgtttattagcaatcttaaagctgaggagcggagtattttgaaaaaatggagttgggtgacaatcggaacccttgtaagtgtggcggtgcttggcatcggcgggtggtggctaattgaccactatcattatcagcaactggttgatcaacctgccgacgtcaaaaagtggcaggcggatccgcgtccactgcagtctgaaagtgaagcacaaaaacgaattaccgaaattcggcaaccgtcgtctggtgtgcacctggcaaagaagacgaagatggcggtgatcccggggttgcgaggcgcgtggtcaatcgacaacaaaacccggcaagcggcctttggaactaactgggtgccacaaggggttactcagtctaaaaaagcgctctatgtcagcatgtatgatggtgatcatcggttaaattccattattatcgaaattgatgccaaaaccggtcgttacaataagacacttattttgcgctccaaggcgcatgtcggcggcattacttacgatctcgacaagcagcgtttgctttggtcggatgataattcgaaagcaggcggtgccgggatcagttatgccgcgcaacgcgaaattgacgcctatcagccgcaagtcaaccaggcaccgctggcctcgacgcggattccattccacctggctaaccgcacctcggccatgaccctttacaaccatcaattggtcttggtgaaatacggtaaaaagaccaccggccgctcgctgattgccttgccattaaatgacgagaacctgccaaatgcgatcacgcaaaaacagtttgacaagatcgtcaccgacctcgccccgcagacgcaacataaaagcacgacccaaatgttagacattcttttcaaaaccctcatcaaaaagaaaatcatcaactcttacaatccggcgtgggatcggctgcaaggcgttgccattgccaaggatggcgtgacgttgtttagccagtcaaacggcagtgcgccaggcaaaatctggatccgcatggccgtgaataaagggtgggaaaagttagattttaaatccccaaaagctggcgataaaatgatcaatgtcccgaactcagttgaggaaatcagctttaaccctaatcaaaatgagttgctccttatcttcgaaagtggcgcaaaggcttatcgtgaagaaggctggttcttccatcggccgcattacatggatcggatcatgtacttgcctttaaccgtttagagcattttgcctgaacattagtgattggaaatcataaaacagccgtaacctactcgtcagttcaatgactgcgagaggttacggttgtttatttttaagtcggataattttagcggtagcatctgcgtcacggaaaacgatcggcgaacaaaaacacaacgatcctaagatcattgtgcctgatcaactatccaccgcctaacttgatgtctcacgtttaccgctcacgcaggatcaacctatacataacttgatcaccaccaacttggcttgattgtcttgaggtggcagtaatcggataatgccgcgcgtcaaatagttttcctatggatagcgttctaaagcggaccaatatgttaactcggtaagtcgtttggctttctttttgaaagcgtttacgataatattcaagctatacataacgctctatggacaaagccataaatgaagaacatgaatgtttcgttaaacgactcgccgcggaggctttggtttcggatggcgtgcagttgccgctaagggaaattattgcgattctccctttgccagccaattttctgtccgggaaaatgctggcactaactgcgactgccaactatctgttgccgaatacctctttaagctttgtccgttatcacgaagacgaatctatttattcgcaatcggtacatcaagttatcgtgacgaaattatatcatggtaacgcggaaaagttgccgaagatgcttgccggacccggctatgcatttataccgctatctgcgcctgatcatcgcagtgtcatttgggttgcttcccatcacctagttgaccatgccattcagcgtcgcggaggcaagcagatcattaccgtcaaattttgcgggaatatgaaaatgactttaccgacaacttatcatgccgcgcatttttcggaaattttggcaggtagtcggcttttgatggatgtgacggaacaactggcccggatcagtgcaggccacgcaccgttagctgacgatccgcagcatgaacacacagtgctggtggatcatcagactgccaagatattgatgcatcacgtcaatgggcggctttggcaacaaggcgctaagcaggctgtgggggaagataggtatatgttgcagtcggttaaggaaaaagggcgcaatccagacggcgtttagttttgcctgtgcctatctaatttgaatatagtctattacaaatttgcaaattttatttagttgaaaaagtggttaatgaataatgcgattgtttatcagccgcctttccgagttaagtcagctctagcttaaacatcggcaaataaggtactattgtcatagaagtatcaacgcagaactacaacaactttcaatgataaatggctggctaacaacgttgataacggtcacctgccggaatcaacgcacaagactgacggaggattgatgatgattaaactaatcgcaaccgacatggatggtactttcttgcggaatgacatgagctacgatcgcaactggttcgaccgactctatcaccagctgcaagcacaccacatttattgggtcatcgcaagcggcaaccagtactttcagttacggtctttctttgaagactatcccgaaaccatttttgtcgcggaaaatggggcctacattcgcgacgccaaccacatctatgccctgaatgcctttgctccctcgattatccatccgatcctaacccaccttgaacagattcctgatttaaaagtctccgtcagtggtcaagccggcgcctacacactggacaccatggatccaaatcatttggcgatcatgcgaaaatattatcctaagctgacgttactacatgactaccatgaactcgacgacaaaatccttaagttctccatcggctgtcccccagagcgtacagatgcgattgttgctgaattgcgcagtgcgctggctggcgttgcgactccgactagcagcggtcacggcgacattgatttgattcgtcctaacgtgaacaaagcgcaagggcttgcgctgcttgggcaaaagcttggaatcgacttgtccgaaatgtgtgccttcggtgacggcggtaatgacttggagatgctgcaggaagtcggcttaggtgtggccatggccaatgccgatccgcgcgtgaccgctgtcgctgatgccacgacgacaagtaacgaagaacagggtgttttgaagtttatggaaacactgataacaaccgatcaacggcatgccgtcaaaggtcgctgaacatcaacgcaacgcttgcgataaagctatcattaagtgaaagacaccgcgaaaagggcgctagttttcctaagtcgaaaactagcgcccttaatagttgatctgcctgattgggaccaagtctcagttttaacctttagtagccagatccttgttgatcacgatgctctgatacatccaagtggtgatcagatagtataaaccgtaaagtacgatgaatacgccgaacggcacgattaggttgtcataaggtgcctgcagaatcattttgaacaattgtaatccgaacaaaacgtggatcatgccgacgatgcctggcagaaggaaaagcacgccgatttcctgccgaatggaacgacgtagcacttggggacgtgcgccgattttctgcaacatcaggtagcggcgcttgtcgtagttagcgccggataaaatcttaaacatcaaggtcgaagccaacattgccaagaacgacagccctaagaagaagcccataaaggcaagtccggagtacatcccgttaagaatggagtatgactcgaatttttgatcagtatcactgccccacagtttaggatactgtttgttttgcaagtttataatcttttcaatggtgtcataattttggttgaagttcttaactctaaaggtcgtcaatgtttcggcattcccgagtttggcaaaggtcgcgtcatctgcaacccgcatttgttttccgcggttatcaccaataaagatcccaatagcgcctgagtattgcgtggcgattttgttaaagttgcggcttgtcaacgtcaccgagcgcaacttgccattcctactctggtcacggatctggaccttcaacggatgggcgtcaagtgcacgctggctaatataaaccgttttggcatctgacttgagtgtatactgctgcttctccgtgacgccttgcaactttttgatctcagcttgcgtttgggcatttggtgatacaaccgtcaaatcataagcagtgtactggctggccagcacgggaatatcatgggtaaaccctagtccaacagtgatcgcccctaatgccaaggctaccaaaatggacacgacggacaggatccgtgtatagtcgcgaatccgaaaactcaattgcgacaatgtaaaagtatgcagctgcttggaagcaaaagaatggttgcgcttcaacaaggcaattaaggccacaaagaccgcattgaataagaaatatgtccccatcacaatggtgactaaagcagtcgggatggcttttatcccgatatgagtcgcattacccatgcagtaatatccaaccgccagtaaaattaagcctaatacaatttgcaacgcgaaaaagatttttttctgtttaacccgattcggcgtttgcgcttgtcgtaatagccgcatcatcggcatttttagcaacttagccgtattgtaaatcgccgataaaatgaacaagacaacgaagaatccgaacgtccataaaatcgccggtacccagatagcggagaagccggttgcttgggcgtgcagggcattaatcaaccatttaccaataaagttggtgccgactaacccaatcaaaacgcccgcaaacgttgcgaaaatcccaatcgcaactgtttcaagaaaaatgagctgtccgatcttccgcccttttgctccgagcatcataaacatcgcataatcgcgttgccgcatactcagcaggaaactgttggcgtaaacaatatagacaaacgtaatgattgccagcagtactgccccaaagccaaaaataaacggcgtgtagctaatcggcgaattttgttttaagaagctggtgttcgttgccagcgccatgaacatataaaagacagcactggcaatcaccaggccagaaaataacaccgcatagtcgcggaagcggttctttaagccgccaagtgcaagtttgcttaacatagatgccgctccttatttttgaaatgtgccaagtgtttccaggatttcctgatagaacgcttcttggctcttatccccatgtaccaactcagatccgatttgaccgtctttaatgaaaagaatccgacttgcataactagcggaaaatggatcgtgcgtcacgagtaaaatcgaaaccccgtgattcttatttaaatcatccatcgtatccagcaactcgcgcgctgctttggagtccaaggcgccagtcggttcatccccaaacaaaatgtccggttgttgaaccaaggcccgtgccgcggccacccgctgtttttggccgccggataactcggtcggataatgatccaacaccgcggcaatacctagcgttgccgcgatttgatcaaccgctgcctgttgctttttggcactgacattctgtagcgccagcggtaaggcaatattttcccggcctgtcaggttctccaataaattgaagtcctggaaaatgaagccgattttcttggcccgaaaatccgaaagtgcattgccttttaacttggtcacatcttcgcctttaatgcgaacagcaccagaagttgggcgatcaagcgtactgagaatgttcaacaaagtcgtcttccctgagccagacgcccccatgatgccaacaaattcaccaggttcaacctggaaactaacgcctttcaatgctggcgtctgcttttcaccgcgtttgccataggttttggtcacattttcaaccgttacaactggttgtttgtccatgataatcctccatttgcgtgtttgcttttttgaataatgtcatcataccggctctagaccggcatttcctgataatgggctaacaaacaaccttttcaagctaacgtctttgtaagccactttaacttttctttacttctgattttgtccgtacctgtgttcattttgattgcttcgaaaaccggcttcgatgtggtgcaggtggttgtgtccaaatgagcatatcgcggcaaaagaaaaacaaggccttgattttttagaatcccatcaatcgaaaccttgtcactcacgaatacttgcgattaaccaaagtgcggtcgcttaatttaatttttctcttgccgcttttggcacatccttagaaggcacactttgccagcgggtcacgccacgatttttgttgtaagtcatctttagatacgcattcatcttcaaaggccggtcacgataaactttaaacttgagttgcttggcttgacccttttcatcataaccggtcagcttatagtcatactgcttgttgccttcactatcatttgattctttacctttttccgtaatcttcgtatagtagctcggaccgccgtagctgaaatgttgataagctttcatggcaccgaatcccagcaccatcaggacaaccaatcctattagcatttttttcaatgtcgtttcgccccttttttaatttccagccgccagctattcaaagagatgcttgtttccatagctgccaagctttcagatagtttatcaagtgggcgtttatgttggaaatagaattgtctaacaaatcacaaggcgtaactaacgggtttgtaagcaagttcacttttacgacttttcgacaggaaaaaaatccgtgcagatcaatagcgcggcgcaccagcgggcatatgctgaccacttgaatgctaattgaccgtcaacaaagcacagctaaccttcactcactcgtcgtgcaaaactatctggctggcacttgcttccaagctagccaagacgtcttgctgttcgatgaaagcaatccaagcctgccgcgaatcttgatcctcttctttaatgtagcgtttcaagttgcaataagcgctgcacacaaaccgctccaccatcgcctcaacagccttttcttctatcacgggatctcgctggtccgccgcgcatccctgcgcgtgcttcagccgctggtagacaaccgcgcgccgccgaaaatcacgcacagcatggcaatgggacatcacatattctttaaatgtatcatgattcaaacttccgccttctttggttaattgagagacctaacttgttatcattttaacatggtctttgttaattacgaatatgaagaggatggcggatttttgtttgtgattgtcacgctatagggaacgttttacggcagtgcatgaggcaaatgattcatgatctcattgtagtatctcacactgaaagacacctccataatgacattaaacacataaaagcgtgaactgatgaatgtcataacgaagataactctcataaatatctcgctaaattagataataaaagttgcacgtaaagagccacgaattgcagttcacactttttatgcatctgctaagacttttcaatctaaccatgatatactgcctatataaagcacaaaggagggttaccatcatgcttattgaattttccgtccagaatgctacttctatcaaagacgaaatgatcctttcagctgaaacaggtgaacgtctcagccgcctcaaggaaaccaataccatcagggaaaacaacagttcgctgctaaaaaatctcataattattggtccaaacggctctggcaagacaaatatcatcaatgcacttaaattgatgcgatccatggtcttaaacgaccctgataaaatcactacatcattgccgtataatccatttaggttaaatccgcttaatgccaaaacaccgaccaaatttcaagttaaattcaattatggaaatcaaacctttcaatattccttctcttacgtttccaaagcaatcgttgccgagaaactaacccaggttctcaaaacaactgaacggacgatttttgctagggagggtcaaaattatccggtgctggatgaggagcttaagaaagttgccgcaaataccaaaaagaactcactttttctttttaatgcacaaaaggcaaatatttccgcggcaattacagttctcgaatggtttcaaaaggatcttgttttcgtcaatagcaagaacattattcctgaccagctaaccgagttaatggatgacaaacgaatcaaaaatgaatttctacgctttcttcgctttgctgacttcaatattgttgatgttaaagtcagagatattcctttgagcctcccggaagagatcaaaaaaatcatggcgactttgcaaccagagattgaccttcctgatactcgaaaagaactctatgcttcccacaaacaatacgatgataacggcaacgttattggcactgaggaaatcccacttactcaagaatcacggggcacccaaaagatttttctgattgcactctctatcatcaatgcccatcttaacggcaatggtaagacaattcttttcgacgaatttgatgattccctacatttcgaattatcaaaagcgttaatcgaaatcttcaactctaagcaaaatagaaaccagttcattttgaccacccacgaactgcaactgctcaattcagaattgcgaacggatcaaatttatctggttgagaaagattttcaaggcagaagttcgctttactctgtttttgatttcaaggacagtaaaaacacagcccgccatgacgttcaatatatgaagcgctatattgaaggccgattcggctccctgccgcaaattgatgttgacgagatgctcagcgcattaaatgccagcaatccaccagcgaggaagtaatgatgccccgaaaatcacggaagataccttataaaaagatcatcgcaatttactgcgaaggcgagtcagaaaaagcttatttcaaaatgttaaaaagaaagtatcatgcagccaatgtacacgtccgctcacctaaattggtcatcacttccgttggcctgagtggcatgtcgctacttaaaaaagccttccaaaaagttcagcgactaaaaagcaatgagcaggcagaaaaagtctatgtcgtatttgatagagacagcttgggtccaagtgaaattgcggattgtcgcaggttcgccaagcaacacaagatgtctatcattttctcaaatgtcaatcttgaagtctggatcttgatgcattttcaatccgttcgtcgtccatacacaccgactgagttaaacagtatcttgtcaggccctgctttcttcaacaccaattacgaccgttttaagggaaaaccttacgatgaccttctttatgacaaggtaaaaacagccaaaatgaatgctgatgctctagaaaatggatattctgaaccgcttttcctaaatgatcctttcacaaatatgaaccatgcgattcaagaaatatttgacgtcaccgaattttaaaagccacgcactaaatggccgtttgtcatgcaacaaccgatatgaaaggcattaagccataacttctcccagccctatcacaattaagacaagcgaagtaggtaccaaaacaatgccacccactaacgaagcgcgacggtaaggatcgtttacgccaaggcgcttagcaactttccctgccaataagacaaacaggatgatgttggatggtgaatcttcaagtgtctcgcgagcatcgttttcacgaagcttcaagaagacagtgataaacacgcagccgttgaaagccaagaggagcccgagtaaaagtgtgaacatatcatcatcccttttttctaaattgggctacatatcaaaaatcaattttgttaagtttaagatattcccaccaccttggctggtcaagagccctctttactttttcaagttatataccgccgttttacacacactccgataacagctgtgtaaaatggcggcatatgtccgtggtcagaggaattattgaaggtttaagcttattttaaaataacactctgcaccttaaacattcaccgaggcttcctgaaatcactatgatatactggtcctataaaaaagcgaggactaatcatgaccattaaaaagggtgtttatctaatcaagacactttcaggctcagtttataaattggtcaacaccgacaatcaaaaatggcttgaaagggttccttctcaggaatccagttcattgcggcgggacaatgaacgaataattgtttatgaagttctgaatcttgccgttggaaaaccagcattatttgcgatagaacctctcgggttaggaaatgtaactttacgagaaactactacggttctcgaaatgatagtcgtagatcaagcggagtgctaaagcagacagggagctgtcagtccgcttggcagtcttaaacaaagtgtcaaaaatggctgatgtcagaatatgctcccttagcaattgagacctgctgaactgcatcaacaaacgaacctgtaaaaggttgagataatggtcaacaactgaatcgacactgtcactgcaaagcttgcaatgacagcgtcgattttttttaaacaaaaaaacaccttcccagatttcgggaaagtgtcgatgctccaaatattgatcgaatgattaacgcttggagaactgtgaagctttacgagccttcttcagaccatacttcttccgttccttcatacgagggtcacgggtcagcatgccggccttcttaagagggccgcggaagtcagggtcaacggtcaacagggcacgggcaatgccgtgacgagttgcgccagcttggccagagaagccgccgccattgacgttaacaagaacgtcgtagctgccagtggtttcggtgatgccaaatggctgagttaaatcggtgatcaggttttcatatggaaggtagtcgcgaacgtctttaccgttcatcgtgatcttgccggtgccgggaaccaaacggacccgggcaacggagttcttgcgacgacctgtacctgcgtattgtacttgtgccacagtaattgcctccttagattaagtttgaaatgtcgagtacttctggcttctgtgccaaatgcgggtgttcctccccagcatagacatgaagcttcaagaattgctgatggccaagtgtattcttggtcgggagcatcttcttaacagaatattcaaccagacgtgccgggttgtcccgcaagagatccccagcaatttcatgtttcaaaccacctggatgctgactgtgacgatagtaaatcttgtctgaggcttttttgccagtcaactttagcttggaagcattgataacgatcacattgtcaccggtatcaacgtttggggtgaattgcggcttgttcttaccacgcaagatcgaagcaacgacagatgacagacgacccaacgcgatatccgttgcgtcaatcacataccatttacgttcgatttcacctggcttagccaaaaatgttgtacgcacgatttgtttcctccataattctgtgcttgtttgaacacgttaagtttccggggcttatcgtggggcaaacaataccagctactagaataccaacgattcaggctcaagtcaatcttaaattacagcacaagcgagtgtatcggtgtgtttttaaatctaaccacaaaaattctgtcgttaaatcccacgattccgcaccaatgcctgccaggaagattgcgagccagtaacgatcgaagcctgtgccgttattccgtcatgaagccgggcgagttgcgattgactaacccgactctgaaccgttatctgcaaggctccttgctgcagctggtttgttgatggtatctgtgtgacttttccggtaagtataagtgtgtccccagcatttggttcgacttttacacgcacctgctgaccacatttaacgctagaaacgtccttttttgcaaccttcaaggtgaagctgattgaagattggtgattttgctcaggtaaaatccggccgattacctgtcttttagcaacgatttgctgatcagccaccgctgactggcgaaaatagatcaaccctgttactggtgctttaatggtttgcggttggccggcgtgccttaaatcattgtcttttgcctcaagctttccaagggtttgctggatgcgtttcgcgtccgctgcaagtgtttgctcagttatggtttgcaaagtcgttagcaacgtttctgcactggcctgaccagttcctgtcgtttgttgattttcttgctgctgtgcttgcaaggcagccagttgtttttgccgatcatttaatcgaccttgcagttgggcaagatcttgggtttgaatggccgccttccccgctgcatctgcggtggcgactgcctgctggtaatgttgataaaagccagcataaggattatcggcggcaacactcccctgacctcgaatggcggcttcagcaacttgaatctggccgatttcggtcgccgtctgagcgatcattgttgtcagtagctggtcaacttcctgccttttgttagtaagcgcttggttgtcactcgccgccgcatttccagataacgtctgcgtcaccatttgccgttggtttaaataagtctgtaccgcttgttgatagccatattgatcggcttcggaaaaaagattcttattttggtcaacgctttgaccgaacatttgcaattgcttttgctgttttttcaggtcggttatctgactggcaagatcgtcaattcgatcagtatcagcggttacgcgataaaccaaaataggctgatttttgcgaaccctttggccgaactgcatcatgacttgggtgatagtcgctgggccttgtacataaagcgcccggcctcgctgactggtagccatggtgccatttgcctgaatggttttttcttgcttggtaagggccataaaaagaacgaggagacaaataaacacgatcaatggtacggctatccaacgcttaaaatgcttgaaacgccgggtaaaatcagtagccgtcacgaattgattttctttttgactcatggcgactacctcctcagcatttgggcataatacccgtgcttggcaaacaaaatcggatagcttccctgctcaacgatgcggccattaaccaacacaacaattttatcggcattacgcgctagctgcggttgttgcgtcattaaaataatcgttcggtccttaattgcaaacaggcgatcaagaattcgctcagctgtagcattttcaatctgactaaaagtcccgtcaaaaataagcactttagctggcgatagtaacgcccgggcgattgccagccgctgtttttgactcgctgtcatcgtttcggtattggcatcaaccagtgtgtaaactaggtttggcaggtttgtaatgtcatcggcaatttcggccgtttcacaagcagcatccatgtcatcatcggtcacatcaaatcgattgccaagacgcaggttgtccaggatggagccggagaaaatcaccggccgttctggaacataggcaacatattggcgtagtagcgacaagcgaatgtcattaatattcgtttggttaaaagtgatcgtcccacttccggcatcaagcggccataagccatcgatcaaacgtgccaaagtcgttttaccagcaccacttgcgccaacgattgccatgttatgatttggcataatcgttaaattaatcttttgtaaaacagagcgcttttgccgatagccaaacgtaacttggcttaatttaatcgtcccggaaatttgttgcgaatcactgacgcgccgttgttgatcagccgcactgcttgacggaagatcacgcaaacggctgtcggcaacagcgattaattgccgttgcggctgcaaccgcaccacctgtgtcaagtggccgataaagtaaacgaacaaggcagcaaatgctaccagttgaccgaggctaagttgctgcgttacgaccatgctggcacctagccataaaagatcgactgttaaaatgaaatgaaacgcccgctgcaccgcccgttgaagttgcacaaactgcagctgagcaaactttttatgtaaatcatcggcaaacgcctgatcaacccgccgaaaaagatcaggttcggcacgtaatgcctgcattgcctcaacgccacgaaggccttcagtaatttcggtgctaaccgccacaccggactgactcgtagcgtaaccggctgctcgcaaacgatcacgaaaaagccacatcagtaaggcatccccaaatatagccagaacagctggcaacgccaacttccagttcataacaaccaataaaacaagtaatattgtcgcagcaagtgtttcaagccattgggtcgcaagtgttttggcagcaaccccaatgagtcgattcgtttcagccacttgcgcagtgagcgcttgtcgttgtcgattaaaaaaaggcaacggcattgcgtataaccgccgcacgtaggccaaggtcacatcaatcatgagccgctgatccaacattcccaacaaaagctcacggccccaggtcagcactgcttcaaaaagccctgctcccattagtgcaagcgccatgatggctaacggcctcattaatccattcggcagataagtatccacaatgatctggaggaaaaaagctcctgcaacactgatacctgttgtcgctagcaccgcaagtatcaaatacaccaaagccactttttgctgcaaaatcaacgctttaatcgtccgtaaatgtgatgaaggcattttaacagctgtatggttcaatctcggtttaataatagcgccagctgcagcccatgtttggttgaattgttgataggataaccacttaaccccaaccgtcacatcaggatctgctaccaacaaatgccgtttggtgattttaaagacaacagcaaagcgctgttggccggcctgcgcgtctcggctcgccacaataagcggagtttcgtttaaacgcttcggggtgaggctgataacacttttcgttgtgaaatgaagtgcctcggcagcatgaatcaggtcatctaatgtcgtcccggtctggtccacttcagccagtgcccgcaaacgcgtcggcgatatctctgccccataaaatttcaaaaccatgttcaaagctgcaacgccgctttctcgcgggtcagcttgtggcacatagtcacaccgattgacatgtctcacccaaaaattcccggtaaccctcatgtgcgcgctccccttgttgctatgcttgatcaacctttaattaatactaagcttatcacaaaaattaaaatgtttgttatttaaaagaggaatgaggccgttaatctcatgaacaaaagaggtacccacatcacttttgttcgtccgtttggctaacacctgtacaaaacatctgcaacgcccgatcaagtggcagttgttgctggaagccaccgttttctgcagtattagacggtcgcaaataaacggccaggatgtttaaaaagtataatgtgacttcccgaggctgatatacctccagtaattctgattgaaaatcggcaaaaaagcggtctaacggcgcgagcaaactgtcctgccaggctttaaaaacctgtccccgcgcgctagccttcaagctggcaatgtcgtgaatcaccatctgcaggttcatatcattgtcatcggtcaaaacatgccctaaatggttcactttagcagccagactgccactgccagtttgcgccgacgcaattttggccgccatgctgtcactcacctgcatcaccactgccaagtacagtttttctttggtgccaaagtagtgatagagcaacggttgctgcacgttgctggcctcagcaatcatccgcgttgtgacgctggcatagccgttagtcataaataatgtctgcgctgcggccaaaatgcgtgcaatggtcgccttcttttgctgttctcgttgattcatttttaccaagccctttttatttatcaattgataaacgagtgctataatgattttacaaaattcaagtggaggtgatcgaaatgtttcttgccattaaagaaattctgcataacaaggcgcgctatcttttagttgtcgtcacgttcgtcctcattgcctatcttgtcttcttcttgacgggtctggcaaccggactggcgcgcaacaaccgcactgcgattgacgccttgcccggtgattatgtactcatgtctaaatatgccaacaaaaacctgctgagttccagcctgaccaaacagcaggtcgataaagttgctaacaagcacaccgccgtgctcggccaagtttctgtggtcgccgagaataccagcacggacaagaaagtcaatagcaacgtttttgggattaacctcgccggtaagttaaagccgactgtcaccagtggtcgcatgccaagaaacaatcatgaggttctggccgacgatagtgtgaccaacgaaggcctgcacaaaggtgatcgcatcacactcaatggcagtgaccaaaagtaccgaattgtcgggttcacgcatgatcgccgcttctacactgtacctgtattttatacaactttgacaacttttcgccaattaaaatatggccaagccaacgcggccaatgtttcaatcgtcatcagtagtcgcccgtttaagacaattcccgccaaaacccagcaaattgatcgggcaaccttgattaacaacatccctggctataccgccgaaacatccacctttgcgttgatgattggcgccatgatcgggatcacgttactgattatcggtatttttatgtatattttgacgattcaaaaaatctcgatgtacggcgtcatgcgggcacaaggtattcgtacccgatccattatcgctgcgttgttctggcagattctgattcttgccgtcgtcggagttggcattggcgccggattgctaggactcacgcagttcattttgccaaaaacgatgccgttctatgctaaccccgcactcttctcgagtattgccgctgctttgattgtcatgtcattagtcggtggcctgttctcgctgcgacgcattattaaagttgacccattagctgccatcggaggaggggaataacatgaccaatctcgttgaattaacccaagtaacgaaaatatacggcagcggccgcactgcagtcacggccttgcaaccaaccgatttcgttttgaaagcaggtgaatttgccgcgattatcggtccttcaggctcgggaaaaaccacgctgctcaccattatcggtaatttgcagcgtcctagtggcggcaaggtcatcattaatcatcaagacaccacacatttcacggagcatcaacgcactgaactgcgtttcaacacattcggcttcatcttgcaagccagcaatctgatcccctttttaacggtcaaagatcagctggcgttagtcgatcggttcaatcaccataaacagcacaaaatgtcgaaaagcgagttattcgatatgctgggcatcaccgaccttgctgacaactacccagcggcactttccggcggcgagcggcagcgggtggccatcgctcgggcactgtacaatgacccaccgctcgtcttggccgatgagccgaccgccagcctagacaccaagcgtgcgctgcaagtcgtacaacagctcgccgatattgcgcacaataccgaccgtggcgtcatcatgatcactcatgacacccgattactcgatcccgtcgacaccgtttatgaaatgcgcgacggccacctcagagcccttcctaagtccagcttggaaaaaattcaggaaaccgcgatttagtcaaaattatttaatttttagcactcaattaaaaacagtgctaaaaatttgcatcattaaccggtaaaaggcttataatgaacctgtatcaaaattgagtctaaatcatggaggtaattcattatggcatcagtagatcctgaaaagacattgtttctcgatgaaccaatgaacaaggtatttgactggagcgacagcgaagcacccgttcgtgacgcgctgtgggattattacatggaaaagaacagccgcgacaccatcaagaccgaggaagaaatgaaaccagtcctcgacatgtccgacgatgaagtcaaagcactggcagaaaagctcctcaagaaataatcaaaaactgaacatcatgaaccgcgaaccgcagccccgggccgcggttcttttggtgtaagcgcgaactgatcatggcaaaacgcgaccaactgagcttattgctgcaaaccttggatcaaactttagaaaagggagtcgaaactatgactgacgatgagaaattcgcagcctttaaaaatcgggcaatcaatgacaatgaacaaacttttggcaaagaagtccgcgaacaatacggtgaggacattgtgaacgccagtaacgagaaattccgcaaaatgtcgcaagcacaagtggcacagctcactgcattgcaacaaaagattctagatgaattaaaaccccttgttggcacaaacgacttcaacacgccagaagccaaacaccttttcaaactgcacaaacaatttttgcagctcacctggccatccaaacaatactcgccaaaagcccatcgtagccttgccgccctgtacgtctcagatccacgtttcagcaagtactatgaagatggaaccggcaaaaatggtgctgctgaaacgctaaacgccattattcgccactatacacggtaaattgaaaaagttcagcaagcatgtcttctgaatgcggaaatagttcatcaaacgcaattgaaaaatcaagcttaacaaaaaagacggtgacactgtgtcaccgtcttttttaagcttaataataaacttccttcaagtacaatcccgaagcaggcgctgtccctcttgcctgctgccgatctctaacttcaaacaaccgttgaaagtcatggacttcgcgtcggccgttgccgatctcaagcgccgtggcaaccagtatccgtaccatgttgtacaagaacccattgccataaaactcaaaaatgagttcatttgtcgccgtatcttcgcgaaccgtcgcctcgtaaatcgtccgaaccttatctttaatcacaccgccactggcagcgaagctcgtaaagtcatgtgtgccgacgagatccttcagagcaacttcaattcgggcaacatccagcttatagggatagtggccagtataaagccgattaaacggattcgtataatagccgcgcgcaacccgatacatgtaacgcttgcctttagccgagtagcgcgcatgaaagtccgcggcgacaatttctgccttcaatatctcgatatctaaaggcatcaatgaattcatcgcccgcaacattgacttggcaggaatatttcccgggtaatcaaagctaatcacctgacctaaagcatgaacacctgagtcggtccgcccagaaccatccacatgcaccggctggcccttcgtcattttggtcaaggctttttgcaacacgccttgaaccgtccgttgttttggctgaacctgatagccggcaaagttggtgccatcgtaagctaatgtcactttataatgcgtcaaaaaccatgtttcctttctaatacgcccgcagcaaaagcaacagtccagtcaaaacagccatcccgccagcagcaatccaatcgcgctgatggtaacgtaagattcgatacttcgtgcgatcatcgccaccttgatagccacgtgcctccatcgccgtggccagttcatccgcagtggtaaaactggaaacaaacagcggaatcagcaatggtacgacagctttcatctgttggaaaatgttaccttcaccgaaatcaacgccgcgcgcacgctgggcattcataattttcgttgtctgatccattaatgttggtacgaaacgcaaggcaatctgcaaaaccagtgccagttcggtgacgggtacccgaatcacgcgtaatggtttgagcagactttcaaccgcatccgccaacgacaatggctgcgtggttaacgtcagcaatgtcgacataaaaatgatcaacacaaaccgaacaaaaataaaagcaccattaatcagcccaagctttgtgatccataaccagccccaatgccagtaaaccgtaccgccacgcacaaacaaaacctggagggcaacggtaaacagaatcagccaaatcaacggccgcacaccacgcaggaaaaagccaatccgaataccggataaccagatcatgaataaggtggcaacaaacatcattaaatatgtctgccagttgttggcgagaaaaacaatgccaatataatagaaactcgccatcagtttagtccgcggatccaactcatgaatccatgaatggcccggaatataccggccaagcagaagcttatccacgctggccacccccaatctgcggcaacagctgatcagccagctcggtctcagtcaacggctgcggatcaaaatggaacccctttgctgttaactgttgcgccatctgggcggttttaggtagtcccaactggttggctttcaaccattctggatcactgaagatttcccgcggcgtgcccgttttaatcaggcgtccctttgccatcacccagacggtgtcggcataatcagctacgtcatccatttgatgcgtcacaaggacgatggtttggccttgttcccgatgcaaccgttcaaacatcgtcatcatctcgtggcgaccggctggatccaatccagccgtgggttcatccagaaccaagacttcaggctgcatggccaatactccggcaatggcaacccgccgcatttgccccccggataagtcgaaaggcgacttttctagcacatcatgtggtaatccaaccatggcgagcattttgtcagccaatgccaaagcatcctgttcactcacaccgaaattctgcggaccaaacgcaatgtctttggcaacggtttgttcaaacaactggttttcggcaaactgaaacaccatgccgactttttgccgcaatggttttaaatttttattattcgtttcgttggtgatcaccttgtcaccaatcgtcaccgtaccggatgttggctttaacaacgcatttaagtgctggagaatcgttgacttcccagaacctgtatggccaatgatcgcggtataactgccatcatgaatcgtgccggaaacatctttaatgccgtcaccggcgaaaggtgtacctgcctgataggtaaagctcacatggtcgaatgtaatgtccacaggtagtctaccaacctttcattatccaaatatgctttcggcattgccaccccgcgctgaatcaaggcatctttcagcttttccgaatacggaacgtccaatcccaagcgcaacaagtccgtaccatgggcaaagatgtcgcttggcgttccaatttcgttgattttaccatcattaagcaaaataatccgatgagcaaccgcggcttcgtcaatatcatgtgtaatcgacaagacagtcaggttaagttcgtcttttaactcacgaatgacccctaacacttcctggcgaccagccggatccagcattgacgttgattcatccaaaatgataatctccggccgctgggcaataatcccggcgattgcgacccgctgcttttgaccacccgacaaccgcgccggctcgcggtcggcaaacgccgtcataccaacccgtttcagtgactcatcaacccgtttgaccatttcatcacgaggaacaccccgattttccaaaccaaacgcgacatcatcagccactgttgcaccgacaaactgattatcgggattttggaaaacaatgccgactttggcgcgaatatcccagaccgtttcttcactgagcgtcattccggcaacttcgaccgtacccgactcaggcgccagcaacccattcagattcttcgccagcgtacttttgccgctgccattatgcccgataatggcgagccattcacccttagccacatcaaaagaaacatccgtcagtgcttgatgttttgcctcgggataagtgtaattcaagtgttgaacacgaatgacgttgcccacgacgacccttcttcctacgctttgtataccgaacaataataccatattttactgagttgttgggaataagcacttgcaaatagtaccttcgcagatagaccttcgcaatgaaaagcatggcagaaagtagtcggttaaaattccttcttaactatctcaggatctgtactcataaaggcaaaaaaagcaacgaagatcaatccaagtatcgtcaaaatccaagcttcccatttcactggatccccatgcatcaacgtcatgccgacgtgacttttgccattcacaatccataaatacggacgctgcatttgcatcaaaaagataaagaagaccgcccaaatccaccggcttccttttcgaaataatcctatgtaggcagacatgattcctgctggaaaaatgcataaaaagctcagcatcacgactaagaaaaagcccgccgttgactttggaaatgtttgagttgccagcggatgccactgggttagagcaatcaaaataagccacatggaaaaaagtggtatcaaagttttaatcaaacgtggcgactgttggcgtttgcgatactgtctgccagtcaagtagccgcaaacaatcgcaaaaatccacacttcggccaaccacgtcacggtcacatcgccattggcagcgcggtaaacacttggaacaaatggtccgccggtaatgccagccgtgggagtcacactgattagcaaagtaacaaaggttaaagacagtatcagccaacagccgaccactagtaacccgatctgccatggtgttcgttcttttagccaattgtgcatgcctttcacctccgatattgtgcagtatacaggaaaaatgatggctgtgctggatcggtagtgacttttttattgaccgcctgcatcttgaatatggacaggtcgcagacgaccgggctataagaaaagtggcggtaaaaaggaatcgcttcaggtctgggcgattgctttttactgccacttgggtgtggttgtttggtcaataggaagttctattgacggcaggtgtggattacttctataacgccttcactggtgcaatagcctgcatgtaagaaccttggtcgcaatggtcaaatagccgcgcccacagtactgaaagtctattctatcgaaggcaaagtatgggtttgatttccgttttctataacgcgctcgcagtcgcagaaatctacgtgtaagtggcctcaagcctaaatggccaaaacctattctttgagacttgtgctactgaaggcttggtgaaggtttagcttccgctttctataacgcgctcgccagcgcagaagcctggcatgtaaggaccccagaccacaatggccaaaacccagccattgtggtctggggccacttacactccggcttctgaccgcgctggctcacgctcacacaaaaaaatcatttaatgatggagacaccggttgcccggtgctctcaagctagactaagcaggactgggcctgccaccatcgtaacgctccatcgatcaaatgatcaaagttggttgaccttcaagggccagccggtttttaactgtgtttagacgagctcaatgataaccattggggcaccgtcaccgcgacgtggcgcagtcttcaagatgcgggtgtaaccgccattgcgatctgcgtattttggtgccaagtcactgaacaacttttgcaaagcggacttcacaataacgctgtcttcttgttcctcgacacttgcaatttcgttgcggacataagctgctgcttggcggcgtgcatgtaaatcgccacgcttgcccaaagtgatcattttttcagcagtcgaacgaacttccttagcgcgggcttcggttgtgacgatccgttcattgatcagcagatcagttgtcagatcacgcaacattgctttacgctgtgagctggtccgccctaatttacggtaactcatggattggcctccttttcgaaattttagtcttctttacgcaaacctaagccgagatcagccaacttgtttttaacttcttcaagtgacttgcggcctaagttgcgcactttcatcatatcggcttctgttttgttggttaactcctggaccgtgttgatcccggcacgcttcaaacagttgtaagaacgaaccgacaagtcaagctcttcgatggtcatctcgagcatcttttccttgtgtgtttcttctttttcaaccataatttcggcgtttttagcctcatccgtcagattgacgaaaatatccaggtgttcggtcaggatcttcgctgctaagctgatggcttcacgtggtgagattgagccattagtccaaacatccagcgttaacttgtcgaaatcattccgacggccaacacgggtgctttcaacttgatagttaacccggctgatcggggtgaaaatcgagtcgatcggcaaaacaccgattggcatgtcatcagacttgttctggtcagctgccacatacccgcgaccctttttaacagtcatacgtacatggaagtgcccgccgtctgcaacagtacagatatactgttcaggatttaagacctcaacatcaggatcagtgacgatatcagcagcagttaccttagccggaccgttgacatcaatttcgatgttcttatcttcatcggtattcatcttgagtgccaattttttgatattcaaaatgatttgggtgacatcttccaacacaccatcaattgtcgagaactcatgaagtaccccgtcaatctggatgctgctgacagctgcgcccggtaatgaagaaagaaggatccgccgcaacgagttacctaacgtagtaccgtagccgcgttccaacggttcaaccacaaacttgccatagttggtgctttcatcaactttggtaatgttcggcttttcgaattcgatcatctagtttgtacccctttcaaaacgagaagtgaagatttgtctgcctgaccgccataacggtcgaagggtaacaattaaacacgacgacgctttggaggacgagaaccgttatgcggaaccggtgtaacatcacggatcgcagtaacttcaagacctgttgcctgaagcgaacggattgcagcttcacgaccagagccagggcccttaaccgcaacttcaaccgacttcatgccatgttccattgattccttcgcagccgcttcagctgccatctgcgcagcaaacggcgttgacttacgactacctttaaaaccgagtgcaccagcagaggaccaagcgatcgcattgccgcgagggtccgtgatcattactaaggtgttgttgaaggttgagtggatatgagccacgccagattcaacgttcttgcggacacggcgcttccgcgtagtttttctacctgccatcgatcaatgacctcctttaattattttttcttacctgccatgcttgctttcttccctttacgggtgcgagcattgtttttggtgttttgcccacgaaccggcaagccacgacgatgacggatgccgcgatatgaaccgatttccatcaaacgtttgatgttcaggttcacttcacgacggagatcgccttcaactttgtatgaatccaaagctgcacgaatcttgtcttcttgttctggggtcaggtcatcttgacgaacgtcttccggaacaccggcagtcttgagaaccttttgagcggttgtcttgccaacaccataaatataggttaaggcaatgacgatttgcttaccacgtggtaagtcgacacctgcgatacgagccatgtacaatgacacctcctattgttttagtttgtattatccctgacgctgtttatgctttgggtttgcagagcagataatcatgacccgacccttacgacggaccactttgcagtgctcgcacatctttttaacagatggacgtactttcatgagaatttagcctccttgagttggcaactacttgaaacggtaggtgatccggcccttggtcaaatcgtatggtgacaattcaaccgttaccttgtcccctgggagaattcgaatatagtgcatccgaatcttaccggaaacatgagcgagaatttccgcaccgttttcaagtttgactttgaacatcgcgttgggtaaggtatccgtcacggtgccttggatctcaattacatcgtcttttgccacgaagtgtttcctcctaaaaattattggttctattaacgcgcgaaaagggtgaggccgattggcactcaccgcataccgcgatattgtaccataattcttcgactttgaaaacagtcatgaggggcgtgcaatcgtccaagcacttattttgccacagtcgccaaaatcgctttgatatcggcaaacaccttatcgatgtcctggtcgccattaaccgtgtgcagcaggcccttcttcttatagaagtccaatagcggcgtgttcatctcgatgtttactttaagtcgattcttaaccgttgccggcttgtcatcttcacgttggaaaaattcgtgaccgccgcaacgatcacaagtgccggcaacctttggcgggttgtagattttgtgataagttgctccgcatgtcttgcagataaaccggccagacaaacggtcaaccaattttgcaggcgcaacatcaatgttgataacagcatctaacggcttcttgagatcagctgtgatcgtttcgagtgcctctgcttgttgaatggtgcgcggaaagccgtcaagcatgtaaccggcgtcggtatcagattcagcaagacgttctttgacaatgccgttggtcacggaatccggtaccaactgtcccttatcaataaacccctttgcttctttacccaatgccgtgccagcagccattgcagctcgaaacatatccccagtagaaatatgtgcaatcggataagtatcctcaatccgttctgcctgcgtgcctttccctgcaccgggaagtcccattaaaatgagattcacgttgcatcctcctctaaatatacatgccagcgtaacagcaaagtttgaattcagacaaaatatctgaatctttttgctgccaagtgcaccggcacgtacactgcttttgtcacgttagccgattcgaaaatcgaaccggttaacgtacgattttgtttacttcttctgatcatccttaaccaaatcaccacggataaagccaacatactcacgtttcatgagcaagccgtctaactgccgaactaattcaatcgcagtcatgacaacaatcagcaggctggtaccaccaagcccgattgattgtggcagaccccaaatgttagcggccagttgcggtagtaaggcaaccaaaccaaggaataatgccccgactgttgacaagcgcataagcagtcgcgagatataattctcagtttccttacccggccaaacaccgggaatgtagctgccttgtttggttaggttttctgcgaccttttcgggattgacctgaacgaacgcatagaagaatgtgaacaggataatcaaaatcgtatagatcgcagttccggcaggcttttgcatattgaagatgttggtcatgacctgataccaaccatcactaccatgactcttctgaaaagccattaaaattgtctgcggcgttacaatgaaagaactcgcaaaaataaccggaataacaccagcaacgttcaccttaagtggcaggtaactattgctacctgcactggtaacgcggcgggtatactgaattggaatcttgtagtttgcttgttgtacccaagtaacgaaagtgatcacgataatcacaatcactgccaaggcggccaagaacgcaattcctttccagatctcggcgccggagtatacctgaacattgtcccgatataactcctgaagacctgaaggcaggcgtgcaacgatccctgagaagatcagcagcgaaacaccattaccaagccccttatcggtgatttgttcacccatccaggtcagcaacatagtaccgccggtgaggatgatcccgatcgtaatgtaggtactaacagacggattcttgaccaagcccatcgaacttaacgtttgaaagccggctgtaatcccaattgcctgaaagaacccaaaaatgatggttagataacgggtgacctgattcagcttgcgccgaccgacttccccttgcttgctccactcaacaaatttcggaacgatatccatttgcagcagctgaaccacaatttgcgccgtaatatacggcgaaacccccatcgaaaagatggagtattgcgcaagtccgccaccgctgacggtatccagcagtgagatcaagcctgtcgagccaattgactgcagcgccttggcgttaacgcctggcaccgcgatcagtgtacctaatcgatagaccaataaaaccgctaaagtgaagaggatcttgttacggatgtctttaaccttgagcgcgttttttagggtcctcagcattagatcacctcaatcgaaccgccagctgcttcaacagcagcttttgctgcggttgaagcttttgcaaccttaatggtcaattttttctcaagtttgccgtctgccagcaacttgacaccgttcttttcgttcttaacaataccagcgtcgatcaaggctgctggcgttacttcggcaccatcgtcgaaacggttaagatcggaaaggttaacgattgcgtattctttgcggttaatgttgttgaaaccgcgtttaggcatccgccggaacaatggcatctggccaccttcgaagccaagacgcgtcttgccgccctgacgtgccaattgaccctttgtccctttaccggctgtcttaccttgaccgctagaagtaccgcggcccagacgtttgcgggcatgacgggagccgacgctcggctttaattcgtgcaattgcatactcttgggcacctccttgtcgaaataatgtattaatccttgatttcttcaacagaaaccaagtgtgaaatttggaaaatcgcaccgcgagtggctgcgttgtctggcttaatcaccgagctatttacccggtttaaacctaattccttcacaatcttacgttgcttaggaagacggtgggcagcactacgggtcaaagtaatcttcaattgagccatgtgtttacctcctagtcttcaagcgatgacgcagaaacgccgcgcaattcagcaacttgttcccgagtccgcaattgtgaaaggccgtccattgttgcgcgaatcatgttgattggcgtgttccggccaagggacttactggtgatatcggcaatgccggcaagttccatgacggaacggatagcgccaccagcagcaaccccggaaccttcttcagcaggcttcaacagcacttcaccagcgccgaagtgaccgataacttcgtgaggaatggttgttcccacgatcggtacttcgatgaggctcttcttagctgcgtcaacagctttacggattgcttcaggtacttcttgggctttaccggttgcaaagccgacgtgaccgttcttgtcaccgacaattgcaattgcagcaaaacgcaggcgccgaccacctttaacaacctttgtaacacggttgatggcaacaacctggtcttctaagtccaattggtttggatcgataaatgatgccatgtgttggttatcctcctttttactagaattcgaggccattttcacgtgctgcttcagctaacgcagcaacgcgaccatggtacagataaccaccacggtcaaagaccacaactttatgaccatcagcaacagcgcgcttggcaatcaatgcgccaacctgtgcagcagcgtcggtcttgttttcaggatctttaatgtccttatcaagagtggaggcacttgctagcgtcacacccgctacgtcatcaattaattgcgcgtagatgtttttattggaacggaaaacgttcaagcgtgggcgctcgctcgtaccagaaatcttgcctcgtacgcgggcgtgacgccgttgccgagtcttgttcttatctggctttgaaatcacaatgttcacctcttgttaaatttgttgaaggttacgactacttaccagtcttaccttccttacgacggacatgttcgtcaacgtaacgaatccctttacccttataaggttcaggtgcacggacggaacgaacaacggctgcgaattggccaacaacctgttttgagatcccactgatgatgatctgggtggtgcttggaacttcaacagtaatcccttttggtgcggtcatttcaactgggtgtgagtaaccgacgttcaaaacaagcttctcgccttgcttttgggcacgataaccaacaccgaccagtttcatttctttcttgtagccttcggtaacaccgacgaccatattgtttaagttggcacgcatggtaccgtggatagccttatacgaatcatcaggacgggtgaaactgatttcgtcgccttcttgatgcatttcgatttccgggacaaaatgacgcgtcaattcgcctttaggacccttaaccgtgatgttgtcgccatctttggtgacagtaacaccggctgggactttaatgactttataaccaatacgactcacttatcggcacctcctttttgatgtaatgaattaccaaacgtaagcgagtacttcgccgccgacgttcttggcgcgagcttccttatcggtgataacaccttcggaagttgagataattgcaatccctaagccattcaaaaccttaggaaccgcatcactcttaacgtatgagcgcagacccggtttggaaatccgcttcaagccagagataacccgttcattgttcttaccatacttcaagaaaatgcggatcatgccttgcttgtcatcatcaataacttcgtagtcacggatgaacccttcacgtttaagaatctcagaaatgtctttcttcatctttgatgcaggtacgaccaaggactcgtgacgcaccatattagcgttacggatccgggtcaagtaatctgcgattggatcggtcaagaccattgatttaacctcctttgtctagtgattaccagctagctttgcgcatgcctggaatttggccggcatgtgctaactcacgaaggcaaatccggcagagtttgaatttacgatatacggaatgcggacggccacaccgttggcaccgcgtatattcttggactgcaaattttgcaggccgattgtttttagcgatcattgacttcttagccaagtagcggacctcccttatttggcgaatggcatcccgacttgcgtaagcaattcgagtgcttcttcatcagtatttgccgttgtgacaataacaacatccaatccacgaacccgattaaccttatcgtaatcgatttctgggaaaatcagttgttccttaacacccaacgtataattcccgcggccgtcgaaggacttaggggaaataccatggaagtcacgcacacgcggcagggagacattgatcagcttatctaagaaatcatacatgcgttcgccgcgcagggtcacctttgcgccgattggcatgccttcacgcagacggaagcccgcgatactcttcttggccttggtgatcagcggatgctggccagagatcagtgtcaattcatcaacagcttcatccagcaacttagcattctgggttgcatcaccaacacccatgttcaacacgatcttttcgatcttaggtgcctgcatggtgctcttatagttgaacttgcttaccaatgcaggggcgatttctttgctataacgttcttcaagacgattctccatgaaaaagtttgtcctccttccctattatttatcgattgcggtgccagacttcttagcaatccgcactttgttgccatctttaacttcagaaccgacccgggtcggcttgttggtttcaggatccagaagcatcacgttggaaacgtgaataggtgcttctttatcgatgataccgccttgcggattggcgttgttcggcttttggtgctttttgatcatgttgatgccttcaacgacaactttatcagcgtctttcaggacctttgtgatctggccttctttgccggcatctttgccgcgcataacccgcactttgtcaccagttttaaacttcatgtatcgcacctcctatttggtcagaatgattaaagcacttcgggcgctaaggagacgatcttcatgaaatcgccgtcacgcaattcacgtgccacaggtccaaagatacgagtcccacgtgggctcttgtcagcgttgatgatgacagctgcgttctcatcgaacttgatgtaggaaccgtcggcacggtgagcaccggacttggtacgaacaatgacagccttaacaacatcagccttcttgacaacgccacctggtgttgcttgttttacagttgcgacaacgatatcaccgatgttgccggtcttgcggtatgagccgccaagtaccttgataacaaggatttcgcgcgcgcctgagttatctgctactttaagacgactttcttgctgaatcacggatttggtcctcctttcattctaaaaatgattagatgataactgccttttcgacaatgttcaataaacggaaacgcttattgcgtgataaaggacgagtctccgcgatttgcacaatatcgccaactttagcgctattgtcttcgtcatgcgcataaaacttcttggaatacttaacacgcttgccataaacagggtgtgttttgtatgtgctgacttccacggtgatggtcttgtccattttatccgagaccacgcggccttgataaactttacgagaattacgttctgccaaggtaaatgtctcctttccgattatttattgagttcctgttgtcgaaggaccgttttgatccgtgcaatgtttttgcgaacctgcttcaagcgagcggtgttttccaattggccagtcgcctgttggaagcgcaagttgaacagctcttctttatattgcttctctttgtcgagcatctcagcagtggttaatgcagtaatttctttagccttcatttgattgcccacctacttcctcgcgtgaaacgatcttggtgcggattgggagtttgttggatgctaagcgcaaagcttcctttgcgactgcttcggatacgccgccgacttcaaacatgatcttctcacgtttaacgactgcaacccatccagtaggtgcacctttaccattacccatccggacgccgacacctttactggtgtaggacttgtgagggaaaatgcggatccatactttcccaccacgcttcatataacgggtcatcgcaacacgcgctgcttcgatctggcggttggtgatccaatgggattccaatgcttccaaaccatattcgccgaagtcaacgttcttgccgcccttggctgcaccgcgcatcttcccacggaattcacgacgatgcttgacacgcttaggtactaacattgattatttccctcctttcgcactattttgctgtggcttttcaggtaaaatttcaccacgattgatccaggttttgatcccgatccggccataagtggtagctgcttcttcccatgcatagtcgatatcggcacgcaaggtgtgcagcggtactaagccttcgttgtaatgttcgcgacgagcaatatcggcaccattcaaacgaccggaagcctgggttttgatccccttggcacctgcccgcatggtccgttgcattgcttgacgcattgcacgacggaatgcaatccgctgttcaagctgacgagcgatgttctcgccgacaagcttggcatccagatcaggtttcttgatttcaataatattgatgtgaacttgacgaccggtcagcttgttaagctgcttgcgcaagttttcaacttcagaaccgcctttgccgataaccatacccggcttagcagtatgaatggaaatgttgacgcgctttgcggcacgttcgatttcgatacgtgatacggaagcttctgacagcttcttattgatgaagtttcggatttcaatgtcttcatgcaagtagtcagcaaagtctttgtctgcataccacttggcatcccagtcacggatgacaccgacacggaaaccggttggattaatcttttgacccacgcgttatccctccttatgcttctttttcggatacgaccacggtgacgtggcttgtccgtttattgatcggtgatgcgctccccttggcacgaggacggaaccgcttgagggtcgggccttcgttgacataagctttgcttacataaaggttttgtgcatctaagtcatagttatgttctgcatttgcaatagcagatttgagcactttctcgatgatcggtgaaccagatcgaggggtaaactcaagaattgccagagcttcagcaacatcgcgaccacgaatcaagtcgattaccaagcgcgctttgcgagcagcaatccgaactgtcttggccgttgccgttgcagacgtaatttgatcagccatgaatgttgtgctcctttctagcgtgctgttgtcttcttgtcatcggtgttgtgaccgcggaaggtacgcgtaggaacaaactcgcccaacttgtgaccaaccatgtcttcactcacgaaaaccgggacatgtttgcgaccatcgtaaacggcgatggtgtaaccaatgaaacttggaaaaattgtggaacgacgggaccatgtacgaataacggtcttcttgtcgttatctgcctgcgcttcaatcttcttcaggagatgagcgtcggcaaaaggtccttttttaagactgcgacccattgtgtgacctcctttaatcgatgtaacacattaatgtgtttacttcgtcttgcggtgacgaacgatgaacttctcggacttagccttgtgatcccgggtctttttacccaaggtcttcttgccccatggtgataatggtgacggacggccgattggcgctttcccttcaccaccaccatgcgggtgatcgttagggttcataacagaaccacgaaccgtcggacggaagcctaaccagcgcttacggccagctttaccaatgctgatcaattcgtgttgttcattaccgacagcaccgattgtggcacggttttcacccagaaccaagcgaacttcgccggaagccagcttgatggtgacgtacttgtcgttgtctttacccagtaactgagctgaaacaccggctgaacgtgctaactgagcacctttacctggctttaattcgatgttatgaatcgtggtacctgctgggatattcttcaactgcagcgtattgccaactttgatatcgacattttcgccagagtaaactttatcgccaaccttgagaccttttggtgccaagatgtaggacttaaccccgtcttcataatgcagtaaagcaatgtttgcggtccggtttggatcgtattcaatggctttaaccgttgcggccatgccatctttattccgcttgaagtcaatcacacggtagaattgcttgtggccgccgccacgatgacgaaccgtgatgtggccgtgggcattgcgtcctgccgtatggctttggctgaccagcaaagtcttttcaggctttgtcttggtgatttcagcaaagtcggaaccggacatgttgcgccggccgttgcttgttggtttgtattttctaatcgccacgtgttttacctcctataacgaatttttgttacttgttatcgttatcttcatcagcgaagatcttgatttctttggaatcggcgctcaaggcaactaaggccttgcgacgacgacgcgtcatgccttcgtaacggccctgacgcttcttcttaccgcgaacgttggcaatgttgacattaaccactttcacgccgaagatttcttcaacagccttgcgaacctgctgcttcgtcgcatgcagtgcaacttcgaatgtgtatttacggttatccatttcagccatcgattgctcggtgacgatcggacgtaaaatgatatcgcgtgcttccattatgcaagcacctcctcaatcttttggagcgcagattgggttaagatcaatttcttgtaatcaacagcgtccaagacattgataccctctgcaggaacaactttcacattcggcaggttgcgtgcggctttggcagcaacttcattgccgtcttcgagcacaaccaatgccttttcattaaccttgaggccatctaaaacattttggaatgccttagtctttggtgcttcaaagttcaagccatcaacaacgacaaggtcgctatcaagaagcttttgtgaaagtacggatttgatcgccaaacgacgaaccttcttaggcagcttgtaagcatagctgcgtggtgtcggtccaaaaacgatcccaccgccacgccattgcgggctgcggattgaaccttggcgggcacgaccggtacccttttggcgccaaggcttgcgaccgccaccggaaacagcggaacggttcttaacggcgtgagtaccttgacgaagggaagctcgttgcatcacgactgcgtcaaacacgacgttttcatttggttcgactgcccagatggcatcgttgagttcaactgtgccgttttctgagccatcttgcttatataaagtaacgttagccattagttattgtcctcccttcgtattatttagctgctttaacagcagaacggattgtaacaaaggacttgtttgcccctggaacgttgcccttgatcaacagaacattgtgatctgtgtcagcagcaacgacttgcaggttttgcatggtgcgggtacgattacccatccggccaggcaatttcttacccttgaagaccttgttgatgatggccccaagagaacctggacgacgatggtaacgagaaccgtgagccataggaccgcgggactgaccatctttcttgatgttaccttgataaccgtgacctttggaagtaccggtgacatccacaatgtcgcctgctgcgaattcgtcagctttaacttcgctgccgacttcataatcactaagcgctacatcgcggatttcgcgaacgaagcgcttaggggtcgtgtcagcctttttggcgtgaccgacgcttggcttattcgtcaagacttcacgcatatcgccgtagcccagttgaactgcttcataaccgtcagattcaacggtcttgacttgcattacaacgttgggcgttacgtcgatgacggtaacgggaacaagttcgccgttttcggtgaagacctgcgtcatgccaacttttttgcctaagattcctttacgtgccatgggtacacctcctattttctatagattataatttgatttcgatatcgacgccgcttggcaagtcgagcttcatcaaagcatcgactgtcttcggtgttgggttcacaatatcgatcagacgtttatgtgtccgcatttcgaattgttcacgtgaatccttgtacttatgcggggaacgcagcaccgtatagattgtgcgttctgttggcagcgggatcgggcctgaaattgttgcgccagtgcgctttgcagtgtccacgatcttgtctgcggattgatcgagaatccggtgttcataagccttgagccggatccgaatcttttgttttgccattgtgtgacctccttcgtctattatcagttagtagactagctccgtgaaaattaccaactcgccaccgtggcaaagcggccgggcgtgtcgcaacctctcacatccacgctactctggttcacctttggaaccaagtgcacagttatccccttcgagaaacagcactcttgatagtatacaaaaacattcgtgccattacaagcatttcttgaggtttgcagaaaaaacatgcgcgctgcaatccgtttcttccataatacacgtcaatcatttcatcggtaagctcttttggctccgccagcgcgtaacacattgatctaagcaaacttgttttctcaagaagccgtctgtgctacattcaactaaagtacgttcattttcgcaacggattggagaccacttatgaaatttgaccactataaaaaaattgtcaacgcagccttagacgttctgctcggcttgcttgccattgttgtcgttgtcttcatgctccgttacatcatcgatatcggcagcatgatcctccggccactctcagccgacctatttggcaaggtcattcaggaagtcaccagcttcttcatgctgtttgagttcgtgatcatgctcattcgttacattgaagaaggccaccacatccctattcgttaccttattctgatttcgatgacggccatcctgcgccagctgctggttcttcatgatcgcggcacggaaactttactgctgacgcttgccattctcgtgttagcgggagttctaaccgtcttctcgtacgtcagcggcgatttcaagcactcgcgcgatgaaaaagatgtggatattgaccagcatttttagagattattgcctaggagaaagttgttgtgaacagcaaatacattatcaaaaaccacacgaatacgtttctcattcgtggtcatgaatatgaagtcaccgcaccggctaagtttaatcggtcaacaggtgagcttattgatgataagacgttggacgatgtggcgctggaaatcgcaaatgaaaagtaccgtcaagcgatgggcatcgtttcacctgcagacataaagcgttatcgtacgcgggtcaacttgtctcagcaagagcttgcaagtttaatgggacgacatccagcgactatcgaattatatgaagcgggtgcatttccggcagaggcagacaatcggctattaagggcactcatcaatgatgatgctaccattgttcgtaaataatcctaataaattcaaagctgatctgagagaaaaatctcagacaattcgggagacaatttggctcaatgcaccactccaaaaagcacgatggacacatcaactacttgcagctgatggtctctcgtgttttcttttattgttcacttttttggcagtacaacaccgccatgatcccccctgacattagcgaagctcagaaccacaatgatgttcgtactccaagcccattagactaaaagcagccaaaccatcggcgcaagatgctgtaaaacttgatgcgttagaagataccaagcttgcggaacttagtgcactcaaagcaattgaactgacaaatgcccgccgtgtcggttttaatcaattaattccgcttaaccttttaatggattgacaaaggtttgatcgaagtcaccatcgccagacatcttaatcacattatcttcacttacataaacgctttgccgaacagtaatgctgccagaaaaaccatactcccaacattttcaaagatgcgcagctatccgaaccgagtgtcttagtggacattatttggtttcagaatttcaaaggcctattaaagacgttggcatgattaatgcctttgtggaactttttaaaaggggcagacttcgcaggacacaatacgcctacaaaaaaaatacactaaagtggtgttttagaataaagaaaaaggaagtgtcacaatgttatctttaccagcactcagtttcttcttcattgctgtctttttgatatcacttggatttctgcttatctatcgtcatggttcacaaacagcaaggattggagcagccgaacgacactgcccgaattgtggaaagaaagttacatcctctgctaagttctgtccatattgtggtacttctttaggacgagaaagcaaatctacttctaaacccaaacagtatcgctatatttacttaccactcttggttgccgcggttagtactttcctgatgttcgcaggtagttcagctttttcacgcacagcttcaattaataagagcgtcacagaaacagccacaaaccaacaagattcaacagatttggtttttagtcatctgagtcgcaaagatcaacttcgtgaaataatcttttatggtttctcacacagcaaaactttcaagcaaaatgggattagcatgactaccttcccgcctatgggaaagggacttgtagtacacggctatacaaaaaactcctatagcgtctatccttacggctatgcctcaggaggtgtcccattgattgaaattacccagttgcaaaaagacacaggtgggacaaaaactcttgtgtacttcggcatgaaaacgaataccttttacgcggattctaattcaccagtcgatacccaaaacatcgataatttttgcaatgcacaaggcggaataaaaacattacgctctatcaagttcagagagtataatcccaaccctgtctttgaaaattaacattgcaatatatctatgaattgataactagaaaccggacttactttagattacccaaaggatcttctacctcattgactccgtgaatcatttcaaagtcactatatctcaaagaggagaacaatagctgcttgtgtgcattatgcctattcaagcggcacaatattcggtggaagctgctgatatcatatgtgtgcagcaattttcactaaacagtgtagattggagcgacttctatggcggagcaaaattattgcccgcattgcggatacaaacttattggcaagcccaagttctgtccacaatgcggtcacccactaacggcggagaccaaagagcaggtaacgatgtcgaaatctcatatgtttgaactgcgacttgacctaggaaatctgataccgagtcgcacgcactttatcaccgttttaacctttttgaaaaacaacgcgttaacattgtttatccttttttgtgttaccaccttcttaccagtgaattccgtacgctgttggttgttagttgcatacctaatcttcatctatttttacccgctctccactggtaaaaaaagaattttgtgggatgaacgcctcgacacgtggttgcaagataaggatagcttacatcgttttaacgaaaaagttggcaaaggtttctcgcagcttcaacatgtattacccaaagaggaaagtcatacaacaaacacaagcgaagttgccaaatcatcaggcactacaaaagacgcgatctcacttcagcaaaaacaaaccaataccacgaccaacaagtcgcaacatcatggtttcacgtggacgggcgaactcatttgtgggattgtctccacggtcaccgggcttgtgatgtatctcgtaggaaaggatgctactagctcaattagtagtcaagctatatctgtgctccaaagtggagaattggattctggtggctatttttatatttggggtatcttcctgtttggagtgggcatagctatgttgatcggcggtaccatcaaaggaatcactggtcatattcgcggtggtactctcaaaattatcgcaatcctaatttgctttgtggccacaattgccgctacttacgtctattctaaccccctcacatcagcagttaacgcagctgcgtatgcttacaattctaataccaatatagataccattcagaatctggcaaacatcgtcaaagcattgccatatatagcaggcgcaatttacggtttaggcgttttgcagaatgcaacgacaccaaaaaagtagcagaacatacatgaagtggcacttaatacccatataactagcatgcactaagaaacctttggaaagtaactacaaaataaacagactctcatcgctcgccgcgaaagaatcaaagcgttttctttgcagaagcacgtgccgttgcgattagatcaattgctagggtaaaattcaatttctaagtataccgacccaagataatagaagccatttttgaagaatcgttagtaaactagcatcttgattttaaacaatttaagagttggagaaaaaatgtatacacaaaaaactaagtcttgttatcgttgcggcgctattgtgagcgaggatgcaaaattctgtacaagctgcggcgcggatttgcaatcacaagtaatcagatcgacaccttcttttgaccataagactgagacaaattcttcattcacgaagttgtctagttttaacaagggaaaggcaattcttttaaaaaaatccgttcggaggaagctctggtatgctggtctcacagcgttactggtaatcctagttgtcggttatatttattctgcaaaagcagatgctttaatcgctaatagccttacatcaactacgcagcaatggatctccgaagcaaacgcatataaaccagaattaacgactgctttcggtgggtttctcgcgacacttttcattatatttggtatattgaaccgtcgtggattccctgctatcttggctagcattatcttcggcattgttggagcaactaccagtgccggtgttacttacgttttcacagcaggtaaagtaatcaatgctttcgaaactctcgcaacggatcggcttagcgggtctactcagctattcactcttagttattctcattatttacccagcttcatggaaacgaatactgcatatgatggtggtgtttacacattcaagcctgacggtactttaaaggtttatacgaggacgccttatccagttaacgcgaaaattacacctcaagatgccgctatgttgtacaaagaaagccaagattcaacagcagaggttgagtatggtacttggcatgtcacaaatggaacgcttcatcttaagtatggaaaattcaaaatcgcagcagatatcaccattccgtcgtatagcgacataggaaacttagcagatctgtcaatgaagagacggacagtacgaatagataatcacagatttgaaagtattcagttatctgtcgcaggtgaggaagcactttggtcaaacaaaccggatggaaagttaaatattagctttgacgggaaaacatatacgttgaagccagaccgaaaacaccaatactcaatgtcctttaacctttattcaccaaaatctttttcaaagtaaaatggttttcggacttttaaaggaatcttcgttattattttcaatacatctaaagactctttataaatcaataaaacacaattttggagatgtatgtagatgtcatcatttgtatcgagcattttacttttatttatgttagtctttatatctgcttttttcatttcttgtctgatccttatgctaatgagaaaacgaaaaggaaggcatccgttgaaactcttttgtccaaattgtgctgaagctgtaatcaaatctgacatatattgtccaaattgcggctttaagattgatggggcatttgctatagaaaaaaaggacgatattgttactcgttcgatattaattgcacttattatcagtctcttgctaatcacaccggtagttggcagattatatttttagcgtagtatccttgcaagaaaaatcttgtccaatattaccagtgaccaataccgtgatggcccgggcttaggccatcgcgaccaaggtccttacacgcagacttctgcgccggggaacgcgttaatgagagcgtgaaccggcgcggttagaagccggagtgtaagcgctgttacccctgactgaccataaatgatcctattaaatttaagactgatcacggagaaaagattttgacaatttcgttcaatactgtatttcaaaaagcacggcagacacatcaactactttcggttgacggtctgtcgtgctttcttttgttgttcactttgtggcggtacaacgccgccatgattcttttccggttactgagaaccttatccccacgacaaacttctcagcagcttgtcttgcattatgttgaacgcaaagtcatctctagaatgatgcaatccccaaaaccacatcatcgcgtacgactcgcatccaaacatccgttgtgtttacccgactcattaaactagccaacctagatgacgcatcaatgttagtgaccatccccacgatcgtcactaacaagattaccaattaccgtagtatggtctgtcgctattttgcgtggcgatacttacgaacacctgcaaaacccagaaccgcgatgatcaacgcgccagcttcggccaaaacgataccgttttgactctcacctgttgctgggtaagcatgtttaccatacttttgagtcatgcgactaagcggttgcgtgctggcaggctccgtcttgactaatggtgttacggctgcaggtttagcaggactggtagcaggtttaggggcattcgaacctgccggtgtagtagcagctggacccgtggcgctagaggcagctgagctactggcactggacgcagcagaactcgatgcacttgaggtagcggaactgcctgcgctggaggcagcagaacttgtagcacttgaggcggctgaactggctgcgctcgaggttgcggagctggcagcgctggaggcgctggagttattggcactggaagctgcagagcttgatgcacttgaaccggctgagcttgcggcgctggaggcgctggaattgccagcacttgaggctgaggatccactattgttcgtagatgttcctggctctgctccaggattcagctgttcgacttttgaattcaaagaatcaataaacttttgaacattagaatcttgctccgagttataggctttgatcttcggcacgatttgttctaataatgcattatcattggtgaccttatcacggagagttgtttcagaggatgtaagagtgctttctaagttctgataatcctttgcttgtttactctttagagctgctaaagctgactgaatattcgcaattttttgatcaatttctttatccttgcttgtgtctacttgacttggaactgtcgcaatattttcaccagcaaccttgtctgtaacagcatcaaagcatagtacccacgaaccattggcgattttctgatatgaccaaccgccagtctggaaattgtaatcttcgctaagaagtgtttgacgatgtccttgctctgatgcttggtcgtaattaaagagattattaaccgcacctgctaccgattgcaaaacatcaagcattgtaagatcacgatcttgatgaagtttattccagttgggattaaacgattgagctagattctcgccataaccaccgaattttctgaataactggtcaataatgttaatatcatgatgcatcacttcgtcattcaacatggaatcgccacgctgttgaactaagccaagaaaatcagacgttgtaattagcgggctaagtcctaacgccttcctgtaattgttcgtaagcatcatagcgtactgattaacttcgtattgttgtgccttacttagcttgtcatccttaacagtatccttcatagcccaagctggcaccacgccgtagccttcttgataagctgcgaataagtttgccttattgtcataagcttgattgtcttcgctattgacctcactatcagacaaaaccggtaaattttggactaaatagttaccgttccacttcgcattattcaaatcatcgttgttgacgatattgctccaagaccccgttttcgcaacataattaaaagtgccgccatccccaactggaatcgtttcagaagttttttgagaattcaaatcagcaacttcttttacagcagccgtgctggccgccgcataactgcttgcttgcgcggctttcaagcttgccaagctggtttgtgcttctgactgtgccttattaagcgccgcgacatccgtgtctttttgtacctgtgctggcttctgtaattgatctgcgtacgcacttttcgcagcctcagcctgactcttcgcagctgcttcttgcttcgccgcatccgccttagcctgatcatacttagccttagcagctttccactgttcatccgtcatgctagctgaagacggtgccggcgcattcgtttgcaccgcatcattcgcagtcttggccgccgcactagctggttgggcagcctgaaccgaaactgtggatgtagccttttgctgtgccggtgctgcagcttgtgatgtggcgaccgtcgctgcttgagcctgtgctgcctgacttaccgcagctgaagaaggcgttgtggcatcagttttattgaccaacgttgctgactgcaccgttaactgcggttgggtctccgcagcgtgaacggattgcgtctgggttacgccgaaaccaccgatggctaaggcaaatgctgaagcaaccacccactggctgccgcgtttgtacatttttttcttatcatttaccacatgttgtgcaaatcgattgtataacatgatgtcccctccaatttaggtatgtactcgtggttctattaacattaaaattatataaaggcattaggtgtgttatacctagtgaagcttagagggacattttttaagcaaatcctgtgtcagcagctgattgccttcgccagtgctcattgctgtagtgtcttctttttacgccatgcaatttaatttcgtccaaatcagccacgtcattgataacaacaaggccccgcaagacaacaaaaagccgtttatgtcaccagacacctcaatttaggtgttggtgacataaacggctttttaacttaatacaattagccggcgattaaatcttccccaccagcgctgcacccggcttcaatgtcttttcgcctggttgccagtttgctgggcatacttggtcgccatgggctgcaacaaattgggctgcttgcaaggttcggagaatttcattcgcattgcgaccgatgccaaagttgttgacagaataggtttggatgacgccgtctggatcaacgatgaaggtgccacggaaggcctggccgcttgcggcatcgcggacgtctaacgcactggctaaggtgccggctggatcggcaaccatcggatacgcaaccttcttaatggtcggacttgcttctgcccatgccatgtggacaaactcggtgtcttcggaaactgaatagacttcagcaccgactgatttgaactgatcgtaatgatcttgcaaatcgcctaattcggttgggcaaacaaaggaaaagtcagccggatagaaacagatcaccgcccacttaccgcgcatgtcttgatcggtcaccgtatgaaaatccccattttgataggcggtcaaactgaacgccggtaatttttgtccaataaagctcataatattgcctccaatgttagaatgattatcatctacatattaaggatagccgtttgtgaggcttttgacaagggcatttttgggcgatgaccgtccaaatggcataaaaataccgcaaccagtttggatgctttcactggttgcggctggctacatgttatctgataggtggtaatgtgacaggtcggaaatgccataacgctctttgagtgacgtggcaaaaacccagaccacatagtcgcgcagatattttggcgccagtattttgaccagtgcgccttggcctaacagccacatgcgaatgccgaagccgtcgttgactgcaatttcaatgtggtaaacccgtcgtgcgtaaggattgccgttgtccggatctacgcgaatcggcttggggtcgactttggcttgcgggaagcgatcggtcacataagccgggtcataagcatattcgatttccaggttgatgggcttgcccagataaggataccaggtgtgcacttgcagccgcccaccttggaaccggtcatcgtgattgtgggtcggatgatggccatagaatttcaggttgctgatggcatccaagcgaaacttggcgaacttaccgtgatcgggattttcaaattgctcatcgctaccatcaacgatcagatagaagaacagatcaccgaagaagagccctgtcggcagtttatggtcaaaatgatgctgctcgccatgataagtaaagtcgaaactgatcagttcatgattgacaaccgcctggctgagtcgctccaaccggtcactcaacgacatcttcgggacaccgcgatattcaaagatcggatttcgcatcaccgcgtcgctgcccttgtgatcggcaccggttggcatgagctgtcgcaacaacgatttcatctcatctgttgccaagccgcggctagccgttaaaatcaagccgatcgccattaactggccgtccgttaacttggtcccttgagcacgcaagcccgactgcagacgatagtggccagctggcattttggcaaaggcatcgggttcatccagctcccggtcaaacagccgtctgatcgcggcgatatcccggcgaatggctgattcgtcttttccaaattccgccatcaaatcttgcttggtcaacacatccccgcgcaacaagcgtaacaaaatcgtgacaatccgttcctgactcgacacccaacctgcctccaatacaaaggttattatataacgtcgagtatactatactgccgaacagagcgggaggtgatttttgcagttgaccataaaactcttgtcaacgcaggtttcattgagcgtctccacataaaaagccaccctcaaaaaagggtgacttttctgacagtggaagcattcaaggattattccttggttgcgacaccgccgccatttttcttgataatctctgcttggatgctctttggtactggttcgtagtggtcaaaggtcatggtaaaggtaccacggccctgggttgcactacgcaaggtagttgcataaccgaacatttcggcaagtggcaccatggcgttaaccaattgagcattcccacgagcttccataccttcaacacgaccgcgacgtgccgtaatttggcccatcacatcgccaaggtattcttcaggtgcgacaacttcaacgtgcatgattggttcaagaataaccgcaccggcactctttgaagcattcttcagcgccatggaagcagccactttaaaggcagcttcggaagaatcgacttcgtggtatgaaccatcgtaaagcttggctttaacgtcgattaatggataaccggcaagaacaccattggccatggcttctttcagaccttgctcaacggctgggatatattcacgcggaacaaccccaccaacgatcgcattttcgaattcaaagcctttgccttcgtcgtttggtgtgaattggatccaaacatcaccatactgacctttaccaccagactgacgaacgaacttaccttgagcagatgcttccttcgtgaaggtttcacgataagcaacttgtggttcgccgactttggcagccactttgaattcacgcttcaaacgatcaaccatgatatccaagtgcagttcgcccatgccggcaatcaaagtttcaccggtttcagggttggtttcagccttgaaggtcggatcttcttcggaaagcttttgcaagccgacatccagcttgtcttggtcttccttggaatcaggttcgatggaaacctggataaccggatccggaacatccaaggattcaagaatcaacggatgatcgacatcagttaaggaatccccggttgtggtattcttcaagccgatcgccgcagcaatatcaccggagaatacttcagggatttcttcacggtgattactgtgcatctgcaacagacggccgacacgttcacggttgtccttagttgcattcaagacatacgaaccggcttccaatgtaccactgtatacccggatgtaggttagacggccaacgaacggatcagtcgcaactttaaaggccaaagcagcaaacggcttgtcgtcgcccgccgtcaactcaacagcatccccggattcaggatcggtcgcgtgatacggccgaacatccagcggtgatggcaagtagtcgataacggcatccagtaacatctgaacacctttgttcttgaaagcagaaccggcaagaaccgggtagaattccaagttgatggtagccttacgaatcgctgcctttaattcagcattggaaatttcttcgccttcaaggtacttatccatgatgccatcatcaacatcagcaacggcttcaatcagttcattgtgagccttttgggctgcttccttgtagtcatcaggaatgtcaaccgtatcccacttggtaccgagttcgtcttcgtcatacaaatcggccttcatgtcgatcaggtcaatgaccccttcgaacttatcttcagcaccgattggtaattgaacagcgtgggcgttggcttgcagacgatcatgcaaagtctgcagggaatagttaaagtccgcaccgatcttatccatcttgttaacgaaaaccaaccgcggaacgccgtaagttgtcgcttgacgccaaacgttttcagtctgcggctcaacaccggattgggcatccaaaacggtgatcgcaccatctaacacacgcagcgaacgttcaacttcaatggtgaagtcaacgtgccctggggtatcaatgatgttgacccggtgatccttccagaaagccgtagtagcagcactggtgatggtgatcccacgttcctgttcctgtggcatccagtccatctgtgaagctccttcatgagtttcaccgattttatgaattttaccggtataatacaaaatccgttcagtcgtggtcgttttaccggcatcgatgtgagccatgatcccgatattacgggtacggtctaacggaaattcacgtttgttggccatgtggcgtattgctcctctcttgtttcaactggctttatacaaagaatggctactatataccaagccgcggatataatagccaaatcatcttaccaacgataatgtgcaaatgcccggttggcgtctgccatcttgtgggtatcttcacgcttcttcactgcggcgccggtgttgttagcggcgtccatgatttccttagccaaccgttcgtccatcgtatgttcaccgcgttgacgggaatactgaacgatccagcgaagaccaagtgtggtccgacgatccggacgaacttcgatcggcacctggtagttagaaccaccgatacggcgagccttaacttccaagaccggcataacgttcttcattgcttcttcaaaaacgtctaacggttcgttcccggtttgtttcttaatcatatcaaatgcatcatataaaattgttgatgccttaccgcgcttgccgtcaatcatcaagtggttgatcaagcgagtcaccagttttgaattgtaaactggatcaggtaatacatcgcgttttgcaacactgcctttacgtggcatgtattttggcctcctctttaaacgcgctctcggaaaacccaaacttcccgatcacgctctccttataaccgcacaaagcggcactagaaaatttttatcatgatcatctgcggtttaaaccgcgatcaatgttttacttcttcttagggcgctttgcaccatacttggagcgaccttgcatccggccgtcaacaccggcagtatcaagcgcaccacgaacaatgtgataacgaacccctggcaagtccttaacacggccgccacggatcaagacaacactatgttcctgcaggttgtgaccaatccccggaatataagctgtcacttcgatcaagttggacagacgaacacgggcatatttccgcaaagcagagttaggtttcttaggtgtcatcgtgccgacacgtgtagcaaccccacgtttttgcggtgctggattactggtaaggctcttcttcttgctgttgtaaccgaagttcaacgcaggagagtctgacttggttgttttggatttacgaccttggcgaactaattgattaatagtaggcattaagcttctccttccttattttgcatcatttttaagtccacacatccaggcggttcattttttctgataaaaaaatggccaaccgaacggcgacggctcttaacccagtcagcacgtccggataacccgaataaactggaaaaaagcacctttgatagtgtactatcctgtacgcatcagtgtcaagcgtaacctgaactagatcaggttaactaacaactcctaatcataacaaaattgttctacaaagcaagcaccttgactcagagcaagagcgtgagctggcgtgtaagtggccttgggcgtgatgggcctgggcttaggccatcgcgcccgaggtccttacacgcaaatttctgcgccagtgagcgcgtttcagcacaaaaatagccccacaaggcaagccctcatcagagcttacttcgcggaactatttttcaatctgatactaactgactagcatctcacccattacgactgcttacgccgccgcaaaatgaccgtgctgccggcaatgataagaatcacaacgcctgcaaggatcaacgtcatggcgtcccgatcgccaaagctgccaaagagcagtcgtcgtgacggttgttcgtgccgaacattgttgctgtgagcactcgggctgcttggggtacttggcgtgcttggggtacttggggtacttggcgtgcttggcgtgccactcgggttagtcgcaccaccgttgtttccgccattgccgcctgtatccggcaacgttttgtgcggttgatcggcgatggtcattcggacggcatcaccgctcttaatttcaacagcgaccggcttcgcataatccgaattaatcgtataaccactcggtgctttgatttcagtgagccaataacgacccaacttcaaattgtcaaaggttgctaagccttttgcgtcagtcgtgatttctttgctgtagccttgatcgttggtcaaccggaagactgcgccggccaatactttctgctgatcggccgcgtctaccttcttgatgataagcgaattaatctgataattggcaacctgaacggtaatcggttgctgcttattttgggtagctaaggcactggctgtctgggtcagactggtttgttcaaccttgaagcggatcttatcggtggtcaatgcatacttcggcaaggtcttcgtctcttcaaagtaataatcaccgattggcaagttaaatggcaaatcaatctgcccattcttgtcggttaccagatccttggccaggatattcccgctgctaccgtataagttgaaggtaatgccggctagtcgattaccaaaatcgccatcggtcttttgcaactgaacagtacgcttgaattcaggctcaatgatcggatccaggtcgatcttttggtcgcccttcacattcacatcaatccccttagccaagttgtccggaatgacatacccgcgtggcgcttgggtttcaaccagttgatacttgccttcgtaaagatcgtgatcgttgaaggtcacaatgccgttctggttggtaatcgttgccttccatgaccggctgttatcaactgtaccgtcatcgcgataacgataaagcgcaaactgagcgccaatcatcgtcattttggctgggaagcggtcatcatgcgtggtggctgctttcttggtaataacgacttgaccggccttcttctggttagtggccgttaacttaagctgggcctgattggctgtcaacgtgaaatcgacgctgccagcttctaggctttgctgccacgactgtttagcggtaccgtttgtgtcacgagcttgatcagtcgcatcgccttcgtagtgcttaggcgcttgggtttcaaccagacgataagcgttatccggcttcaagccttcaatcgcatactgaccggctttaaggggcgtatcaaagctgcttgcggcaccaaaagtcaactgcccgtccgcatctgtcttcatgtcggctttcagcgtcttgccggtaacttcatcgacaagtttgtacgttgcgcctggcaacagatacttcttaagcgtggcggcatcgtcagtcttcttaacccggttatcgtacttggttaaggtgacttgatatggatcgtcggcgatttccttgttgaccgtgattggggtcggcgttatcgcagaggataaggtgatcgaatgaactgttgtatccaaccgataaccagacggcgctttgatttcagtcaaggcgtagttacccagcaggagatcaccgaatgaggcaaccccattttcatctgtggtagcagtcttgctgtatccagtactattggtgaggcggaagacagcacccggtaatgcatgtttcgtataggtgctatcaacctttgtcacgttcaaggttttaatctgatagttggtgacattgacagcaattggcttctgcttattttctgttgctaaagcagtcgccgtttgcgtcaaatctgtctgatccaccttaaacgaatgcttgtccacatttaatctgtagggtggcagcgtcttggtttctttaaagtaatatgcgcctgctggcaaatcgaacggcaatttaacttggccattcttatccgtcaccagattgttagccaactcagttccgtcactgcgataaagtgcataggtaataccagcaattggattgccaaaattagcatcggttttctctaactgtaccgtccggcgataaagtggttcggtaatcgctggcagagccaacgactgatcaccagtaatatgaacgtcaatcccttgggctaactcatctggaatgacgtacccacgtggtgcttgggtttcaaccagttgatacttgccttcataaagatcgtgatcgttgaaagtcacaatgccgttctggttggtaatcgtcgctgtccatgcttgatcgtgatcaacttggccatcttcgccataacgataaagcttaaactgagctccggtcattggctgacggtctgggaagtgatcatctttaatcgtctcagcttgttttttgatcgttaactgacccggcttcttctgattagttgccgttaaggataaccgcgtctgatcagtcttaattgtaaaatcaagactcccggcttttaagctatcttcccacaactgccggtcagtgccacttgtcacatctgcttgatccttggcatcgccgcgatagtggtcaggtgcttcggtttcaaccagccgataagagttatccgtcttcaagccttcaatcgcatattctccagctttaagcggcgtatcaaagctgcttgcggtaccaaaggtcaactgtccgtcagaattcgtcttcatgtcggcttttagcgtcttgccggtgacttcatcgacaagcttgtacgttgtgcctggtagtagatacttcttaagcgtagcggcatcatcggtcttcttaactcggttatcgtacttggttaaggtaacttgatacgggtcgtcggcgatttccttattcactttaattggcgtcggcgttaccgcagaagataaggtgatcggatgaactgttgtatccaaccgataaccagacggggccttgatttccgttaaatcgtaattgcctaatagcaagtcgccaaatgaggcaacgccgttttcatccgtggtgacatctcgactgtaaccggtgctgttcgtgagtcggaaaaccgctcccggcagcacatgtttggtatagttacggtcaacttttgtcacgttcagggtcttaatctgatagttagtaacattgacggcaattggcttctgctcattttctgtcgctaacgcatttgccgtctgcgtcaaatcggcctgttcgaccttaaaagcatgtttatccgtgttgggtctgtaaggcggtagtgtcttggtttctttaaagtaatatgaacctgctggcaaactaaatggtaaatgaacctgtcccttgctgtctgtcaccagatccttggcaagctcggtaccgtcttcttgataaagtgcgtaggtaataccggcaattggattgccaaaattaccgtccgtcttttccaacatcaccgtccgccgataaaccggttcggtaattgttgggaacgtcagtgtttgatcaccggtgatattgacatcgacgcctttggccaaagcattcggaatgacgtaaccttcgggcgctttagtctcaaccaactggtacttaccttcatacaagtcattgtccttgaaagtaagtgcaccatcgttattagcgatcgtctctgtccacgatttatcgtgatcaacttggccgtcctcaccataacgataaagcttaaattgagctccggtcattggctggcgatctggaaaatgatcgtccttgatcgtttcagcttgtttcttgatcgttaattgaccaggcttcttttggttagttgcggttaaggataactgcgtctgatcagccttaattgtaaagtccaggctcccagcctttaagctgtcttcccacaactgccggcccgcaccgcttgtcaggtttgcttgatctttggcatcaccacgataatgttcaggtgcctcagtttcaaccagacggtatgcgttatccggcttcaagccttcaatcgcatactctccggctttaagcggcgtatcaaaactacttgcggcaccaaaggtcaattgaccgtccgcgttcgtcttcatgtcggctttcagcgtcttgccagtgacttcatcgacaagtttatacgttgcgcctggcaacagatacttcttaagcgtggcggcatcgtcggtctttttaacgcggttatcgtacttggttaaggtaacttgatatggatcatcagcgatttccttgttgaccgtgatcgcactaggcgtggccgcggatgccaacgtaatcggataaatcgtggtatcaagtcggtagcctgctggtgcttttacttcagtcagtgaatagtgacccaacagcaaatcgccaaatgaggcaacgccattttcatccgtagtaacgtctcggctgtagccagtactgttcgtgagtcggaagacggcgcccggtaatgcgtgtttggcataagtgcggtcaactttcttcacgttcaaggtcttgacttgatagttcgtaacgttcacggtgacgggcttctgcttgttgtcgctggctaatgcggctgcggtttgcgtttgatccgtttgcttaatggtaaacgcatgcttatcggtattcagccgataaggcggcagcgtcttggtttccttaaaataatattgtccggctggcaagtcaaatggtaaagcaacctcgccatccttattggtgaccagatccttggcaagttcggtaccgtcttcttgatagagcgcataggtaatcccggcaatcggattgccaaaattgccatcactctttttcaaaacgactgtgcgtcggaaaaccggttcttcaatcgttggatacgtcaatgtttgatcgccggtgatgttgacgtcgacgcctttagccaagtcattaggaatgacatagccttcaggtgccttcgtctcgatcagctgatacttgccttcatataagtcattaccagaaaacgaaacggttccgtcattgttcgtgacggttgcttcccatgatttgtcatagtcaagcttgccgtcatcgccataccgataaagcttaaaggtcgcaccggtcattggctggcgatcaggaaaatgatcatccttaatggtttctgcctgcttcttgatggccagttgaccgggcttcttctggttgtacgctgtgacttgcgcgtttggcgttttgtcatcaatcgtggcattgacactgccagcgttgaggctatcaatccagagttgcttgtcgggcccgcttgtcacggttgcctgatcatgcgcatctccccggtaatggatcggtgcttcgcgttcaaccaaccggtagtgaccgggttttagcccttcaaggacatattgcccggctttcagatcaggcttgaacttgccatcagtataactaccagcaaaactggttgccgtaccaaccgtgatttgaccgtcatcattggtcttcagaccggacagtaatttctgctggttatcagtgtcgatgaggtcataggttgcacccgacaagcgatattgtttgctgtcggctgctgattggcctttcgcacgattatcatactttgaaagggtaatttgataaggctcattttcaaccgcttcattctgaatcgcggtgccggtatcagaagtagctttcagtcgaattttctgtggcgctaacggtttgtagccagcaggcgtgttgagttctgtcaaggtataatccacaccgattggcaagccttggaaagttgcggttgccttgtgtgtttgatcatcgagtttggtagttgcttcaaaagtatgggtaccgtcactcaaccggaacttgatacctggaatcggtgcgccgctgactttatcttttttctcaaccactaagttggccagctgcgtgatggtctccccacttatgccagagtcccaagatggcaaatagccctgcgttgaggctgttcggccgctttcaggaacaccgtcgctaggttgattggtggtctcatcgccactccatgaaaccttgctggtgttgtaaacccagccggcattcttgctgctagtggcataatacacattgacgtgataattatttagcggactgccatccgtttgtgtcagattaccaaaagtccggtggaacgtgacggtgaatttgtcaccgttcaaggcaagatcgtaatccttgccttgtttcaacgtgacttcattggctgatccaacctgcaaggtaaccttgaaactagtggcattgatttccgcaccagtaccagatggatcaagcgtatcttcaataaccggattcaccatcggccggtacttgtcttggatattctccagttgaacatgccagtttaggacatttttcagctttgagtcccgactaaccgttttgttaattggcgtccaatagctctgcgccgacttggaagcagacggcgtgaacttcggaatgtcggttgttgcttggttcttgtccgtcacagtcgccgtattggtgaagttagggtcgttatagctccactggttggctcgcttcgtttcaaagacaacccagacgcggccgttaccgatattaggaaaatcaaaatctaactgttgcgctaaatctttattgtccgtcaaccaagtattcggtgtgttggtcggcaacagatcttgctgggcggcgtcatccgccttcagcgcggttgttgaccagccactggtgccgtaataagggttggtcttaatttctttgacgtcacccgatgtggtcggatcgccagtgtttgaaggatcgataccatctgacccggtcacttcatagaacttaatcgaatcaggaatcagctcataattgaccccgtcaaatctcggcaaaatatctgtcaaatgcagatgcccatatttgacgcccaagcgattcaccaaaacgccccaatactgggtatccggtgtatcactccacgaattcttcaaggcaccactaaaagcaccctcttcgggagtcggcgtattgctgctggaaccgctggcagtatcatggctgcctggtggtaaatcaaagaagaagaaagcccggttgtttaaagcctttttcaatgcatctgggtcattggcaacttggcccagttttaacatgtccagtttggtgtgcgtgtagatcacaatctgggaatcggtgtctgcatacttgcctttaagggttacgacaaacccgcgaatgcctttggtctggccatcagcatcaatcggattttccttgtctttagcgttatactgcttaactgccgtctgaacatcgttatcacttgtgctcatcgcataatcggtgccagacttcagcagcgtgcgcttgccatcgggatcctgcgcataaaccaaaatcccgtcattgctgccatcctgatcatcggttgacgcattttcgccattgatcgtgttgatatcggcagcggttggatcgtcgccaagtttatcaacgccatcagggaacaaatcaaaaatcttgccgttacgcatctcgcggaacgtttggttagcattgatccgccacatcatttgagcattgtaggtatcaatgttcccggctgttttgtcgatgctattcggtaaacttacctgataagtcgcattggcataatggtccttttgatcattgacaatgttggttagcttagtcccattagccggcgtcgttttcagcttggtttggtattgcacttggaatgacgcattgtccggcagctttgcaccgccgagatacgtcaacgtgaaggtgccattacctttatccgtcagcttaaagtatttggcaatattgtctttggaaaccgttggtgatgcattttgatcaaaagtaacttggaagactttcagcgagctggtatcgagtgactgattagcatcctgctcgatttttggctgattgtgatcgtcggttcctccaatttgcttaccaaaatggtcggttaaggtcgcaccggctttcatggtgtccatgctatagttccaattaatcttccactttaacgcgcggaagttattcgtaatgtccccggccttggtgatcgcgaccccggagttacgcatggtcacgctgctgtaatcatagccatcatagctcttagtgccagttaaatagcgatagccttcaaccaaagcgctaccgactttaccggtatcgtctaaagagcgatcaatgctggctgtgtaatcgacctgatagccggttgattttttgagaccgtcagtcaaataaattttgaccgtgcgtttgtcatccgataaaaccgcatggtaatcccgaccagcaaccagtggcttcaatgcctcggaaaagtcgcctaaaacattaaccgaagcggaagaaactttgattttggccggatcgctgtcgctaaacgtcagcgacttcggataagtcgtcccgctaccttgggcagtgacggtcaactccatgtcggcattcttggagcgcttggccggatcgctatcccacttaggcgggttcgttttatcactttcggccccgttcaaattaaacttggcacttccggaaataccggttggattcaagttctgtggtgtgacttttggcgcattcaccaccactggctttgcgttcgaccgaaacgtaatcgggaacttggtgtcattgtcttttgtatggaaaaccaacgtctgattcaatgagtcattggcggtcagtgctttaaaacttgcagtaatattgacccgccatgagccattatccgtggccttcaaaagtttgatcgtcaactttccggttgtttgatcaaactgatactctgcaacaccgccgtcaaagacaccggtactgcttggcggaaaatcaatttgatctttcggcagctgcgtggtaaacgaagcgcctgccggaaacggcgtgctggtttccggtaacgtgaacgttaattccattttcacggtactttgttgattaacttccgtacccaacggctgtccgttgccgtctttcaatacgaccttcgtgaaaatgtttggcaatgtcgtgtcagcttttgcatctggcgtggcacttttagccggttcctgtgcactggctgtctgcgctgccgatgacgccgcagcactactgctactactgctgcttgtgatcgttgcggatgcgcgactcttaaacaacagcatctcattgcccgacgccgtgacactaacattcttggtctgctcaatggctgtataacctgaagcagactccgtttcggtagccgtataatttccgacgggcagattcggtacaattgtctggccgtctttgctaatggcgctgttagccacaacctgatgggattcattacgaacctcatactttgcgccattcagcgacttgccttgctcgtcctggttcttaatcgtcagtgtaccagtcactgcttgtgtcggattctcggcggcaagggtcaatgctggcgaaagcaactgcacaatcatgccaagaatgacggtaaaataaacgctaaccttgaacagcctgtgcctggtttttttgacacccaactccttcatgatgttcccactcctccttctaaaagactttcatggcaactcccccgcgaaaccattaacttgtgaattatgaatacattaactaaaactacacccactgtcattgtataacattgccataaatattgaagcggttaacaaaaatcctcatcaaatatacatttaattttttgtgtgtttataggtttattttttaaaacaaggcacacaatctcaaaaagaaacaatataatcccttaactaaatataagtgtgctattttgcttacttatcgttaccgaaacggcttactcactttctaaaagttagtgtcattattattttctaggttcttttacttttttaagcggaatctaccctatgaaggaggattgtcgctatgatttcaggactaatgttacttagtgttgcgaagttcaccatggacttgacggcagataaccggtatttccactgttgcctggctgtgcttttagggatggttgcccaaacttggctaacgttactgctgagtgtgggtttattgatttttagtgtggctgattggcgggagcgggcggtgtctgccgtttggtttggcagctggtgttttctgctccttctcctgtttccttgcgattggtttaacgtgtgtttgctggcagctttggttggtgggctcgcggtcgtctcacacgggctaggcagtgccgatgtgctcctcattgccgtattcggtggcatcctgcaacttgaaattgcactcatcatcacgtgcatggcgtgcttcagcgctgtcatccactggttggtagcccatccgccatccctaccgttcatcagtcatttagcggtcggttatggctgtgtgcagctagcaagtggttggctgttttgagatgatgataagtgccgcaaaacgtggccatccataacgcgcgagccggagcaggagtctgcgtgtaaggaccttggtcgcaatggccaagaccgggcccatcacgcccaaggccacttacgctccgactcctaagcgcgccggttcacgctcacaacaaaaagcacgacgtaaacgcccttaaaggacacttacgccgtgcttgtttgtaactagattattcgattagcttgagcagctaacatgatgactacttgttgtcagtatcatcctgttggtcgtctttttgctggctgtctttttccttcatctgcttttcaatgtcagaaatcgaatagacactatcggaaacggtaccgacactctttggttcttcgtgacgatacgttgccatcccggtaccagccggaatgatcttcccgatgatgacattttccttcaagccaactaacggatcgttcttcccgcgaatggaagcatcggtcagaacccgcgttgtttcctggaaggaagcagctgacaggaagctgttggtttccaaggaagccttggtaatccctaacagcaccggacggccggtagccggaatgccaccactgatgatcgcttgcgtgttcttctctttgaagtccgcaatgtcgagcaatgttcctggcaagatgtttgtatcgcccggatccatgacgcggatcttgcgtaacatctgccgaaccatgacttcaacgtgcttatcaccaatatcaacaccctgcatacggtaaactttctggacttcagaaagcaggtagttttcggttgccatcacatcgcgcactttgatcaactgcttaggatcaattgacccgcctgtcagtcgttcgccgcggttaacatgatcgccttctgcaaccgccacactggatgcatagggtacgctataggttcgggtatcagtctcacccttcaccgtaatttcacgcgtatgctcagccggattttcatcaatagcagttacttcaccggttacttctgtgatcacagcttcacctttagggttccgtgcttcaaaaatttcctgaacacgaggcagcccttgggtaatatcttcgccaccggcaacaccaccggtatggaagttacgcatggtcagctgggtacctggttcaccgattgactgggcagcaacggttccgactgcttcgccgacttcaacctgttcgccggttgccatgttacgaccgtagcacttctggcaaacaccgtgtttggtattgcaggtgaagaccgaacggatggtaacggcttcgacaccggcatccacaatcttctgtgccatgtcttcgtccatcaaggtattgcgcttaaccaggactttgccgctcttaggatcaagaacgtctttcatggtaaaccgcccgacaagtcgatcatacaacggctcaatcatttcgttaccttcacggatagcgcgaacgaccaaaccacgatcggtgccgcagtcttcttcacgaacaataacatcctgtgccacatcaaccagccgccgagtcaagtaacctgagtcggcagtcttcagcgccgtatcggtcatccctttacgagcaccgtgagtggacatgaacatttccataacggtcaaaccttcacggaagttcgagataaccggcacttccatcatcccaccgttaggcgcagccatcagaccacgcataccggcaagctgagtgaagttcgagatattaccacgggcaccggaatcagacatcatggagattgggttgttcgggtcaaaagaatcaaccagcttttgctgaatttcatctttggcatcgttccaaatctggataacccgatcatggcgttcatcatcggtgatcaacccacgccggaactgcttagaaacagttgcaaccttcttatgggcagcagccacaatttccggcttttccttcaggttagtgatgtcggaaattccgacagttaatccggaattagttgattgcgtgtagcccaatgtcttcatgtcatccaacaaatcactggtccgctgaaccttataaaccttgaagacctgcgcaatgatatcggataagaagcccttcttaaacggatcgatcaaaggtgcatccgcgagataagcgtgaatgtcttcacctttatcaatgaagtacttatctggcacaccattgacgatgttgtcttgcgtcggctcattcagatacgggaagtcttttggcataatctcgttaaagatcgccttgccgacacttgtcaccatgatcttttgcttctgatcgtcagtgaatggtttgttagtgaaggaattagctgcaacgccaacgcggctgtgcaaatgaacgtagccattttgcaatgccatcaggatttcgttggtgtctttgaagaccattccttcgccttcgcgacccttttgctccatggtcaggtaatagttacctaacacaacgtcctgcgaaggggtaacgattggcttgccgtcttttggtgccagaatgtggtgtgccgcaagcatgagcatacgtgcttcagccatcgcttcatcagacaacggcacgtggatcgccatttggtcaccgtcaaagtccgcgttatacgcttcgcagaccagtgggtgcaaccgaatggatttcccatcaaccaaaacaggttcaaacgcctgaataccaagtcgatgcaacgtaggcgcacggtttaagagtaccggccgttccttgataacatcttcaagcacatcccaaacgtcatcatcctgacgatcgattttgcgccgggcattcttgatgttgcttgccatatcccgcttaaccagttcgcgcatcacgaatggcttaaagagttccaaagccatttcacgcggcacgccacactggtaaaacttcaaccatgggccgacatcgataacggaacgaccagagtagtcaacccgcttaccaagcaagttctgacggaaccggccttgcttccctttcagcatgtgtgacagggacttaagcggacgattgcctgggccggtaaccggacgaccacgccgaccattatcgatcaaagcatcaaccgcttcctgcagcatccgtttttcattttgaacaatgatgcttggtgcattcaggtcaagcagccgcttcaaacgattgttacgattgatgacccgccgatacaagtcgttcagatcagacgtcgcaaaccggccaccttcgagctgaaccattggccgcagatccggtggaataaccggaatcgtatccatgaccatccaggccggatcattaccagattccttaaaggcatccaaaatgtccaaccggcgaatcgcgcgtgtccgtttttggccttgcgccgacttcaggtcatcttttaattcggtaacttctttgtcgagatcgacatcctgtaacaattccttgatggcttcagcacccatcttggcattgaaggttttgccgtattcttcgcgcttttcacgatattcgcgttcggtcagaagttgctttttctccattggcgtatcgcctggatcaatcacaacgtaagaagcaaaatagataatttcttcaagtgaccgtggcgacatatccagtaccagacccatccgacttgggatgcccttgaagtaccagatgtgggtgaccggtgcggctaattcgatatggcccatccgctcacgccgaaccttggaacgtgtgacttcaaccccacagcgatcacaaacaatccccttatagcggatccgcttgtacttaccacaggcacattcccagtccttagtcggtccgaagatgcgttcatcgaacaagccgtcccgctcaggctttaaggttcggtagttgatcgtttcgggctttttgacttccccatacgaccagctgcgaatcttgtccggcgaggctaagccgatttgcatactttcaaacttattgacatcaatcaaagggctaacctcctattttttatcgtcggtactgttatcggcaggcttaccgtcgctcgcttgagctgcggcttcgtgtgccttcttttcttcttgctgggctgcaaacttcgccaaagcatcgactgaaacaacatcgtcttcgtcgtcatccatatcccgcaattcaatttctttcttatccgcgccaagcaccttcatatccagacccaaggcttgcaattctttaacaagcacacggaaggattccggtacacctggctttggaatcggttcgcctttgacaatggcttcgtaggtcttgacccgcccgacaacgtcatctgacttataggtcagaatttcttgcaaggtataagccgcaccataagcttcaagggcccaaacttccatttcaccaaaccgctggccaccaaattgtgctttaccaccaagtggctgttgggtaaccaaactgtaaggtccaattgaacgagcgtggatcttatcgtcaaccatgtgtgacagcttcatgtagtacataacccctacagatacccggttttcaaatggttcaccggtacggccatcatacagaactgacttaccatcggaggccatgccagcttccttgacggttgaccacagatctttatcgttggcaccatcaaaaacaggggttgccacgtgaatacccaagttacgtgcggccatgcccagatgcaattcaagcacctgaccaatgttcatacgacttggcacacccattggcgataggcagatgtcaaccggtgtcccgtctggcaggtatggcatgtcttcttcaggaaccacgacggagaccgtccctttattcccgtgacgaccggccatcttatcgccgacctgaatcttccgcttttgggtaatgtagacacgaaccatcatgttgacaccaggagacaactcatcgcccgcttcacgagtgaagatcttgacgtcctgaatgatcccgccgccgccatgaggtacccgcaatgaagtgtcgcggacttcacgagccttttcaccgaaaatagcgtgtaacaatcgctcttcagcagacagctcggtaacccctttaggtgtcaccttgccgaccaaaatgtcgccatcacgaacctcggcgccgacacgaacaacaccgaactcgtcaagatccttgagggcttcttcaccgacgtttggaatttcacgagtcacttcttcaggcccaagtttggtatcacgtgcttcggattcatattcttcaatatgaatggacgtgtaaacatcgtctttaaccaaccgttcagacagcacaatcgcgtcttcgtagttgtacatgttccaagtcatgaaggcaataattgggttttgacccaatgccagttcgccgttttgcatggctggcccatcagcgatgatttcatcaacatcaacgtgatcgccaatcgtgacaatcggccgctggttgtagttcttgccggcgttactacgcttgaatttcattaagttgtaggaatccaaggcaccatcttcacggcgaacccgaatttgcttagcgtcaacatattcaaccgtcccggcattcgtagccagaaccgctgtcccggaatcatgcgctgccttatattccatcccggtcccaacaagtggggcgtgcggattgatcaacggcaccgcctgacgctgcatgttcgcacccatcaaggcacggttggagtcatcgttttccaagaatggaatgcatgccgtcgcaaccgcaacaacctgcttaggcgaaacgtccatgtagtcaactttgtctggagaaatttcaatgttgttatctttgtgacgcgccaaaacggtatcgtcaacgaaagaaccatcatcgttcaatggcgagtttgcctgcgcaacgatgtagttatcttcttcatcggcggtcagatagtcaatcttatcggtaaccttatgcgtatcccaagaaacacggcgatacggggtttcgatgaagccataaggattaaccaccgcataagaagccaagctgttaatcaacccgatgttcgggccttcaggtgtttcaatcggacacatccggccataatgggtgtaatgaacatctcgaacttcataacccgcacgatcacgcgtcaagccaccgggtccaagggcagaaagacgacgcttgtgggttaattcgccaagcgggttggtctgatccatgaactgtgacagctgggaactgccaaagaattccttgatcgaagcaacaaccggacgaatattgatcaattgttgcggcgtcacggtggcagtatcttgaatcgacatccgctcacgcacaacccgttccatccgggaaagcccgatccggaactggttttgcagcaattcaccgacggaacgaatccggcgattgcccaagtgatcgatatcatcgactgagccaaggccttcttgcaagttaaggaaatagttcatggatgccaaaacatcagccggaacaatatgcttaactttcttgccaatgtggccgttgccgattaaattgatttctttatccggtgttacttgtgagtagaccttaatgctttgcagcacaatcggatccgtcacaacgccttgatcggaaggttgataggtgacggtcttgaaatcatcgcgatccaaataagcccctaatttgtccatcacttgacggtcaactttggttcccttttgggcaataacttcaccggtatccggatcagccaacgtttcagccaaaacctgattcaacaggcgcgtcttcaagctcaacttcttgttaaccttatagcggccaactgaagccaaatcgtagcgcttcggatcaaagaagcgcgcatacaaaagtgaccgtgacgaatcagcggttttaggttcgcctgggcgtaggcgttcgtaaatatccttcaaggcttcatcggtacgggaatcatccgtgttcttatgcacatctttttcaagtgtgagcatcagcgaatcgttatcgccgaacatgttgataatatcttgatcagacccgaagcccaaagcacgaaccagttcagtcaacgggatcttccgcgtccggtcgatccggacataagcaatatccttggcgtctgtttcatattccaaccaagcaccacggttagggatgacagttgtgccataggtaacccgtgagttcttatcggtttcgctatggaaataaacaccaggtgaacgaaccagctgggaaacaataacccgttccgccccgttgatgatgaaagtcccttgtttggtcatcagtggaaaatcgccaaagaaaacatcctggctcttgatttcaccggtttcatgattcgttaaacgtaaggttacatgcaaaggtgcggagtagttcgcatcgtgttggcgtgcttcctcgacagtatatttcggttccagcagttgatagccgacaaattccagtgacagtttcccttgaaagtcatcgatcggcataatatcgtcgaacatttctttaagaccttcatcgaggaaccattggtaagaattcgtttggatctcgatcagattaggaagatccaaaacttccttgatccgggcataagaccggcgtgtccggtgcttaccataattcactaagtgtcctgccaaattattcaccccttgtaagattttccggcttggtcgattgtaaaaataatgtaaaaattgttaaatttacatgacaatgacgatctcgcagacattttgagcaaaaaaaaaccaaaaacagatcagccttcaaccagcctgctgtttttgctttttccattagccagaacggacaatagatcgtcctgacagcctgtccaaaccgaaatgcgattgatttaataatacgcggtggtgtcaagaaagtcaagcagtaaaatttcttgtacctgtgcaaaattttcgtcgcgtctgtgcgaccacatcaccattgccatccaatttagatcaaatcaaccgccacatcaagatgactgacgcggcgattttctctttctactgtacaactctcagcgactcaaaacggtagcccgattatcatccatataccgtaccgcacgctgatactgatcttcgttataaaagaatcccggtcgccataaggtacttaggtaggcgcccatctcttcaatactaggctgacagtcctgattgagccaagttttaataatgctgacatatgaggctgctaacagattctcctgaaacgctaaccagggattcggttctggttccaagtgccagaaccgcaaagtgtcatgtcgagtcttcgcaatggcccgcgagaagcgattggtaaaatcatcccccatccgcgccgagaaaagaatagtgaagacttcctgatgttgtttgatatacgtgaaatactccgtgtatatcgggtaattacgatgcgtaatgccttcataaaaatagccaaccgaatgttgccgaactttcttcatgatgctcacaaaaccggcaatcagatcatcttcgatttcttgcaacaactcatatttatccgagtaatagctgtaaaaacaggatcgactcacatcagctttttgaaccaactggcgaatggacacgctatgcagatcattctccttcagaagatccagaaaagcgcgcttgatatatttttgctgcttgcccatggttaacctcccctaacgactcgtttcgcagcatgaatcggcatcatagcaggctgcttatgatatccaaccgaagcagccgaaaaaatcgccatagcattaagcgcgttgctatgtacagttcgcccataagtgtccaaattcgcacatttagcgtaacactggtattaaaaaatgtaaacccttacattactatcataatagactttccgttaacaagttaagattgatcgttgtgcatagttgagcaataacccaattaattgggacaaaaatacaggaggatacgtaactatggatacattaaagatcgccatttacggtgccggttcaatcggaaccatttccggtgcctacttgtctgcggcgtatggtaaagatcacgtcaccttgattgatacttggccagcaaatgttgctgccttaaatgcagagggcgcacatgttatcggaacaacagacttcaccacacctgttaccgccgtaatggcagatgaagtggtcgatcaattcgatctcatcctgttgcataccaaacaagtcgacaatgcgaaagtcattccagcggtcaagcagcttttgaagcctgatggcactttagtttccttacaaaatggcgttccggaaagatatgttttgacgcatattccggctaaaaatctgatcgccgggtcggttgtcttcggtgcgacgggagcaggcccaggtgtgaccgaactgacaaccgcctacgatagctttaaagcccatgcctatcagattggtgaaattgacggcaccataacgcagcgcacggagttggtccaaacgattctctctcacgtcggaatgaccctgatttcaaatgagcttatggggacgaagtggtcgaagttacttgtcaacgctgcctttagtggcttatcaactatcatgaatcgaacttttggcgaagtcgctcaagatgacatcggtgtgaaaagtgctttgcacatcctcaatgaaggtctcaacgtcgggcaagcagatggcatcaccttcaccccattatcgggggtcgatttggcggccacttttggcttaaccggtgacgactttactgatacgcagattgcaaccctccgtttgatgaccggcgctagcgctaaactcaaagccagtatgctacaggacttatacaaacagcgcaaaaccgaagttgattatatcaacggtttaatcaccgcgacggctcgcgatcacgggattgcaacaccatttaatgatctagtggtcaaattgattaccgaagctgaaagaacacacacaattccgacattcgaagtagctaaagccgaactgcaacagctgctcgatcatcgcgccgttgtttcctgatcgatgccagattttgtgaaacactgattttaaacacacagaaaaagcaaatgtccatttttggacacccattttggtttgtcattccatcgctaaagccttttcaatatgctaaccatggaaataagaaagcaagctttttttagaaaggagtctcgttatggctgtcgaaacaaaaacagataagttgatgtggccaattgaagccattcaaccagttaaagacggcgatactgtcgtcctcggcggattcggaccgctgggttatccggctcagctggtgaaagcgctgtatcttttcagcgatgccaaagatttgcatattgctttaaacgcacctaatggcatgtatctgccgacgctggatcggttaattgcagaacgagcaagccacttaaccaccacttttgtccgcacaagtcgcgcagcaaccaagttctttaaagaaggcaagttaacgctaacgccacaaggaacatttgcagagcgtctgcgcgcagccggtgctggtattcccggattctatacccccgtcggcatcggaacgatggtggcagaaggcaaagaggtcaaagaattcaacggccgccagtatttactggaagaagctttaaatgctgatgtaggtttcatgcaagccaccaaagtcgactacgacggcaactgttatatcgaaggtgccatgaagagctttggcgcacttgttccggccgcatcgaagtataccgtggtcgaagcagaagaaattgttccggtgggcgatattccatctgagctcatcacggtttcaggaatctacatcgatggcattgtgaaagtggggatgcgtcatgatcagtagaacttatatcgccaaacgcgttgccgatgagttagaagatggtcagattgtcaatttaggcattggcattccgaccttgataccaaaattcatcagtgatgacaaacacattatcttccaaagcgaaaacggcatcattaatatcggtccggcaccaaaaccaggcgaaccggaaaatcccaatatttttgatgctggcggttcgccggcaacgatcaagccaggcggccaattcatcgacagtgccaaagcattcggtttgatccgcagtggcaaggtagacgtcacagttctcggcgcagtgcaagtcgacgcccaaggtaacatcgccaactggatcatcccgaacaagatgttggtgggcttcggcggtgcgatggatttggtcacttgcgcgaaggaagtcatcgtcgcgatggaacacaccgccaaaggtcaaattaaaatcttagacgaatgtaccttcccattaaccggcgcacattgcgtcagcaagatcatcacggaactggctgttttccatattacggatcacggaatggttctgaccgaaatttcacctaaaacaacactagatgaagtgcgggccagaacaggagcacactttaacgttgcagataatctgaaagtcagccaaattgctgatgaagctgttgaagtttaattggagtgcatctatttataacgcgctcaccagcgcagaagccagcctaaacctggccatggccgcttacgctccggcttctacccgcgccagttcacgctcactcaaggaggatgttaacagcactcaaatatgacgaacaatatggaatcaagtggtacaacatggacagaataattaagtggaagctgtccgtgtgttcaaaccaagctaatctgcgaaatatattgacaagagcctgaatcggtactgtatgatggttcttaccaaagttccgctagctagtattggtttgaacgtctacttcaagctccctctcgagcggcgtttaaccagctaattgagaggaggtgacaacttttgattaaaacgcataagattaaactctatcccaacgcaaccatgcggtgtgaactggagcgattgtttaactatcgccggttttgctggaatcaagccttagaaacgtggaacgtcatgtacgacgcgtctctggtaatggcggataaaacgctgcgacctaatgagcgcaaggttcgcgatgaactggtttggaacaaaaccgactggcagtacgaacagtcagcccgagttttgcagctcgcggtaaacgatttaggtaaggcttggaagaactacttcaattcgaagatgccagatcatgataagcccaactggaaatctaagaagcgatctcgcaaaacattcaaaacggatcgcgcgcgacttgtgaatggcaagttacgtttagataaacttcatagtgctggtgcctggtatgacatcaaactagccgagcacccgcgctggcaaggagaactgaaacaagtttgcgtcgttcaagacgcggatggttactacgcttcgttttcgattgaggttcagacttctgttgaaaagcgtccggttctaacggttactggggttgatgccaacatcggcaagtttgactatcaaacagcaactggctatgccactcaacccaccttacctgagcgtctgccaatactttatgcccgcattgctcattatcagcgtcaattagcccgcaaacggaaagtaaatcccaagcattttaactctaaggcttatcgtacaacgagaaccaagttgaagcgtcaataccaacgagttgaacggattcaagtggatttgctgcaaaagtttacgacgaagcttatcactgattatgacctaattgggattgaggatctggataatcaccatatgcgcatgaataaacgt

SEQ ID NO: 329 - DNA, 6280 bp, Lactobacillus casei
tacgacgaagcttatcactgattatgacctaattgggattgaggatctggataatcaccatatgcgcatgaataaacgtctcgccaagaatctgcatcgatccctgtttggcaagttcaaagtgatcatgcagtacaaggctgactggtatgggaatacgttagtgctagcggatcgtttttatcccagtacgcaacgttgttccaattgcggttatgtgaagactgctgatgaacgggtcacgctaagcggcaacttgaaacatcagactggtcacgatgactatcattgttaccagtgcggggtgaagttgcggcgagacgaaaatgcggttgaaaatctaattgcttatgcaaaatcaaaagttacggggtaggctatacccttaaagttcaagaggcggtcactgtcgggctgatttatttcagtgtgggaataccgttgttgacgggactaaatgaaatgtaggattgtcaatcaagaaaggaaatatataaaacctttattggtgtcaaagagacattcttccacgttttatatagcaggaaaataaaatgcctgaaacaaaagatgctgtcattgtcgcttatggtcgctctgccgtagggcgctcattgaaaggtgctttgacgaatgaacacccggttgattatgccgcagaagttttgactggagttttgaataaagttccccaactagacgtcaacgatattgatgatgttatggtcggttgtgcattacctgaagatgttcaaggactcaatgtagcccgaatgatctctcaacgcgccaacctgccagactcggtacccgctcaaaccattaatcgtttctgttcatcaggaattcaaactatcgcaaccggggccaacgccattatggctaatcaagctgatatcattgttgcgggcggggttgaatccatgagccaggtaccaatgtcctttgatatggccggtatcaatccgacattacgagctgaaaagcctcaagactatatgccaatggggctaaccgccgaagtagttgccgaaaaattccaggtgccacgcgaaaaaatggacgaatttgctatgcacagtcatcataaagctgcagcggctcaggaagctcatgcttttgatgatcagattattcctgttcactatggcgacatcgaaggtcacactaaagtcttcgacaaagatgaaggggtccgtggcaatctaacgatggatcaactagccgctttgccgcccgcttttaaagaagatggtggtcaggtcacagccggtacttcttcaccattaagtgatgggaccgcctttgtcatcttgatgtcagcagacaaagctgccgagttaggggttaagccaattgcccgttttgtcggttatgccgtagctggcgtcaatccggccgttatgggacttggcccgatctatgcggtgccaaaagtgatggcccggacaggcttaaccattgatgacatggacagtatcgaattaaacgaagcgtttgcctctcagtcgcttgtctgcattgataagctcaatctgcctgtcgacaaagtcaacccacgaggcggtgccttggcacttggccatccgttgggagcaaccggtgcgattttgacctgcaagattctttcctacttgcaggccaccggcggccgttatgggttggtcacgatgtgtattggtggcggcatgggagcagccggcatttatgagatgattccagacgaagaaactgcagaggcgactgcgtaatgtttgactgctggttcgcggttatccaagtaagctcatttcgctaaagggggtgcattttgactgatcgccaagtgattcagacccgcttggtgttgcctggcgacaccaatgctcataacaccttgttcggcggtaagttgttaagttatattgatgatgtttccgcaattgcggcggttaaatacagtcagcgaattgtggttacggcttcgactgactcggtagattttcgccatccaattgctgccaatgatagcgtcacactgacagcattcgtctccggagtcggtaccagatcaattgaggttttctgtcgagtcatgggagaaacgttaacgaccggaaagacttatttggcaaccacagcttttagcacctatgtggtcgttgatggtcaaacaacaccgctgccgagtttcactccggtaactgcagaagaacgactcttattcagtggctaccctgagcgtcgtaccgctcgcaaagcgcgccgtgatcgtaatcgtgcgttcatcagccagctagagacagcggaagacgacccacaatcgctaacccagaaaaattaaaaagaggctccaagatcccgttagtattcaggatcttggagcctcttgcttttttacttaattgttggccagtttcagtgttacgaaaggtcaatgacctatcgcttacgccttaaccggttccttcgaagcaccgttttctttatgcttacctttgttttcctttacggtaaaagtcaacttgccttttttggcaccgatttggatcaaatcaccggtcttagcttggcctgtcaacaaaagctcgctcagttgatcttcaacatcggtctgcaaagcccgacgaatcggacgtgcaccgtattcaggatcgaatccggcagccgcgatggcatcaatgcctgctggcgtaattttgacatcgattccctgatccttaatgcgactgagcacggtcttggtcatgatcttgacgatctcatgcagttcttccttgttcaggctgtggaagacaaccgtttcatcaattcggttcaggaattcaggacggaaactcttcttcaattcatctaacatccgactcttcatggctttgaagtctgcggttggatctttggcgccaaacccaaccgttttatcgtcgcgaatggcagttgccccgatgttactggtcatgatcaaaatcgtattacggaaatcaacccgacgaccctttgcatcggtcaagtaaccatcatctaagacttggagcaaaatgttgaagacatccggatgcgccttttcgacttcatccagcagcacaacggaatatggcttgttgcgaaccttttccgtcaactggccgccttcatcgtaaccgacataacctggtgccgcgccaatcagacgactggtgctgaatttctccatgtattcggacatatcaacccgaatcatggcatcctctgatccaaacatcgcttcagctagggccttcgccagctcggttttcccgacaccggttggcccaaggaacatgaaggaaccaattgggcgggtaggatctttcaatccagaacgtgcccggcggatggcccgtgcaactgcggaaacagcttcatcctgaccaacaacccgttgatggagaatcttctccaggttgaccaaacgttcggattccttcttttgcaactgggtaaccggcacaccggtccattgtgacacaacttctgctacatcggcgcctgtcactttgatatcggttcgaacgccactttcgttcacgggttccggcgtatcggcaagtttggccttaacgtccgcctctttggtgcgaatggtagccgctgtttcgaagtcttgatgatcaatcgcgtcttctttgtccgcgactaacttggccagctcgtcctgaagcttgtcggatttggtctcgacattagctttatctaatcgtaccttggcagcactttcgtcaactaagtcgatcgccttgtcaggcaggaagcgcgttgtaatgtaacgtgaggacaaaacaactgcttcatgcaaagcttcatcagtaatcgtgacgccatgatgcgcctcataccgtggacgcagccctttcaaaatctgttctgcttcttcttccgttggttcatcgacttggatggtcgcaaaccgccgttccaaagcagcatctttttcaatatacttttgatattcgtctaaggttgttgccccgatcaactgcaactcgccacgagctaaggccggcttgagaatgttggaagcgtcaatggcaccttcagcaccccccgcaccgattagcgtatgcaattcatcaatgaacaaaatgacattgccatctttataaatctcatcaatgattttcttcaggcgatcttcaaattcaccacgatacttcgtgccagcaaccagtgagcccatatccagcatcatcagtcgcttattcagcatgtcatccgggactttgccagcgacaatcttttcggcaaagccttccgcaatcgcggttttcccgacacctggctcaccaatcaacactgggttgttcttggtgcgccgagccagaatctgaatcagacgccgaacttccttttcgcggccgaccaccggatccatccggttttcccgcgccatttgggttaaatcgcgcgcaaggccatcaagtgtcggggtcccttgactatcttggcgcgcaccgccacgcgccattggccggcgtttggcagcggtgtccgcaatgcccattttcttaaacaccatttgtcgtgtcttcgaaagactgaggcccagattctggagaatccgcgcggctagaatatcgtcttcacgaagcaaccccagcagaatatgctcggtgccgatcttcaaagcacctaagcgctttgcttcgtcgccggcaaacgccagaatttccttaccctttggtgaataaggcaaataactatcgctagcttgaccggcggcatcaacagttccataccctgtgaagcgctcgatctcgtcatggacatcattctctgtgacccctaactgacgcagcgtcttaccagcgattccatctttttccataaccaacgccataagcaaatgttcagtgcctacagcatgatgatggaaatacttcgcttgttcctgggctaaaagcaaaacatttttagcactaggggtaaataagttgtccataagcacgctcctttttagaaaactaattataaactgttctatctttcataccgcaaacgatccaaaaatgcaaggaacatgcgcgaccgtaaatgctcttctgtcccttgatcaagaatgcccaaagtctcatgattcatgaccgccaacaacaaattacctgattgctgggaaataaggccattgtcaaacagttcctgaatcaaatcacgtgcatcgcgtaaccgcaagcgcttgggaatgtgctgccgcatgatttgaatgaaatcctgatcatctgtcaatttgaccttcacgatgcgaatgtagcccccgccaccacgtttactctcaacaatgtagccgcgagccggtgtaaaccgggtcttaatgacataattgatttgcgaaggaacgcaattaaaacgacgcgcaatctcggctcgccgtatttcaacggcggcctcctgtgccagtatcgtttttagataagcctcaataatgtccgaaatattctcacgctgcatgtcgttcaatcctttttgactttgaccaatcttgactattacacattatactggcattggtcagtttatacaaatttctgcatttgaaaacgaaaaaaggaccacgatttttcgtgatccaagaatcgggaagacaagattcgaacttgcgacccctacgtcccgaacgtagtgctctaccaagctgagctacttcccggtaaagcggaagacgggattcgaacccgcgacccccaccatggcaaggtgatgttctaccactgaactacttccgcataccgcatattaaattgatcggcgccagcttagcttcataggcgatcgacgatgcacccagtaggagtcgaacctacaaccttctgattcgtagtcagacactctatccagttgcgctatgggtgcttcaacaaaatgccgaggaccgggatcgaaccggtacggtcatcactgaccgcaggattttaagtcctgtgcgtctgccaattccgccaccccggcataaagtgaaaagcggaagacgggattcgaacccgcgacccccaccatggcaaggtgatgttctaccactgaactacttccgcatatcaaacctattcaattatgaccgaggagcggccttcaaagacccgagcattccgttcaagatacgatgcgggtgaagggactcgaacccccacggtcaaaaaccactagaacctaaatctagcgcgtctgccagttccgccacacccgcaaaaggtgggttaaatgagccgtgacaggctcgaactgtcgacccactgattaaaagtcagttgctctaccaactgagctaacggctcaatggaggatacagggc

SEQ ID NO: 330 - DNA, 119779 bp, Lactobacillus casei
ctcgataccggagtatcaaggaccctgcacatttaaacgaaactttgttcagttttcaaaggacgaccttgtcaaaagacaactttgatatattatcacaggcaagcaatacctgtcaataactttttctgatgctttgaagcacatcagcgttgctcatttacgacgcttattatcataccaacggtttgcgccatcgtcaacaacttttttaaataaaaatactatccgtatattatgtgtgccattggggattttcattcgtgaataagcctataataaacttactcacagcgcaatctttcggaaaacaaaaagtgccgccaaaatggcgacacataagtttaggttatgggcgcaatgtcgggaacaaaaggacatcgcgaattgaaggcgcatctgtcaacagcatgacaagacgatcgataccgatgcctaagccaccagttggcggcatgccgtattccaatgcctcaacataatcatcatcgataccttgcgcttcctcattgcctgcgctcttttctgctgcctgggcttcaaaccgttggcgctggtcaattggatcgttcaattcagtgaaggcattggcgtattccccaccgccgacaaaaagttcgaaccgttcgacaaaacgaggatccttagggtttttctttgcaagaggggacacttcgattggatgtccggtaatgaaagtcggttgaatcagtgttgattcaacaaactggtcaaagaaggcactgataatgtgaccgaccttccaataaggctcgtaatggacatcatgttcgtctgccaacttgcgcgcatcatcaacgctcatttccggccaaaagtccacgccggttttatctttaatggcgtcgaccatgttaatgcgggcaaacggcgcatctaggtcgatgtccatgccttgataggttaatttaccggaatcaagaaccttatgagcagcaaaacggaaaatgccctcggtttcagtcatgacgtcggtcagatcccagtaagctgcgtaggtttcaagctcggtgaattccggattatgtttggtatcaatgccttcattacggaaaacccgaccaatttcgtaaactcgttccatcccaccgacaatgagccgcttcagatgtagttcaagcgcgattcgtagataaagatcgatatccagtgcattgtgatgcgtgatgaacggacgggcattggcgccaccggcttggttatgcaacaccggcgtctcgacttcaaggaagccgtggttatctaaatattcacgaacagcactcacaattttggtccgtttaacaaaccggtcaaaactgtcagggttggaaataagatccaaataacgtttgcggtacttctgctcaacgtccgtcaagccatgccacttgtccggtaatggccgtaatgccttagccaagtgggtaacatggttggctttgaccgtcagctcgccggaatcggttttcatgacttcgccactgataccaagaatgtcgccaagatcggccttcttgaaaatcatgtagttctcatcgccgacaacatctttacgaacgtagatctgcattttgccactacgatcacggatatctgcaaatccgactttacccttgccacgtttggacatcatgcgtcctgcgatcgtcactttcggtttttcttcaagcaacgtttccttgtcgtcttcaccgaagtcttcgcgcacttgcgctgccgagtgggttcgatcaaaccgatgaccgaatggatcaatccctgcttcgcgcaaggcttccatcttttcccgccgcgcaatcatctgatcgttcatttctggttgctgtccgttttccttagccaacacatgttcctccgttccaatttatagcactctttgatgatgacaattttactgcgaaaaagcaaccttctaagcattaaaagacgctctcaatgattgattagccaacaaatcatcgcagaacgtctttttcgtctaaagctctagtaagttaatgactgcgctgacgctcgcgggcgcgcgcttcggtctgctcaacaaaatcgtcaaaaatatgatttacttcagcttgcgtatcaaccatgttaacggctgctttggtcttcgctgaacgcgggatgcctttcaaataataagctgcctgcatccggaattcgcgcacggcctgatgctcaccgtgtaagtcaaccagccgttgtagctgtaacttggcagttgcaattttttcccgtggtgtcggttccggaatcaactcgccgtcatccagatatgctgccatctgtttcaagacccaaggattccctaacgctgcgcgaccgaccatcacggcatcggcaccgacttcttcaagcatgcgtttggcatcttgcggtgtccgtacatcaccgttgcccataaacgggatcgtcagatgttgcttaacttcttttaaaatattccaatccgcatgtccggaataaagctgcttacgcgtacggccatgcatcgccagcgctgctgcaccaccacgctcggccgccagcgcattttgaaccgcataaatgtggtcttcatcccagccggttcgcatcttgacggtgaccggcttggaaacggcatcggtgactgccgcaaccatttcataaaccttttccgggtccagcaaccaatgagcacctgcgtcagttttagtgactttaggaaccgggcagcccatattgatatcaataatatctgccgcggtattttggtcgatgaatttcgccgcattaactaaggtttctttggtcccgccaaaaatctgaattgaaattggatgttcccgcggatccacaaacatcatactcaacgttttcttattcttgtacataattccacggtcactgatcatttcgcacacgaccagacccgcaccgaattctttggcggttacccgaaaggccgcattggtaaccccggccatcggggcaacaacgagtcgattgggaatttcaacattggcaatatgccacatacaagccacctctttcttgctttcgcgatgctaactttacttaaaataagcaaaaatcgcaactattcgtgtcgggctattaatgcttcaagatccgcaacgctgtaatgatactgattaccgcaaaacttgcaggtcgtctccgcaccgccatcttcatcaatcatttcctgtaattgttcatgcggcaaggttgccatgatatcgccaaaatgggctttagaacaattacatgcaaaccgcagtgactgggtatccaggaattgcaccggtgcatccccagcgatacgttgaataatttgctctggtgtcaggccgctttttaaaagttccgacacaagcggcaatgttttgacgttggcttccagtgcggacaattctgcatcatcggcccccggcaacgcctgtagcatgaagccgccagcgacctgaaccgagttgtcggcgttgacgaaaacggataatcccactgcggcaggaatttgttcggattttgccagataatacgtgaaatcctcggctaattcgcctgataccagcggcacttggccggtaaatggttcaccgatcccgatatctttggtgactgcaagcatgccatgtttaccgacagcacgggcgacgtcgatttttccgacaaggttgagcggcaaattgacgtgcggctcttgcacatagccgcgaaccgtgccgatctctgtgccatcggtgatgatagaaccaaccgggccatctcccttaatgcgcaccgtcagcatgtcatcacggttttttaatcctgaagcggacaataacgccgttgcaaccagcgtccgtcccagtgccgccgacgccgcactccaagtatcatgacggcgttgcgcctcgcgtactgtctccgtcgcatcgacagcaaaaattcgaaaatgcgtatcacgcgacaatgcgctcgcgatatagtcactcatgttgggtcctcttttctgaaagttaaacgtggctattctaccaaaaatgtgcgctattgaaaagtcagtgtactcatcagtatgcccgattgaagcccaacggcaccatttaagtcaaagtaggtttcgggtttacacgtttttccccattggcgatgcctatgcgcactatgtcaatcttcatcacgaaaattgcgccgaatgccttcttgatttcgaaaaacgcgtaaaataaaattattaattaaccttgaaaggacttggtatttttgatcagtcatatcggcgttatcctaggtacaacccgaaaaaatgcgctaggtgcacgcattttcaattatttaaaacaagcatttcccgacacatcagaggttcattacacgtggcttgatcttcgggattatccgttgccactttatgaccatcccgaaacgccactcgaagatccgattcaagagccaaccccaatcgaaacaaaatggttaactgcggtggccaaccaggatggttacgtgatattaacgccagaatacgatcacgcgctacccggcggtttaaaaaatgccttggatctaatcggtccggaagttgaacataaacctgttcaaatcattgggtattcgcatttttctgatggcggtatgctggcagcagccagtttagtgccgattttacaaatgctgaaaatgatcgtcctccccacgccgacgttactttggtcggccgatccgtgttttgacgaaaacgggcagatcaatttcgctgccgcgaacagccagcattttgcccggcgcttgcacgagacgatgcacgatattggcttttacacacgcttacttaaggaacacccgtaccaaccactagttagcgatactgcagctaaccaaacctcggcgacaaagtgactcaaaccacagctgacctctgaaatttttcatgataatgcgtaacaaaaaaacaccgcccaagttggtggtgtttttttgttacgcttgcggatcctgatgttcattgttgtctgaagaaccactgtcagccgacgtatcatctggcttttcgaggccgcctgtatcatcatcctggctggcatgatcttggctggcctgggaatcagattcggacttagcattggcttcttcatccgcttgcttctctttatctttgtgttcaagcgctgctttggattcttcgaaagtagcggccttttcgcttgggaattcgtcttgatcgcgttctggcatcttgccatcgttgaacaagctgaggatttccttttcgtttaaggtttcgtacttgagtaaagcttcagcaatcagcttatgctgctgacggtgggcctgaataatctcgtaagcctgcttatgggcttcgtcaatgatccgccgcacttcatcatcaatcgccgttgctgtcgtctcagaataaggtggtgtctggccatactgagcaccaaggaatggctggccctcggtttcgagttgaaccgttcccaggcgatcggacatcccgtactgagtgaccatgctccgggcaatttgggttgcctgttcaaagtcattggacgctccggtggattcgaccccgaagataatttcttcggctgtccgaccaccaagtaagccgacaatctgttcggtcaattccttcttggtcagcaagaattgatcatcttttggcagcataatcgcatacccacctgcacgaccacgcggaataatcgtaaccttacgcacagttcgcgagtcgcttaagaccagaccgacaatcgcgtgtccggcttcgtggaaggccaccatattgcgttcttttggactgatgacccggtctttcttcgccggaccggcaataacccgatcttccgcttcatccacatcggcagcatcaatggctttcttgcttcgtcttgcagcaaccaaggccgcttcattcagcaggttttccaaatcagccccgacaaaaccaggcgtttgccgcgcaatttctttaaggtcaacattcggtgcaagcggcttgttcttcgcgtgcactttcaaaatcgcttcacggcccttaacatccggacggccaaccagaatcttccggtcaaatcggcctggacgtagcaacgccggatcaaggacatcagaacggttggttgcggcaatgacaataacgccttcattaccggtaaacccgtccatttcaaccagcaactggttcaatgtctgctcacgttcgtcatggccgccgcccattccggcaccacgctgacgaccaaccgcatcaatttcatcgatgaagatgatcgaaggcgctgcttttttggcttggtcaaaaagatcacgaacacgggaagccccgacacccacgaacatttcaacgaagtcagaaccggaaatcgagaagaacggtacaccggcttcaccggcaaccgccttggctagcaaggttttaccagtaccaggaggaccctcaagcagcacaccggctgggatgcgggcacccaatgccgagaacttccgcggatccttcaggaactcaaccacttcaaccagttcctgcttctcttcttcggcaccggcaacatcggagaaccgcactttgttggcatttttatctgcctgcttagcgcgtgacttgccaaaactcatgacccgaccagaaccgccgccttggccagcctgattcatcatcatatagaagaagatcatcatgatgacaatcggcacaaccgtgatcagtaagctaaaccagaccccagactgtgattcttcctgggtatccgttttaacattgttagcactggtcatcttctgaatctggctcaaagtcgcgtcgttcgtcggaatataggtggagaacttcgtcaccttggtcgtctgattgccaaataaactcagtgaattattcgcaccggaagacttctgggccttcttatattcaccgctgactttgtaaacgccgccagatggctggagcgaataactcttgacattgtccttctttaattcggacatgaaggtgcttgtttcaatttcttgggacgatgttgtcccattatcgcgcatataatacgcaaaaccggtgaccagcagcacaaaaatgatgatatacgttagtgtgctactgaacaggccgttttgttttttcttcatttagaacctccggcaacattcaattagtaccttatatactaccacaaacccggcgcacagattaagattttgccgcgtagacttctggttttaataccccaatataaggcaaattacgataacgttctgcgtaatccaaaccataaccgaccacaaactcattaggcaccgtggttcccacgtaatctgcctgaacatcgaccacgcgtccctccggcttgtccatcaaggcgcaaatccgcacagacttcgctttacgggttttaaagatatcggttaagtatttcagggttcgaccggtatcgacaatatcttctacgatcaaaacgttccgatccttcacacttgcatcaagatccttgataatcttgacttcgccgctagattcggtcgcgtcaccgtagctagacacatccataaagtcaagttccatatagtcatcaatctcacggacaagatcagtcatgaacataatggcaccttttaagatgcacaccactaagggattcttccctgcgtaatcgtgcttgagttcagcgccgagccgcgccgtgatggcatggatgtcgtcttgagagtacaacacctttaaaatatcgggattcatcatctatcctcacttctgtcaacatctggcgagtgcaccagtacaacatggagtatatcagtttgagctgggggcgacaatcgttctaaaggctgaccttcaatccaaaaaacctgatggtcctgcgccaataaaagtaattgatcacgttgacttgccggaactttttcattaataaaaaaacgccgcaatttctgggtcaccccatttggcagccgaacttgatcaccggcttgacgggtacgcaatgtcaccggcaaccgcacctgtaccggcacgcctttgcaatgcaatgcctctgtttgtaaactaaacgttccacgcggggttttcacagtctgcccaatctgcgtaaacgtcactggggtcattgccggttgtaaaaccagtttcctgatccggccgttctgaacggcaatgatgacaccgatgccaagatcaaagcggtgttcgctttgagcaaacaaatggtgcataacctctggcagtagtttttcgtcaacttcgggctgccactgccgcaacatcctttttaaaagcacaaactgcaccgcttttggcagacgcgttgctgcttgccagtcaatcgtcaccggatccacttgcaaccgctgctgccatcgactgacttcagcatctgccagtgccagcatccctgcttgctccaccgtaaaccgttgaatgtgcgccaacaattgcggattttgccttttataggcgggaatgacctcgtggcgcaattgattgcgagcataacgggtatcgttattcgaggcatcatcacgaaattcaatgtcgtgcgcctgagcatatgcacgaagcgcggccttactataacctaataaggggcgaaccaaccgtttcccatgccacgactgatccgcccgaatgccaaccaacacggccggatcaccggaacgccccagccgaaacaagactgtttcaagttggtcatcggcatgatgggcagtcatgaccacggtcgcatgctgtgtctcggcacttgcagccaaaaactcatagcgtgcctgacgcgccgccgcttcgctcgcagtatccgtcgactcgcggtgccaaacaccggtgacaacgggaacatgataccgcgctgcagccgccaccacaaatgcttgttcctggcgactttccggccgcaagcggtgatcaaaagtggccacaattacatccagatccggtgcccgaaccgccagatccaacagcaccattgagtcaacgccgccggaaacggccacaagcacacgggtatgcggtgcgaaaccgaatgtttgaaaaagtttcgggctcatacgtctcctccacgttaacctcgtctcagcattaagtcagtcaaaaaagacaatccaagaaaataggcccagaacaaatcataatttgtcccagacccgatttctaactgcgccgaccgcctcggccgccgcgtttgccttcggtattacgacgaagaacacttaaccgatcttcgctttctttcaaataaccggacatcatcgcgtcaaaatcacctttagccggttgttgagctttatgaccaaagtgattgccaccattgcgggcaccaccctggaaccgattattgcccggatgcgctgatggcgcgtgccggccttcatgatgattgttctcatgttcacgctgttgcggcttatcaaccgctttccggatagacaggccaatcttaccatcttggatcgaaagaactttaaccgtcaccggttcgccaacatgcaacacatcatgaatgtctttgacataagcatcagagacctcgctgatatgcaccaatccggttttcccatcgcctaactcaacgaatgcaccgaatttcgtgatcccggtgaccttaccagtcactttcgtaccaacttcaactgccataaaaaaagaagtcctcctaattaaatgtgtctataagtatagcatgggtaacaagacacgcaagcagcgcgtgaacctgtcacaatcaaaactgtatgccactcgcgcacgcttcaagcataccactcaatcacaaaccaacaaactaccgaaacatgacaagatccattcgccgacacaaaaactgcgccaatcagggtcaaaaagctcattgactgacgttcagattcggaatcttattggctttatccggcaagttgaaaatcacctcaccgggttttgaatacagatatttctcccgaatcaatttggccgtgtagtcatcattgtggagctgatcaacctggactttaagtgcggctttgttggcctttagtttatccaagttagccttggctttcgtcacggcatgattggtttcacccagtgtcatttgcgtccgaaccacactaaagccccccagacctaaaattaccaccatcagaatcagcaaattccgaatgcgtttcatatgtaccgcgtgtgcccgggacttgggcgcacgctgcttttttgctgtgtgctcacgcgtatacgcattatttaattgactgatattattctttgccatctgatcgcaccctcgttttcaccagccacgtgttacgacttcagtaaatcaagtataacaaatcaaaggggctacagaccaacaaatccgcattaaaatgtttctttataattttctttcagcaccgtgtacatgtctgccgcatcgtttttcttggttgtttcgaccaaatcatcggcgcgcaccgtcagtgttttgttgccaaagttaatgaccagcgtgtcgcctacactcacgtcgctactggatttggccactttaccattgatcgtgatgcgtcctttgtcggcaatctcttttgccgcggtgcgtcgtttgataattcgggaaactttgagaaacttgtctaaccgcatatctttacctcgcttttatttttcgtacaaattttaaatactttttaccgccgggcagatcaagcatttcgcgcaacgtcaaaagtttgaaccaggtacctgtcagcaaaaagacgatgacgccgagaaccacgcctaatatggtaacgccaagcgcaaccagccgtgagctcaacggaatccaccccactgccaggtaaaccgtcaacaccatgagaccggttaccacaagcaattttggcacaaacagccgcagcgcacttctgcctttgatcgtctcaggaacggcataataaatcaagcaaaggatcacgcccaatgccagaatggtcgcaccactggcgccggccgtcccaaaccgggcaaccagcggctggttaatcccggccttgatcaaaataccgatcagcagcgccacgctaatgcccttataccgatccaagctctgcaagatggcgttatacgcattaatcatggcaacaacggcaatcgcaatggcatacagttgtaagacaaacgcgccggcggtatcgccaaaaagcagtaaatcaattgccggcatcaaaacagccaacccagaagtcgccgcaagcgcaaaggctagattaaaatgcaccaattctgcgccacgttgaatgaattgccgacgttgctgtagctggcgcgcctgggtcagactaggcagcaaagttgtggacagtgaagccgccaccacaagccctagctggacaaggggttggccacggtcatagatcccttttaaacttttggccgttgccatagcaataccggaactggtcaagccttttgtcactgtgaagctgtcaaccagttgtaacaaaatcagcagcgcggcatacagtgtaatcgcgccgccttccctgacgaagcgactaatcaggtgggcatatgcctgaacgccaggaaaacgaaagcggcgacgaccaaatacccggtgatacggccgccacaatgtcagcactgctgccaagccgccaaaaaaggccccgctcatggcaatagcacccatctggtagacactccaatgatattggacgaaccaccatgcggctagtaaaatcacgccaacccgaacaatctgctcaaccacttggctcgtggccgttttcaccatatcaaaagtgccttgaaaataaccgcgtcctgtcgccaaaaccggcatcgtcaggaacataaacgccacgatttggattaacggtaacaattcgggatcagccatcgcgcgggcaatttcctgaccaaaaaattcaaggcccaaaaacaacgcccacgaaacccagttcaaaatcacgttgctctggtgagccaccgttaactttgcttcgtcaccgtcagcttccgcgacaagtttggaaatataaaccggaaatccggacaacgcaaacgtcatccctagcccgtagatagggtagatttgctgataagcgtaaaatcccgtgtcgccaaccatattctgaaatggcacccggtaaactgcgctgaggatcttggcaatcagtgagctgaggctcaagatccaggcaccgcgcattaaatacttcatttgttgattatgcatggtggtctcctgttaacgtggttacagctgaccgctcgattcgcgaaacccctgctggtcaatcataaggcattaagctgccggctttttctccggctggggattgacaacgttcaccaatccctgcataaaagctgtcagttgcgccaaccaggtcccggcctgcatggttttaggaattgtcaacgtcacggtcagcttaccatcagcaatcgcaacctgagctttaagcgtggttgcggccaacgccttaaaaataggttcgccttgcgctttagtggttgcttgcggcgataacacaaccgcaattttttgatccgtcttttgcacgctattgacccatgccaagtcggcaaaccgtttgagatgcgcgatcgccagcaggttggtcaccggctgcggatagtcaccaaaccgatcaatcaagtcttcgctgatttccgtttcggcttcatcgctattggcttcacgaatccgtttatacagttcgatcttttgccgcgaatcagccacatagtcggtcggcagataagcttccaagccaagatcgatttcggcatcggtcttctgcgccgttttaatcccgcgccgtttgttcaccgcttcttggagcatctgggtgtacagatcgtaaccaaccgaatcgatgaagccatgttgctgcttgcccaacagattgccggctccgcgaatcgacaggtcacgcatggcaattttgaagccactgcctaattccgtaaaatctttaatcgcctgcagtcgtttttccgcctcctcattaagcaccttcatcggctgatacatgaagtaggcatacgctatccgactcgaacgaccgatccgtccccgcagttgatacaactgagataagccgtaatgatcggcattttcgataattaacgtatttgcattcggcatatcgacgccggtttcgatgatcgtcgttgtgaccagcacatcataggcaccgtgcagaaaatcataaatgacgttttccagctgcgtttcggtcatctgcccatgcgcgtagccgatactggcatctggcaccagctcttccaactgactcacggtgcgctccatatcttccacccgattatgcaggtaaaagacctggccaccgcgctccatttcgcgttcaattgcctcgcgaatcaccccgggattttgttccatgacaaatgtctggatcgggtaacgattggtcggtggtgtctcgatgacactcagatcgcgcacgcccagcatcgacatattcaaggtacgcggaatcggggtcgccgtcagcgtcaaaacatctacgttgctttttagctgtttgatgcgttctttatgcttaacaccaaaacgctgctcttcatcgatgaccagcaaaccaagatcacgaaaagccacatcttttgacaacaaccggtgtgtcccgacgacaatgtcaatcgtgccattcttcaagcctttgatggtctctttattttggtgcggcgtctgaaaacgggacagcaacccgactttaatcggaaaatcggcaaagcgttctttcatggtgtcaaaatgttgctgcgctaaaatcgtcgtgggcaccaaaatggccacctgcttgccataatcaatcgctttaaatgctgcccgcaacgcaacttcggttttaccaaagccgacatccccgacaagcaagcgatccattggcttcggtttttccatgtcgcgtttgatttctttggctgaccgcaactgatccggcgtctccggataaggaaactcgtcttcaaatttttgctgcaagtcatcatccgggccaaatgcatagcccttttctgcttcacgtttggcgtataaatcaatcaactcatccgcaatgtcttcaatgcgggccgccactttgcgtttggtcttctgccattcggtgccacctaacttattgacgcttggcgccttgccgtcagcggagacatatttttgcaccagattcagctgatcaaccggaataaaaagcttgtcgttattgcggtagacgatggtgatgtagtcgcggtgaacgccgtcgacttccatcgtctccatcccggtatactgcccaatcccgtgattcacgtgcaccacataatcgccaggcttcagctcattgtagctgcgtaaccgctccgtattggccaatgtctggtgccgtgcccgccgtcgctgccgtgcattgaacaactcgtgctcggtgacaacgaccagcttcatgtccggcagttcgaagccattcttcaaactgccttccgtcaattgaacctgacccggcaataaatgattgggttcggtcagaacattgctaatttcaaaatctttcaacgttccgctcagcttatctagccgatttttgtccgcaatcagaaaaaccacggtttgcttttgtttcacccaacgatcggtttctgttttaagcaatggcatttgactaaagaattgttgaacattgcgactcggcacattggtcaggctatcaagccgcaattgtcccatacctttttgaaaaaggcttaaatacagccgtgggtgcggttcgtgttggttgagttcttgaattttaggattaggtgtcttaggcagcagccgaccttccgtttgcaattgagcgtaccactctgcggtttcctggactaaatgggtatcgctatccagtaacctgctgtaatcgtcaaagacaacgagtgcatccggtgtgaggtagtcggtgatgcgctgatgttccggataaagttccggtgcatacagagccagattctctggccgctccagtgcctgcaactgctggccggtggttaaaagtccatcagtgattgcttgcttggtatccgcatctttgaccttggccttataagccgttgcctgcttcacaagacgctcaccggtcgcactcagcacttgatctgacgcgatcatatcggtcgccggggaaatcacgatgcgcgttagttttttcaaactacgctgcgttgcaatgtcaaaagtacgaatcgaatcgacggccgtatcaaataattcaatacgaatcggatcatcctgattgagtggatagatatcaataatgccaccgcgaatggcgaattgccctggcgcgctaaccagtgaatcgcggcgataccccatcgcaatcaattgcttggtaatatcttgtggctcaagctctgaatccatatcgatgaccagctcactagccgcccaaaccgctggcgccggcaaaatacgcttgtacccagccaggctggtcacaataatgccaggcttaccgctttgcaagaaagttagtgcattaatccgatcattgcgggtctccggtgagctcactgcaacttcggcagccagcacgtcttcaaccggaaaatcataaaccagcgcatcgcctaacaaactgctcaagtctgccgctaattcgtcagcgtgaaaacgattattctcgacaatcagaagctgttgctgacgttgttgcaagagcgcgccaaaaaagaccgtcttggcggaacccgaaagccctgtcaccaaatgacggccggttttgagtttaggccataatgccgacagttctggatctgcctgcaccatgtcgatcaaattcatcgcttcacctgcttctttcctctacttaaagtttacctaatcgaccgcgtgcgatcacgatcaagccgccgacttttaattaaacttattcatcagttgcggaaacggcatgccatttagccagtcttccaacgcatcatctgctctgttaatcgcatcatcgatcgttggctgatcggcttgggaaaagggcgtgagcacccagtcaacaacccgctgtcgctgagggtgttgaatgccgattttcaaccggaaaaattcatcgctgccagtcgcgctgatgatatccttaatcccgttatggccacctgctgatccgcgttgccgcagccgcaatttgcctagcgtcagatccatgtcatcatgaaccaccaggatttcatctaaccgaatttgatagaacatcatcagctcacgcacggcccgccctgaagcattcatataagtctggggcttcaccaaaaacactttttcatcatgaatccgggtagtcgccgtggcagcatcaaattcaagcttatcaagtttgagtcccaaacgtttagccagttcgtcaacgaccataaaacccatgttgtgtttggtacctgcatattttcgtccgggattacccagaccaacgatcattttcattttgtctccttaaattagtgcttttttcaacaaccccggttgcctgtggttggcacccttttggcaacagtgacaagctacagttgcttttctaaccgtgtgtattcttgcgtaaccaagccaagcgaaggacaccaaacactaaccaacatcacaaggttaagcgcttggtgtcacttcgctatacaccgtcatccacatactgggacgtgaatttctattagtatgcagtataacacatcaggactgattaactgtacacattcattttgtgaactgttaagcttttgctcctcgtgaaaatcgctcatgcaagcgttttcgttcctgaaagcgagcttgtcacaggattcacaagccttgctattgtaaggctgagcgcgactttttaaccatggcaaaattatgaaaaagtctgtcaattttgtttcggcgaattgataatgtgttatactcacaatgaaatgcagtttgcatgcacataagaaaggatgatatcaccgtggcaagtattacggataaggatcaccaaaaagttattctcgttggtgacggcgccgttggttcaagttatgcctatgcaatggtattgcaaggtattgcacaagaaatcgggatcgttgacatttttaaggacaagacgaagggtgacgcgattgatttaagcaacgcgctgccattcaccagcccaaagaagatttattctgctgaatacagcgatgccaaggatgctgatctggttgttatcactgctggtgctcctcagaagccaggcgaaacccgcttggatctggttaacaagaacttgaagatcttgaagtccattgttgatccaattgtggattccggctttaacggtatcttcttggttgctgccaacccagttgatatcttgacctatgcaacttggaaactttcgggcttcccgaagaaccgggttgttggttcaggtacttcattggataccgcacgtttccgtcagtccattgctgaaatggttaacgttgacgcacgttcggtccacgcttatatcatgggtgaacatggtgacactgaattccctgtatggtcacacgctaacatcggtggcgttaccatcgccgaatgggttaaagcacatccggaaatcaaggaagacaagcttgttaagatgtttgaagacgttcgtgacgctgcttacgaaatcatcaaactcaagggcgcaaccttctatggtatcgcaactgctttggcacgcatctccaaggctatcctgaatgatgaaaatgctgttctgccactgtctgtttacatggacggtcaatatggcttgaacgacatctacattggtaccccagctgtgatcaaccgcaatggtatccagaacattctggaaatcccattgaccgaccacgaagaggaatccatgcagaaatctgcttcacaattgaagaaggttctgactgatgccttcgcgaagaacgacatcgaaacccgtcagtaatcatcatcatgactgagtctagaacagccgggcaactgcccggttgttcttttttaatctcgaaaaacaattaagaacttttggggattcctttcacttggcagcaacgtaaaagtataatgttttttttaagttcccagatgccgcttcattaaagggcggtgcccccacaatgcctgtagctgaacgaggcgtgccgcttttaattcttggcttgttaccttataataagcagaaacaatgtcattttttgaggaagtgcttgctacgaaacaggaacacacaaggagcaggaggcagcgatcagtgaataagaataaacggtggctcctcgttgtcggcgcgctagtcgttcttctaggcggattttatatcgtccggagcatgcactatcgcgatcattttttgcctaacacggaaattctcggaattgacgtgtctggtcaatcggttaatgcggccaataagaagctggtcaagcagttcaatgaacgtcaatatacgtttgttgaagacgataaaaaagtcatgaaggttaaaggccgcgctttggggctaagccaggatttcaaaaaaggtctcagtcaggcactgaataagcaaaatccgtggttgtggaccacttcgatttttgcgggtcaaaaggctcatgctgatgaggatccttcgattaacagtgttgccctaaaacagtttgcggacaccactgccaataaactgaaccaaggacgccaggaaccggtcaatgccaaactcgttgcagatggcacccagttcaagattcaaaaagaagtcaacggtaatcagattgacgctgataaacttgctaaaacggtaacgaccgccttggataatcatcggcaaaccgttaatttaacggatacgtacaaaaagccgaccgttaaggcgtctgacagtagtctgcaaacgacagaacgggatatgaataagcttgccggaaccaaagtgtccttgcagattcagtccaagactgtcacagttcctcaagcaaccgtgatgagctgggttaccaacgacaacggcaaggcaacagtctccagtcaggccattaccaattatgtctcgacgctatcacagcagtacagcaccattaataagacccgtcagtttaactcgcaacagcaagggacagtttcggttcctgctggcacgtatggctggagcattaatgtcacctcgaccgcagcgatgattcttgccagcgtcaaagccggacaggatcttaacaaggaagtcgtccacagcggttccggttacgcaactgacggcgatatcggcaatacctacgttgaagtttcaaaagagaaacaacacgaatggttcattaaagatgggaaggtcgtcatggattccgatatcgtaaccggtaagccgagccaggaaaccccatctggggtcttctacatttggtcaaaacaacgcaatgcaacgttgcgcggcaaaaacgatgatggtagctcctatgccagcccggtttcttactggatgcccatcgattacacgggtgtcggtcttcacgacagcccatggcaacctaaatacggcggcgactggtacaaagaacacggctcccatggctgtgtcaataacccgcctgatttcatggccaagttatatgccgcagttgatgaaggaacgccggttatcgtttattagttttcagtcagtaacatcttaaccaacaagaaatcggctcataaggcgaacccgtcccttgagccgattttttgtacccaactgttaagcaacatccggcgctgactttttacccggaaagaccgttacaccgtcaaaaaactatggtatcataggacaagattagaacattttaataaagtgtgcacctttgatggaggaaaacgaatgttaattaagtcgttagtattaaaaaaggaattcctgaccactgtcaaggaaacagtcacccttgaagaagcattgaagatccttgaagactccggctttcgttgtgtgccgatcttggatgaaagcggcacgatcttccgcggcaatatttacaagatgcatatctatcgccataagtcccaaggcggcgatatgagtctgccggttacttatctgctgaagaatgcgaccaagacgattccggtgaatgccccattcttcaaagtcttcttcaacatcaaggatctgccttacattgcggttttggatgaaaatgctaatttctacgggatcctcacccatgccaaattgcttgggatgctgtctgaagcttggaacgtcgacgttggctcctatgttttgaccgtgatgtccaccggtgaacgtggcgacttggcaaaaatgagcaagattttggctaagtatgtttccatttccggctgtatcaccttggatgccaaacgtgacgaattcgttcgccgaaccttgttcacgttgcctgcagggaccgatgaaaatacgctcaacgaaatcgtctcgcgcttagagaaaaagagtttccgcgtagttgaaattgacgatctacaatccggacagccgattcgggtagacgaagaattgtaatccgattttaaaaagctcggcaacgttatgactactgccgagcttttttatatgatgagcgtgaactggcgcggtcagaagcctattagcgttggcgccaattcggtttactggtttaagcgttgcagatcctttataatacgttggcataagtaaccaggtctaatgatcgtgacacggggaggaaaacctcgcatgaaaactctgacgcatttttgggatcgaatcgtcttcactgttcgtttccttcgtacccatcatttcaaaccaaaatttcgaaaacagctgtttttcttcgctgtcttggtaccagtctgtttggtgaccatcatcaccggccaacaagtagaaaaaccggttcctgctgccaccatttttcgcaccggaacaacactcgccaaggtgagccagtcttcacatcagcctactagcaaagtcgcgcttaacgttacaaagaaaatcgactggcaagctccctctgaaaatcagccttatcccgacttgacgcaacacccgcacctttcgctggttgtcagtttgaacaagcaacgggtattcgttaaagatggtgctaaaaccctttacaccatgtatgcttcaactggtatcgacgactcgacaccgcatgggcactttaagattcagtctgaacgcggctatgactttttcaatcctgaagaacaaatgggcgcgcattattacacgagcttttacttacacggcacctacttattccacaccgtgccgactgacatcaatggtcaatatattgaatctgaagcggccaagttgggccagaagcccggttcacatggctgtgtacgcctcagtattccagatgccaagtggattttcgaaaccgtcccaactggtacgccagttgttattgaataaagcaaaaaccgcacctacctcagttgaattatcactgagatgggtgcggttttttgccaaaatgatgcgttaatttttattatatgtttttggtttgggcaaactaacgagccctactgaaattgccaacgcacgatcaacggccgccatttttgcgcttgataaagctgtcacgcgcgcctgtaatcgctgcttatcgatggtgcgaatctgttctagcaaaatcaccgagttacgttcaaccccgtcttgctttgcccgtaagccaacatgagtgggcatcttgggtttttggatcttggaggtaatggccgccacaataaccgtaggactatagtggttgccaacgttgttttgaataataagtacaggtcgattgccaccctgttcggatccgacaaccggcgataaatcggcgaagaagacatctccgcgttttacggttacatccatgcttttgccccctcgttgcttatcgaatatgggcgtatgcctcactttcgcaggcggagaaagcatgactgatctctgtattgatctgtcccatggcaacatagccggaaatcagctggttgatatcgggtgcttgtgactgcaaaaatttggccactgctgttgtgatcacatcttgagtatccgtgtcattcaactcacaataggcatctaaccgcgccttaatagcagcatcaaacgttaccgttactgacgtttgcttcttcatgacaacttcctccaacttcccaagttcatgttgctactttatcacaaaatcgattcaggagctaccgcacttagctgatcatctgaaaaactgtcagcttattcgccaatcgaattgatactttgccgtttcaaccttggcgtcaaattgcaggcaatctcataatgaatcgtgttgctatacttagcgacatctaagagcgtgatttcctgatcgccgctttgcccgatcaaaaccaccttggtccctgctggataggcttttggcagacgaatcatgaactgatccatgcagattcggccgacaatctcacatgcatggccatcaaccaacacatggaatccttgcagtcgccgcagccacccatcggcatacccaatcggaacggtaccgataaactcgtcccccttagcgcgataggtgacaccataggaaataccgtcaccagcatgcacctgtttgcaatacgtcaattcgctctccagcgacaaagcaggctcgagtggaaaaggcgttgtcggaatcgcatcaccggatgggttcaggccataaatcgccacaccgtagcgaatcatgttgccgttacatgccgcatgccacagactggtcgccgagttcgagacgtgcacgtaacgcggtcgagttggcaataagtccaccatgtgattaaacttggccacttgctgtttgaaataggcatcgtccggatcatctgctgtggcaaaatgggtgaaaatgccttcaaccgtgaactgtttgggatgttcctgaatgaacctcagggcatccaaaagtgcctgatcttccgtaaagccaatccgccccattccggtatccaacgcaagatgaatgcgcaaaggcggcaactccggttgggcttccagcaccggtaatgcctgctcgagccattcgacactgctaatcggtaacgaaatcgtttgtgccgcagcaagcgcagcatactggcttggcacaatgcctaaaaccagaatcggctcgacaaaattggcgtcccgtaaatctaacgcttcgtcaagcagcgccacacaaaagccgcttgcgccagcggctttcgcaacccgtgccacacgcaacatgccgtgaccataagcatcggctttgacaacggcaaaaagttgggtcttctttttcaaccgcgccacctcatgctggacattatgcaaaatagctgtttcatcaattaaaactgttgctggtcggaagttaccgatcgtcacgttcaggaccttctttttctaaaattacctcggtgaacaccaaagtctcactgtgagaaatggaaacaaacgcattaccggaaaatgggtgtttcgtcagaatcggtttgccaagttcgttattcaaaatttcaacatcctgcaaagcaaccttgcccagtccggtaccgaaagccttggaataagattccttcgctgaaaatcgcccggaaagatactccacggcacggcggccatccaattgttgatagtttgctaattccacgggtgtcaaaatttttgcggcgaatccatggttcttttcctgggcggcttgaattcgtcctaaatcagtcacatcaaccccgatgccataaatcatggttggcctccaataaacttgataaaatcattttagcatgctttgattaaaaatcggccatgttcggcaaattgcctgctgcatctgtttgtttagctacaaataatctgtccctccggcgctacatatcgccatgaagaaaaccaactttctttccattaaaaaagcaccgagacgatatcagccccggtgtctgttttattttaaccgtcaattttcgtgttaggaactttgactcgtgaaagcttattcgcctgaacgaattttgaagttacgtttgacattcttacgtttgtcgccgaagttgcgcttcttgtcatagttgcgccggccgtcacggttgccttgatagccgccttcgcgccgcttacctttgtagccgcctttataaccgccaccacgattgtttccgtggccgtgattgttgcgaccgcgatgtggcagtggccgttctggtgtaattttgaccggaaccgcactggcatcatccgggctgactgctttgaggtaggcagaaaccaattgtagcggggtatagttttccaaaagcgtttccgccatggcttcatacttttcggtgtcgttggcttcgacttgttctttgatcgtggataagccgctggaaatctggcccatcaacgcttcttcagcggtaggcggcttcatcggcaacatccgcttcttcgtcaagtcttcgatcgtgtgcaggtattcaatttcattcggtgtgacaaatgttaccgaaacccctttgtgccctgcacgaccggtccggccgatacgatgcacatatgaatcaggatcttgcggaatgtcatagttataaacatgcgtcacgccggaaatgtctaatccacgagccgcaacatccgtcgccaccaaaaagtccaattggccactcttgaattggcgcaacacgctcatacgcttttgctgcgtcaaatcgccatgaatcccttcagcgcgataaccacgtgccttcaagccgcgggttaattcgtcaacgcggcgtttggtccggccaaaaatcaatgccagatcaggatcctgaacgtcgaacaagcgcgtcatcacatcgaacttttcatagtcctttgcgcgaacatagtattgttcaacggtgtcagcagtcagttccttggccttaatcttaacaacaaccgggctcttcatgaacttgttggtcaagcgcataatggctgccggcatggttgcagaaaacagcaatgtctgccgttctgtcggcatctgttcaacaatcttttcaatgtcgtcaatgaagcccatgtcgagcatttcgtcggcttcatctaataccaaggtatcaaggtgttccagtttcaaggtatgacgcccgatatgatcaagaatccgtcctggggttccgaccacgatttgcgggtggtcagcaagctgacggatctggcggcgaatatcagcgccaccataaacagcttgcaccttgatcttcttgtcgcgacctaaacgataaagttcttcttgggtctgaatcgccaattcccgggttggggaaatgaccagtgcttggatactccggtcagctttatcgatgtgttgcagaatcggcaagccaaatgctgccgttttcccggtaccggtctgtgcttgaccgatcacatctttgccttccagaaccagtgggatcgtctctgcttgaatcggggtcgcttcttcaaaacctgactgtgcgattgcctttaagagatcatgatccaaacctagttctttaaacttcaaatgagttcctccttgagaattcctgcacgcgtttacccaagcgtgttttcaaggaatccgcgggcatcacgtgcattttcagtaaatgacaaaaaaacatatctcaacaacaatagcacgttcacaattgaaaaacaagaacgagtgtcattgcagaattgtggcggtaatggactcacaatttccgaccaaacgcggcggtgtcgcgatgatagcgctttgatactgaggtacggctgtttattttatgaaatttacaagataataaaagacgaacacattagctgctgttcgcctttgttcaatgcaattaaattttcatttagaaaacgcacccgtgtcaggcgtgacccccagcgatcagcgctcccaaaaccgtttccagatgcaagccgtgacttgcctttaacagcaccatgtcgtcatggccgacgtcattttgcaaatcgcgaatcatctggtctttggctgatagcgggtaataatgcaggttatcgggtgaatacttgtcggccaaagcatcggccagtgcgtgcatctccgacccatataggtagacaacttgcacttcatgaggatcaagggcatcggccaagcctgcatgcagcgcctggctttgatcgccaagttccagcatgtcgcctaacactgcgatgtgccggccggttgccgtaaattcactaaaatcacggatcaccgcccgcatcgctgttggattggcgttataaacatcactgagaatttgttcgccagcatcaccgatcagccattgcgtccgattggcagtcacctgaaaatgcgcgagtgccttttgcatgacctcgggcttaacatgaaattgtcggccaactaacaacgccgccaatgcattcaccacgttatattcacccataatcggaatcgagaaagtcagatccggccactgttctaccgtaaactcggtatgattgcgatggccgttaatagaatgtgcaaacaaggtattttccggatgtaaaccaaatgtttcctgcttttgggtaacttttttggcgcgttccacaagtaatggctcatcaccgttgtagataaaagtaccgtcctcttttaagccatcgatgatttccattttagcatcagcgattttagcgcgggttttaaagaactcgatatgcgcttcgccaatcatagtgatgaccgcaacatctggttcggctaaggaggacaacgcgtgcaactggcccggatgatccatgcccatctcaaggaccagcacttcggtattaggctccatactcaaaatcgtcatgggcacgccgatttcgttgttataattatccggcgttttcacaacatggtattgcgtcgccaaaatcgccgccgtcatatctttggtcgttgttttcccgttgctgccggtaatggcaacaactttgggattgaccttcatcaacaagtaatattgggccagctgttgcatggccgtcagcggatccgaaacaaccaaggctggcagcttagtcttgatcggtgcatgatttgccgcaacaaacgtcgccactgcccccgcagcagcggcagccggaataaactcatgaccgtcacgttcaccttgtaagggaacaaataacatccctggcttcaatcgacgcgaatcaaaggtcaatccggtgaccacgcgcgaaccatccgcctcagaaagcggctgggctttaacgacacgcgcaatctctgccaatgtcattttcatcattaactcgactccaattcttaaacgtagagcgtgagctgggccggttagaaaccggagcataagtggccttgggcgtaatggcccggccttggccattgcgaccaaggtccttatgtgcaggtttctggcccagcgaacgcgttttcaacagagcgtgaaccggcgcgcttagaagccggagtgtaagtggcctcaggcgtgatggccgctctttggccattgcgaccgaggtccttacacgcaggcttctgcgccggtgaacgcgtttcaacaagagcgtgagctggcgcgcttaggagtcgaagtgtaagtggcctcgggcgtgatggcctgatcttggccattgcgaccgaggtccttacacgcagactcctgcgccagcgaacgcgtttcaacatacagaaaaaaggccacatcaaccctttcccagtcaaacatattcattataagcaggaaactgcccttttgcaggcagtctcttaaagttacgcttttttggcagtttcagtcggcaccatctgccactgatttttctgacgcatcaaaaccagtttgccaagcttccgaacggtattgtcaggaaacgcgctatccgggataaaccgattgcttggctcaagtaacggaattctgatttgttcacgggaaaaccgcacattgcgaaaatcaaaaagcaccccatcctccattaatggaaacagctgggtataggcttcatctgacaaaggtgaaaagtgctgttgccgcaaccgtaaccaaaatggttgctcgttggcaatgcgtcgcaaatatttgttaattgctgcggccaaaaaggcttcgaacaacgcctcatgccgcaaatacatgttcaccatgccattacgcaacggcaagtaaaccaattcattttgtagtttataataaaaaggtgaactgagatgcgttttgacatgtcctaagtatagcagttctgcaatctcgttaggggtcagttcctgcaaaaaacgcggacgggcataatctaaccaacaacgtgtttgaccctctttactccgcagaaactcgcgcacttgatcccgtccgttgataatattaaaccaagtatgcggatcaatctgttcctgttcgttaaccggtggcaataacagcagatgatttgggattttttgctgactgttcagcaaatcacttgccgaaataccataagtcaaaaataaatgtgccaacggttcgtgatgaacataaatcattgcgtttcgcatgattaaaaccccttataactcccacaaccattatacgactttcagcggcaatcttgacccttcaatcaaaaaaggagttctgcgtatgttaccctggccaaacaagatcccacaacctaatttaccaacagttccacatactgacctcataccttcgacttatttttccacaattaaaaccggctacctgccaaaaagatggtggctgccaacttctgagccgaccagtgatggcttggacggtgttggcattcacgccttcgcaacaccgggagccgccatcaccgcagacgatctgccggcggactttttgccgtttgcccacactggtcatcaatattttggctttgatttaagtcatgacccgcgacggattcgctacattgataccgaagtcgaccaatggctcacgatcgcgccagattttgatacgtttcttaaacaattgcagccacatccggtccgtctaccggaactgccagtcgatccgcaagtttttggccacatggcggtcattgctaccgccgccgattggcctgccttattcgatcacgcgcggacgtttatgaccggcgcggagcttggcccgtggctcgtttggctggcaacctcggatgagtcagccaaacgtcaggccgccgccgaggaatatcattttcttagccgttatcagccaaactttctcacgccgaatacaacaatcgagttgcgaaaattgttgtcctgagttagtttccatcattgtcgcttaccgcgatcttcggattggaatttaaaagtatctaaccaccgcaagtcgcgtttaatgccaaaatacccaaacaacgccaagcctagcgagccaaagaagtccatgaacaaatcacccatggtatccatcaacgcggcccggccgcgcaacaacaccccgcttgccgccatgtaccgttgcatattcatgcccagcaagccgtcaaacgtaaattcataaaattcccacaatacgccgatggttgtaccaaatgcgagcgcaaataacgccattaacaaaggactcgtcgtcgctaaccgttttgcgggcgttaacgctgcaaaaatggcaaagcccaacccagctaacatagccgcgctgaagagatgctcgaacttgtcccaatatggcacgctgtagcactgcaaccccgtgcctaacaaaacgctcaacaaaataaaaatttcaaataagtaaatcaagagcggcggaaaccggaaatgccaccagtgttccattaacctaggcagactgacaattaagatccctgacgcaacttgcgccagtaacattgcctgtccatggaataacggccgcccacttatgaaaagcccgccgacaatcagcaggtacagcaagtcgccaccgatatttaaccaatataaaaaattcgatcgtttagtcatgacgtttcctcttttcctcaaaggttccaggcaccgatgcaattaatatgtttttgtaagcgcttggtgtagactcagctttaggaggtggtcccatgccaatcaaaacgttgcctgaagatcaactggtcgccatgagtcagtccgtcgtcaaagaagtcgcccaagcgtttgccttcccttattatgtcaatgatttaacgcatgacgcaaattttgacaccgatcacactgcaaccaagctcgaattcgaactcacgctgctaaatgatcccgaccctgatcgcacgattagtttttacagcgatgcggatgctgacccgattatgggcggtgccgcatcagcgcaagtcgttgtaacagccggcatcacatttatttatctgaatgacggatataaagattcttatctcattattattcacgatggcaaagtcgttcaaaacctcaagctagaacaacaaattctctcgggtcctgaagtcgaagacttgatcgagcacgtcatcccaaacgccaaataagtctaagaataaaaatcgaaagcggccaagtctggctgctttttattatttcttactaatattggcggactgaggcatcgctgggcacaagaccagacatcgggttgcgccattttttccaataaaaaaaccaccataacggtggaaaagtttgggggaacttttttgggagtgtaagttaatgtgtaagcctaaggcagaaatacctccgcctcattgacatcagtataacaagttcttaacgactccgtgattccattttcgacaagttatccctttaattaataaatcgacttatattattataagttattgctaacaaaaaagcagcccaaccggactgctttttgttattatttcttatccaaaccgtacttcttgttgaaccggtcaacccgtccatcggcttgcgtgaacttctgcttgccggtgtagaacggatgagaatcagacgaaatttctacccgaaccaatggatattctttgccgtcttcccacttgatggtttctttggaagtcttggtggagccggaaataaatttaaaaccagttgctgaatccatgaaaacaactggatgataatctggatggatgccttgcttcataatcaattactccttttgccctaaatcattgcctgatctagagatactatgactacaactctaatagtctatcacgcgcaacctataaacgcaatctcaatcaaccaattcgacatcagcgcctaaaccgcgcagtttcatcacgactcgatcatagccacgtaggatattatcgactttggtgatcgttgttgtcccttcagccatcaatccggcaatcatgagacaggcgccggcacgaatttcctcagccgcgacctcggttccttgcagatgatcgcagtgatgcaggatgatcacatcattttcaatcgtaatgtccgcgcccatccgcaataattccggaatatggcggacacgcttagggtaaattgtatcaatgatgagtccttcaccatgagcttttaacatcaacggtgtaattggctgttgcaagtcggtcgcaaatcccggatacggcatcgttttgatttgcaccattttcaaatcgcctgacggatagacaaaaatgctgtcctcaccgacgtccatgacgacgcccatttcttccaatttagccaaaaaggcgtctaaatgttctgaaataatgttcttaactttaacgccttcgccaaccgctgcggccatggccaaataagtaccggcttcaatgcgatcggggatgatggtgtgcgagttgtgtgcttgaagcgtcggcacaccgctgatccggatcacatccgtgccagcaccccgcaccttggcgcccatgttgtttaagtaagtcgctaagtcgatgatttccggctctttggcagcattttcgatcactgtgcggcctttcgccgtcactgccgccaaaatcacgttaatcgtggcgccgacagaaaccatatccaagaaaatccgggcgccgtgtaagccttcagcaggtgctttaatcgccatggcaccatgttcattactcacggaagcacctaacgcttcaaaccccttaatatgttgatcaatcggccgtggaccgatatcatcgccaccaggcaatccaacaatggcttttccaaaccgccctaataacgcccccataaaataataggaagcgcgcagactcttaatcttaccgtttggcaacggtacatcgtgaatttctgttggatcaatcgtcaaaacattttcggtaaaatcagatttgacgttcatatcatccaaaatggccatcaaattatagacatcctggatgtgcggcactgaatcgagtgtcaccggggtgcgcgacaaaattgcagccggaattaaagcaaccgtgctgttcttcgcaccgccgatcacaacttcaccggacaatttctttccgccgtggatcagcattttttccatttgacttaaatcctcgcttaaggtcgttcatttcaagtaggctgaagctgacctgcatcttttgcttcaaatataaaacgcgatttctggtaggcaagcccatgactcatccgccatgcactcaataaacaagtttaatgaatcccagaggaaaaaacaaggagtaaaaagatgagagcgtgaactggcgcgtttagaagtcggagtgtaagtggcctcaggcgtgatggcccggtcttggtcattgcgactgaggtccttacacgcagacttctgcgccagtgaacgcgtttggagagagcgtgaaccggcgcgcttaggagccggagtgtaagtggccttgggcgtgatggctggtctttggccattgcgaccaaggtccttacacgcaggctcctgcgccggtgaacgcgtttgagagaagttgcagagaactttaacgacctcagtcttttggtatttaggcttgaggcccttacacgcaaacttctgcgccatgctttgaccaagccatcgcaacaaaaaagccgccccaaagcatcccgcttcaaggcagcaatgatcaacgattaatttttaaaatcgccagccgattggataaaggccttaaacaagccttcaggtttattcggacgtgactggaattccgggtgatactgggaagcaacaaagaatttgttcttcggatattcaatgatttccatcaagcggttgtccgggctaacaccggaaaatactaagcctttgtcttccatcggcttgcgatacttggtgttgaactcataacgatgacgatgacgcttctggatttcatgaacgttgtcgtacgccttagctgcaacggaacctggcttaagcacgcatggataaaggccaagccgcagcgtcccgccgagattcttcacgccaacctggtcgcgcatcaagtcaatgaccggatccttgacatcaggatgggtttcggtcgtgccggcacctttaagtcccaaaacattccgggcaaattcgattgatgccatctgcatgccgaggcaaatgcccaagaatggaatatcattttcgcgtgcgtaacgaatggctgcaattttgccttctaagccgcgatcaccgaagccgccaggaaccaagatgccatcaaagccttgcaacaggctttcgacgttatcatcattgacatcttctgcttgaaacatttccaaatcaatatcggaatcccagtaatagccggcatgtttaagcgcttcggcaacggaaatataggcatcctttaaggcgacatatttaccgaccaacgcaattttggtgtggtgggtcaaatgctgaaccttatgctcaagcttcatccactcggccatatcggcagccggcacatcaaagccaaaatggtcaacaacgatctgatccattttttgcgcctgcaatgctaatggcacggagtaaagcgtcttggcgtcacgggattcaatcacggcgttttccggcacatcggtaaacaacgcgattttcttcttcatgtcttcggtgatcggcttttcggtccgaacaacaagcatgttcggctggataccgatgctgcgcagctctttgacactgtgctgggtcggcttggtcttcatttcgtcggctgcccgcaaataaggcaccagactggcatggatgtagaaaacattatccgagccgacatcgcgcttcatctgccgaattgcttcgaggaacggcaaggattcgatatcgccaaccgttccgccgatttccgtgatgatcacatcggaatcactgtgtttagcggcacgcatgattttttctttaatcatgttggtgatgtgggggattacctgaacggtcgcaccaaggtattcaccgcggcgttcacgttgcaagacttcagaataaattttcccggttgtgacgttgctatacttgttcaggttaatatcaatgaaccgttcataatggccaaggtcgaggtcagtctcggcgccatcatcggtgacgaacacttcaccatgctgataaggattcatggtgcctgggtcaacattgatgtacggatcgaatttttgaatcgtgatcttcaaaccacgattcttcaacaaacgacctagggatgcggcaacgatccctttacctaatgacgatacgaccccaccggtaacaaaaatatacttggtcatagtcaatctccttttttaataatcgggaaaaaacaaaaacaagctccctattcatatgaacagggagcttgaaccgtattggctttacacttttgtaaagcgcccaaaacgtatattaaccaattgtaaggggctcgtcaagtattaaagtgaattgagtaaaatcaagattggtgcgatcgattgagtgttgccgaatcacgcttcaccataacgcgccagctcgcgctcaccaaaacaaaaagccgcacctgtttaaaaggcgcggcctaaccgactagtgcttgtcgctgtcactatcgtcatcatcactatcatcgtcatcgctgtcatcatcaccggagaagtcagccgtgatgtcgtcgttatcgtcatcatcgtcgctgtcattgtctccgaactcggctagctggccttcaatgccatctggcaacccatcgtcagggtcgtcgtcgctgtcatcgtcagttgcagcagctttgccgatcttatcatgaaagccggtatgatcatcgtcgtcaaaatcatcgtcatcgttgtcggcgtcgagatcttcatcttcgggatcatcgtcgttgtaatcaatgacatcatcgtcatcggctacgtcagccaagaaggcattaaccttcttgcgcttcttgcgacgtggtacttcttcttcatcttccggatggttaacttcttcatcgacggaatcgtatggataccaagcgcgcaggccccaaacgttatcgcctaaagaaatgaaactgccatccacgttcagatccgtgtaaaattgcggcaaacgttcacgaatttcttcgtcactcttaccgagataagtctggatctcgttggccagatcaacgaacgccatggtatcccctttttcttcgaggatctcatgggctacttcgatcattgataattctgatttatcggcattggcaaatgctttgagtttcaaccgatacacgccctttccaagtctttacagtctgtttcttatagtacacgctcatgccttgaattgcaatcttaaccgataatttcccagatgttggtgatttgcgaacaactcatactcaacgtaaatctcccctgctaccggatcggttgtcatgcgggcatcaatacgcggggtgactgtttccaccggaataatcccatatggtgttcgatagcgcgtcaaaacccgcttttcgttggcaaagaaaagcttcaattgcgtatcgccattgctgctgccgcgcgaaagctgaatgtcgccgtcatcgcgcagcttcatcgtcaccggcatactggttccagcgtcttcatcgacttcttgataccgaatgtaaagcgcgttacccatttgaaccaacgtcccgggttcatcaaaaacatgtgtctcagtatcatcaccttgcgtgacaaacgtctcaaggtgaatttgaatcggcactccttgtgaaagatccataatgtcaatcctttctataacgtattgtacgctcacgggtcaactcggtcgagtttaagcagggaaaatgtctttgtgactgacgtgccctgtcaccttcgttataatataggtaatctactattaagaaagagggcgcacgatggacctgacgtcgctggctggacaacaagccgccattttccagcaggatttcaccaaagaagaagctccactcagctttgcccataccaatgccctgttagcacatcccgagttgcacccaccgttaatgttgcacttttggacggcagaacagaccgtgattcttgggatgcaggatttaaaattaccgcaattcggacatgccttgccggttctggccagcgatcattacggcgtctttgttcgtaattccggcggcttggcagtgattgctgacagcggcgtcttgaatgtctcgctttttttacctaatgaagacaatctctccatcgatactgcctacaatatgatgaccgccctttttcgaacggcattcccaagtttgcccatagccactagcgaaattattcattcgtattgtcctggcaaatacgacctcagtgttcacgggcgaaagtttgccgggatggcccagcgacgcaatcatgctggtgtcgtcgtcatgctgtattgcagcatcttcggtgatcaaaatgcccggtgtgagttgttgcgccgcttctatcgggcaggacatgctagcaccagtacgcacttcaagtttccgattatccgctctgaaaccatgaccacgctcagcgatttgctgggtcgtccgctgacccgcaacgaagccattttagctctgttaaatgctttggctgctaatggcattgccgcagatatgaactcgatgccggcgattttacgcgatcctgcctaccacaaggcactcgctgcggccactgcggatctgcgcaatcgcaatcgtcatttatcataacgcgctccccggcgcagaagtatcttggtcgcaatggcctaaacccgggtcatcacgcccaaggccacttacacttcgacttccaaccgcgccggctcacgctcacttaaggaaaatgggggaacaccatgcaatttgaaaaattaccgcgcgaaaaagtctttcgcgatccggttcataattatattcacgtgcagcatcgcgtgattcttgatttgatcaatacgccggagtttcagcgtttgcgccggattaagcagttaggcgtttcggactatgtattccaaggggccgagcatacccggtttgcgcattcgttaggggtttatgaaattgcccgtgaaatgtgcgacaattttgtcacgaattaccctagcaaaacgccggaagacggcctttgggatgatcgggagcgcccggtggttctgtgtgccgcgttgttgcatgatatcggccacggcgcctattcccacacttttgagcatatcttcaatactgatcacgaagccattacccgcgccattcttacggatccgcataccaacgtcaaccgtattttgcgcagtgttagttccgattttccagagcgagtggcttcggtcatcaaccatacttatccaaatccgcaagttgttcagatgatttccagtcaaatcgatgccgaccggatggattatctgttacatgatgcttactataccggaactaaatatggtttgttcgatttgtctcgcattttgcgggtcatgcggccttattcggacggaattgcttacgaagccaatgggatgcatgcggttgaagactatgttgtcagtcgctttcaaatgtatcagcaagtgtattttcacccagtatcacgcggaatggaagttatcttgtcccacctgctgaaacgcgccaagtttctttatgagtccggccagtttgaaccaggcttttcgccgcgcttattagtgccgttttttgaacagtcattttccttaagcgattatctcaagctggatgacggcgtgctcaatacctatttcacttactggcttgattatccagacagcattctgagcgactttgccgatcgcttcctgaaccggcggccgcttaagtcggtcaccttcaccgatcaaacggctgaactgctgccgaaactgcgccacctagtgacagaagccggctttgatgcccaatactacacagcggaaaatgacagcttcgatttgccatacgatcaatatgatccggcctccgccaatccgaaaacgcaaatcgaaatcatgcaaaaagacggcacccttgaggagttgtcgactttgtctccattagttgcggcgcttagtggtcgggctaccggtgataaacgattctattttccaaaagaaatgcttgccaccgaggacagcaatctcttttcatcgatttatgaaaaatttcaacgttacctactaaatggcggcgttattgacccccacttacatgattagccttttcgtcttcagcgcttgggctgttgtgccagccatttggcaacggcccagcgatgcgtggggcgcttgagttccgccagcgccagatcgatgggcatcagcatcaacgtattgaacgtttccaagggatcttggacaaatgccagctcatcacaggcaaaaaaggttgccggatgataatacgcagtttgccgatggtgggaataaaaatattccgacgacttgcccagttctttagtcacgtgaaccgttgcaccaaattcctcaagcaactcgcgcgccaaagttgcttcaggcgtttcgcctttttcaaccccgccacccggtaaaaacaacgcatggttcggggcttgtaaaatcagcagtcgtgcaccgctatggtccggaatcacgccatacgcgccaattcgggtgtgataatctaacttaggatcttttcgaccaaacactggatcaatcatatggcatccctccgctcttgatcacattataccctaatcaatttctaacctctacacaaggagtcctttcgatgactgttcaggaaacattatttgttttttcaatccctatcgtgctgggtatcattttcgccatcagctttacggttgagccgcgccgcctgattaatggctggttgttcaatttatttgcggttgcctttttattcgcactcgcattagccattttagggtcaagtaatctactgctgattgctgtcacaggaactctgtttgtcatcaccgtgttgatcgttattctcatattcaccttacacttgttctggctgttgtggaacgccatcttggtttggcggcgtgaaggccattcattgagcaacatgctgacgctttacatcgccattggattacttttgctggaaatcgccgcctcattcggacgccgttttattccggagccaatctacatcactttagctgttttcttcagcttcggcggtctgtatgtcttattgacactttataacttcctgacagtactagtcttatacaatctccgtccccagccgcacaaccgcacatttctcattgtgttgggcgctggcctgctgcatggtgaccaggtttcgccattgctcgccagccgcatcgacacagccatcaagttttatcataagcagattaaaaaaggccgcccggcgccgcggattattttttccggcggcaagggtggcgatgagacaatctccgaagcactggccatgcagcgctatgctttgggaaaaggcatccctgaaaaggataccttgttagaagacaagtcaacgacgacgctggaaaacatgactttttccaagcgtttgattacgcaggaaatcggggaagcaccgtataaggctagcttctttaccaacaattaccaccttttccgcgccggtatttacgcgcgcatggcgggcattgatgccaatggtgttggcggtaacacctccttttactttctgcctaatgcggttatccgcgaatatctcgccttggttgtgctgtacaaacggcggcatgccgttgcgtttggcattattgtgttcatggcccttgctcagctactgagggcatggtaaccactgcgagccattcacgtgcagaaaggcgggtcatttcgatatactgaacttgaccgtaacatgtttcaaaccataggagtgtgagcgatgttaaaagaattccagaaattcatcatgcgcggtaacgtcttggatcttgctgtcggggttatcatcgggagtgcttttaccggcttagtcaagtccttaacaaagaatctgatcaacccgattctgtccatgtttgccggcaaaaccgatttgagcggtttgtccttcacgctgttaggtgccaagtttacatacggcaattttctgaacgatgtgatcaactttttgatcattgcgtttgtcgtcttcttaatcgtgcgcagcgtcaatcgctttctcccggccaagccggtaaaacccgccggccccacacaaacagaattgcttgaagaaattcgcgatctcttgaaggaccaggatgctaaggctaaaaattaacggttgatcatatgaacatccgttagcggaacaaaaaccggatcaggtgagttgcaaagctcacttgatccggttttttggtcttcgctattattctgcaaagagtgtctcaattgagtcgccgccaaacgtactttaaccatttgctgagcagcgctccgatccaaatcaccggggcagtcaaaacaagaaataactgaaaagtaaatctaacgatgactgcgccgacacgatccataccgccgctttctagtattgatgccatgacaggcgtggtactgtaaatgaaattctgatagacattcatatcctttttcatttctgcgacgtaatctttggtggaacggccagtcgccgctaatcgttgcacattacgttcgattttatcgagaaaattcggtgccgcgcctaaccagcttactaataaataaacgtcgccgagtgtcaatccgaagttaagtccattcttctttttcaaatggaaaaacagggttaataaggcatatgccgcaaataatctgattcttttttgcatgggcaacaatcctatctctgacgccaaggttgctttcagccaaacaggtccacatttgtgctattagcatgcgccgaaaaatatcatcatgcagctcattccaagtggatcgctaaaacaccatgtttggcttcctgctgtttcgaataaatccggtaagtatcactaaccatcttagccaccgaatcagttggggcgctgcctacgacgattccttgataatgatcgtataactgcgcgaaactggcgaatttctcaagtttagcaacccgtttgctcattttctgctgtgtggtcagatcttcaaatacaattgggtcgcccacccgcacttgttggcgcttttggtcatttaatctgatttcaatggttttgctgccttctcgtaccagctcaaattgatcgtgcatgagccccattttcatatccccagtgctccttcattttaaaaaatggtcgcacgccattacgcgtacgcccaccttttgaattcagacaatagtgttcacttaacggcttacaattaatactgccgcttcccaccttgataaacctgcttatctttttgctgaaacgccttcacatcagccattggatcgttttccaagaccaaaaagtctgcaaattttcccttttcaagggtaccatattggtcgtcaacgcccatcaacttggtgccattaaccgacgtcgaaaaggcttcaaacggtgtcatcccttgctcaaccatcaattgcagttcaaccggcgccatagtgaagtcattgaatggcgtgccggcatcggtgcctaatgtcaacggtaccccacgatgaaaggcatgcatgatgttcttgtacaggtcatctaacgcatccgcagcttttttgacttcccagtccggaatcttacccttggcaaatgttggaattgcccagtcggccacgagcgttggggttaagtatgtgccttgcttcaacatgagatcgatttcttcatcatttacataaaaaccatgttcgactgaatcaacccccgcctgaatggcattcataatgccgggattgccttcagcatgcgccgcaacaatctgacctttatgatgcgcctcttcaaccgcaacatgcatttctgccacactcagctgcggatcatccataaagtcgttaggggtcataaccccaccggttgcaatcaccttaatggccttagcaccttttttcaatgcggtacgaacggctttgcgcatctcatccggtgaatcaacaacataggcagcattaggcatatccccatgaccacctgtcattgaaaagaatttaccggatggcatgatttgcggcacctgttttagttgaccctggtctttcaatgcctttagcgcaatgtcgatgtcaaagctgctgccgcattcacggacgtaagtaacaccggatttcaatagctgatgcaaatggtcaaccgcgccaactgttgaagcaacgacaccacgactggtgccgccatcgccggttaaaggatccatcgtgatatgtgtatggacattggttaatccgggcgtcacgtattgaccaccaagatccaccgttttgtttgccgaaggagcctgtccactccctacttcagcaactttaccagtgtcatcaaccgtgaaccaggcatctttaagaattttttctgaagtgccagtaaataaagaacaatttgtaaaagttgttgccatcataaaacctccattcgttaattctgattgtccagcgtatctggactattgtgcctttggctgtgcatatgtccgtaaaagttgaattaagtaagccacaccttgttgataatcatgtaaccgaatattctcgttaggcgcatgtggtcccgatccggcgtaattcacaccgattaaaataaccggtaaatgcagcgcatcaacaaagaacttagccggaccacctccaggcatcatcgggacgaagcggactttgccagcaccgtagacctgctcggcaacactttttgccagctgcaaatgcggatcattgagatcggagtggaacgcatcttcaccaaggttatagtgcaaacgcacatcggaaaaaccatttttatccaactgagcctgaatgagctgggcaatcttcttgggatcctgccctggcaataaccgacaatcaagcttggccttggcttccttcgggataatggttttaaccccttcaccttcatagccggcggaaaggccattaatcgtgatggttggcgccgtgacaatagcacgcttgggatcatcacttgtaaacgggcgtttgaggccatatgtttttttaatcttgtcaccatcaaaatccatatcggcgatcgctttctctgacgcttcatccaacggctcgatgccgtcataaaagccgtcgacgaggacgcggtgctgatcatctgttaacgatgacaaggcacgaaccaagcgccaagctgcgttatcaatataggcagctagtgaagaatgaatgtcggcatcagccgttttgacgtggagatcaaatgaaacaatcccttttaggcccgcaataatctgaaaatgatcagcttcattcttgccgccggtttcccagatgcacgcatccgctgtcaaccggtcgcgatgagccttgacataatccccaacgtgcgggctgccgacttcttcgccaccttcgatgaagaacttaatatttaccggaaatccaccatgatctttcatccagcgtagcgccgtgagccgatacatcaactcgcctttatcatcagccacgccacgagcaatgagcttgccgtccacgacagtcggttcaaacggctcggtccgccattctgccaatggttccggcggctgaacgtcgtagtgattgtaaaacaggacggtttgatcggagtttcctttaagttcggcaaagacgactggattaccaccttggtcagtccactcctcaaccgtgtcggcatttaaatccttaaatgcctgcttcacccaatcgactgttttgcggatgcctttgttttgggctgaaatcgttggaattcgtaaatagtcctccaacgatggcaaataagataacgcaaattcttcgatcgatttttgttcgttcatcaagccgcctccttatgatgttattaattttcaatatagttctcattcataaagacgtcaacatcgttttataattttaatcacatttaaaaagtctggatattggcaaacaaggcaacacgtcagcattttaatttatataaaaatgagagttgcacacaatcagttattgacaccagcacaattaaggttaaagtattccccatattataatctttttataatctattacttgaatggagaatgcttatgaatttcttaattgcgtttacggttgtcatggtctttatgactgttggcgagtgggttgccgccgccactagagccttcattccttccgtcttcatcactgcggttctgttcgtcatcggtttttggaccgttttacctaaaaatgttgtggcaacggcttcttttggctcgggattcatcaccatctgcatcgcactcttgttggttcatctcggaacactgatgaatctgcgcgagctgcttgcccagtggaaggccgtttgtattgcgttgctcggtgtttgcggaaccttattgttgaccttaacactaggaacgctcatttttgactggaaaaccgttgtcgctgcggtaccaccgttaaccggcggactcgtttctgccttactcatgtccagtgggttgaaggctcaaggtttaacaacgttggtcgctttaccagttgcgatgttcgtcatccattcagtcgttggctatcccctaacctccgtactgttgaagcaggaaagtcaccgactccttaagcaattccgcgctaacggtagcaagctcgatccatccattcccaaaatgcgtcgcggcgctgaagaaaagggggataaccgccctaagatgatgaaactacctaccccctatcaaaccagtgcgtttatcatggcgcgagttgcgatcgtcggcgtgttggccatgggtttcggcaccttaactcacaatgtcattaattcaaatgtcgtatgtctgattttcggtgtcattgcccaccaaatcggctttttggaagataacgcgttgaataaagccggcgtctttaactggctgatgtatggcctacttgcttatgtcttcggccaactcagcgcaaccacccccgctgttctggccagcattgtgctgcaaatcgcagtgctcattgtcttaggcgttctaggcatgttcttagcatcccgagtattggctaagccattcggtatgtcgtggcagatggccttttcatgctcgttgacggcgctgttcgggtttcctgccgattatatcttgacttccgaagtggccagcgcggttgccactactgaagatgaggaagaatacttaacacaacaaatgatgccaaagatgttagttggcggattcgccacggtctcggtcgcatccgtcattatcgcgacgatcttcctaaagctgctttaacgccgtcactttgatgattgttgacacatatataaacgacgactttagttgaagatagcaaaagtggccgacacaaccaaaatgcaaggttatgccgaccacttttaaaatacttattttactgaatattccgcttgtcgaaagggaagcctcaacaagcatcaaatcttttaaattatttcgtaaaccgattctcaaacaacggtgtaacggaacggttctcctgaatccgcatgatggcacgacccatcaatgggccaaccgaaacaacgtcgagtttgtccatgtgcttgtcagctggcaaattgattgagtcagtgacaacgaccttttcaatggccgagtgggtcaagcgttcaaccgccgggccagagaaaatggcgtgggttgcggcaaccagcacttcagttgcgccggcatcttttaaggcttgagccgccagcgtgatggtgccggcagtgtcgatcatgtcgtcgatgatgatacattgcttgccggtcacattaccaacaatgttcatgacttcagcaacatttggccgcggacgccgcttgtcgataatggcaattggtgctttaagaaattccgctaacttacgggcgcgggtaacaccgccatgatcgggcgaaaccacaaccgtatcggcaccgtcataatgattacgcaagaagtagtcagccaacaaaggcgcgcccacaaggtgatccaccggaatatcgaagaagccttgaatttgagcagcgtgcaagtcaagtgccagcacacgggtcgcacccgcgcgttcaagcatgttggctaccagtttcgccgtaatcggttcgcgtgaacgcgctttgcgatcctgccgcgcataaccgtagtaaggcattacaacattgatggtgtgggcagatgcccgccgcaacgcatcaatcataatcagcaattccatcaagttgtcattcactgggctggatgtcgactggatcagataaacatcatccccacgaatactttcttcgatgttgatctgaatctcaccatcgctaaaacgtttcactgaggacttccccagcttgacaccaacctcagcagcaattttttctgctaacggcttgttcgaattcaaggcaaaaatctttaatctcgggtcaccgtattgctcagacataagtccctccacgaaatattataggctgcgaaaaattgttccacaaaaagcttagcggattgacggaaaaaagcaagcacatgagacgaattataacctaattccaatctggatcgttcgcgaccggcaaccgtttccagtaatcctctttggttgtttgccgggcacgagcgatagccattgcgtgaaacggtacgtctttggtaatggtggatccggccgcgataaagctgtggtctgccacttcaaccggcgcaacgatattcgaattggagccgataaatgcatgatcgccgatggtactttcccactttttgaccccgtcatagttgacgaataccacgccgcaccctacgttaatgtcagtaccgagtgttgcgttgccgacatatgtgagatggccaaccttagtgcgtgcaccgattttggccttcttaatttccacaaagttgcccaaatggacatattcgccaatgtcagcatccggccgcaaatgcgagttcggaccgatgtcgctgtgggcatgcatgatggcgtgttcgatcgttgaactcgtgaccgttacatcattttccagagtggcatcgacgagttcggaatgcgtgccaatgtggcaatcttcgccgatcacggtcttacctttcaaataaacgcccggttcgatcacggtgtcggcgccaatttgaacatctgaatcaatgtaggtggttgccggatcgattaaggtaacgccgttgcgcatatgctgttcgttgatccgttgttgcatgatccgagtcgccttggccagcgcgacccgatcattgacgcctagcgattcggtataatccggcatttgatatgcggctaccttttcaccggcttcacgcaaaataccgagaacatccggcaaataatattcgccttgcgcattgttgttcttaaccgaatgcagtgccttaaacagcgactgattatcgaaaacgtaaacacctgtgttgatttcagaaatgagtgcctcttctggggtggcatctttttgctcgacgttcttgatgacattgccatcagcgtcgcgaataatccggccatatccagtcgggtcaggtgcattggccgtcaaaatagtggcttttgcgcccttggcttcatgataggcaaacaagtcatttaacgttttcgcggtaaacagtggcgtgtcaccgctgatgatcaacgtggcaccgtctttttggcctaataacggctcagcctgcaaaaccgcatgaccggtgccaagttgctcttcttgtaaaacaaatttagtccggtccccaagcgttttctcaactgcttcggcaccgtgccccacgatcgtcacaatggcgtccggatgaatcgcttcaacctgactcaccacatgctcaaccatgctcttaccacaaaccggctgtaaaactttataatacttcgacttcatccgcgtccccttaccggccgcaagaatgatggtgaatttctttgacatgctaaagctccattcctaattgtcttatttcataatagaccagcgcgaatgcggtgacaacatgtagagcgcgagcaggagcgcttagaaatcggagcataagtggcctcaagcctaaatggctggtctttggccatttaggcttgaggtccttatgtggagatttctgcgactgtgagcgcgtttttgtatcggaaaactcaggcccgggcttaggccatcgcgcccaaggcccttatacgcagacttctgcgccggtgagcgcgtttgagaaagccgcagagaacccaatagcctctaacatactacgtcaagcttaagctattgcgactaagacccttatgtgcaagctccctagtccagtaaacactttttgagaccaacccccatccacactctcaaagcccaaacaaaaacagacccgcctcacgacgaatctgcctacaaaactacccttactgctcattctcagccgcatgttgcttaacatcattcggcactttcaacgtactaatctgagtcgtatccgcccacgcatcatagaagaaccgataatgccgcgtgaccgtttcccagatgaagttgagaacaaccaaaattgagataatgccaaaaaatcccaacgcggcgagattaatttcagtctgatgacctaaagcaaaatactcaatcaaaaaattgctagcgccaatcaggcttgaataagctaagccatataacaaagcttctcgcaacagcagccgccaaaagccaaccggccggccatcagtacgaacgattttaatccgaaccagccccttgcctaaagtctgcccgtcattaaaagcaggccagataacgaaaacaaagagcaatggcaaaaccacttcactcaagaaatccggtaactgtgctaaccctagcaaatggaacaggaacctgatcatcaagccgacaatcgtacttaatattataaagtcaatgaaaaaagcaaccaggcggcgcatcaacgtcactcgaacgccacgcgcctgacttttggcatccatcgtatcccgagatggcaacgcccgcatgaaaatcggggccaaaacgccgccaatcaagccgccggtggtgttaagaatcaaatcgtccacatcaaacagtcgatacggccgcacatagatgccatacagccctgacaactgagtcagttcaaagaaaagactcaagccaaaactcatcatgatgatctgcggtacagtgcgcttgaaataatagcgcagataaaagccgaacgggatcgtcaagacaacgttaaagaatggctggataaacgcggattgtttcaacgccgctaaccacgtgtgcgggttggtcggggaaaagaccgtcgtgtgaataaagtagcgcaaagccatgaacggggtcagattatattttggcccggtaaactgcgccaccgcctcgcgtgatggaagtggtaagataatcaaaaaataagccgataataggtaaaatatgaacgaatagatcacaatcgcgcgccaccagctaaacgcaccgtagcgccgataaacaatcaccagaaacggtagcgcaagcaccaatgctaaaaacggaaacgtgatcagtgccgttttaaccggcccgaggtaagcactcattgatggctcacctcaagtagctgctgattctgactaagaaagtttccggcagtggcatggagggtgttcgccttggtgtcgaccttatcaacccgaatcagtgaagtatattcattgaccatccgatcgccatcaaacttgccttccgcaaagacggtgatgccaaccatttcggcgttgaattcgtcaatcaacgccttcatgccattgaccgtgccgccgcctttcatgaagtcgtcgacaatcagtacccgcgaatttgccggaagactacgcttacttagctccattttctcgatccgcgctgatgatccggagacatagttgacggagactgtcgagccctcagtaatcttggaatcgcgccgcacgatgacgaacggcacattcagatactggctgacactttgggcaatgggaatacccttggttgcgacggtcatcaccgcatcaaccttggcatcgcgatattgggtggcaatcaaccggccaatttgccgtaacacacttggcgttccaagcaaatccgaaagataaacatacccgcctggcaacaagcgatcggtttccgacagccgcttagccatggcggaaataaagttttcggcctcatcttcacccatgatcgggatgtaccgcacaccgcctgccgctcccggaaccgtttcaagaatcccggtttgccgttgcgcgaaggtccttcttacaattgccagatcttcactaatcgaggatttggcactttcataccgcttagaaaaaaaagtcaacggtatcagcgtatgcggccgttctaacaagtacctcgtcatatcaatcaagcgatcactgcgtcttactttcattaatcccgctcctaactccgaatatttagctctatgttaacattacgtgataatcttacccagtataaatgcttttaccgaaaatttcgaccctttgactcgattttctcaccgaacgttcgcatttgttcattttgatccctgccgcctcgcgagtcgtatcagtggcctcccacccatttctatattagaatggttacaaagaagggtagggaaaagtatgaatgcttttgaattacaccacatgactttcgcgccgacaaaaacggctatcctgaatgatatcaatttagacattccttgggggattgatcttaccattgccgggcactccgggtcgggtaaaagtaccttgctgcgcttgcttgccacgttactgacgccgacaagcggcacgattttgtataatgacaagcctcagtctgattacgatccgattctgtatcgacgggaggtatcttattgcgcccagcaacctgccttgtttggcgccaccgtcgccgatgatctgcgttttccattcgcaattcgcaacactgaaatgccgcgtgaacaagctgaagccgcactggaaagcgtcgacctggcgaagagcatgcttgacgcaccgacacaaaatctgtccggcggtgagcgccaacgggttgctttattgcgtcatttgttctttccgcctaaagtcctgctgctggatgaggtcacgactggactggacccggacaccaaagccgtgattcacgacctgctggaccgccaaaataaaaaaggaatcaccctcgtcagcgtgacccatgacgaaggcgaactgcacatggcaaagaacctcatgacactggtagatggccaatttgaggaggtgccaaccgcatgaatagtcagttaattgtatcacccttagcgcttttgttggcgttaatcttagtggtcattgcgttaacgatcaacttaaaagaagagttggggatgaccaaagacttaatcgttggtgtcgtgcgtgccgtcatccagctaaccgttgtcggttttgtcttgacctatatcattaaagtcaacgcagtttggttaacgctagctatggtggccatcattattttcaacgcggcgtggaacgccaaaaagcgggctggcaccatccccgatgcctttgtcaccagcttgctcgccgtcaccacagcaaccggactcacgctgatcatgctagtttctgtccgcgccattcgcttcattcccgcacagattgtcccgatcagcggcatgattgccagtaacgtcatggtggcgacaggtttggcataccgcagtctgaacaccgaatttacggatctgcggccgcaagttcttgaacgcctcgctttgggcgccaccctcaaacaggccagtcaaaaactcatcgtcaacgcgatcaaaaccggcatggcgccaaccatcgactcggcgaaaacagtcggactcgtcagcttacccggcatgatgtccggtctgatctttgccggcattgatccaacaaaagccatcatgtaccagatcatggtcaccttcatgttactgggagccacaagcctgggcagtttcattgccgtttatcgcagttattcgcgcttttataatgagcaaaagcagttacggtaatcatcagctagttcgcatcaagaaagcgtaaaaaaacaactcgtgccataattcatggccgcaatgtaaagacgaagccgctacccaaaaaatcgggagtggcttcgtctttgattttcgaataactaattcgctaagaatgttaagatcgtagtgccaaagcggagcaatcggaggcgggggcgggctcagtggtgagattgtactagccgggcgatcttcccggcgtagtacaaggccgagctttgaaaccgcggtttttgcgggttcaaagtcgtgcccaccactctagcttcgcggtcgccagcccccgtccccgccggagattgcggagtttggcacggcacagaactcattgcctcggctttcctaattttggccaaaatttgggggaccgagaacagtgtgattgaattacggctcggcacctttttcactcacgaagtactacaacattcagtaaggattttccatcttgttatccggtaagtacgggccatattcgacttgaatggtcgtgtgcgcgatgtcaaagctctcccgcagtgacagactcaaggcgtctagaaaggcgtcgttgccttccggtgtcgtccgaaccacatggaccgtcagcgccacatcagttgtgctaagtgcccagatgtgcagatcgtggcacgaagcaacggtcggatacgcattgaccaaggttttgacggcaatcgggtcgatttccttgggaacggctgccatggctaggttgaccgcatcccgcagtaggttccacgtgccaaccaagaccacaatggcgaccacaatcgacatgaccggatcaagccattcccagcctgtcagcatgatcaagcccccggctaacacaacgcccagcgaaacgccggcatcggctgccatatgcatgaacgcgccgcgaatattcagatcgtgctgcgaaccactgtggaaaaggactgccgtcgcgccgttgaccaaaatcccgacaccggcaaccagcatcatccagccgccttcgaccggtgcattttgcgacagccgggtaatcgcttcgacaatgatcgcgcccattgctactagcaaaaaggcggcatttgccaaagcggccagaatcgatgaacttttgtaaccgtatgtacgctgaaccgtcggatggcgattggacagccactcggcaaaccacgccagccctaagcctaaaacatcgctcatattgtgaatcgcatcggcaaccaacgcaaccgaaccgatcccgatcccaaaagcaatctccgcaataatgtaaaccagattaagcaaaataccccaaaagaacgccttgtttggctgaacctgttccatatcgtcaatgcctcatttcttaccccatcatggtttagtgatccctaaaaatcaacccctaagcccacgaccatttgccggcagacaaaatggccgcaacaaataaacctcgcggcagaagcctttcatgctgttgtaaacgcgcatcgcccgcgaatgtttctggcaaaggccaaacacggtcgggccgctgccggacatctgggcaatctcggcaccatacttctctaaccgatgtttaagcgccgtcatctcgggataccgactggccgtaatcttctccagagtattccccataccgctgatcatttgattaaaatcgtgattttgaatcccggcgacgacacgctgggtatccggatgttcaagcccggcttgatagtcaatcgcattgaggatggttggcgttgacactgatacgcgcggcttagctaacaccacccaaaagttgggcaaacttcccaacggcgtcacgacatccccacgtcccgtaaccagcgacgtctccgaataaacacagtacgggacatcgctatcgacactcaacccgatacgcgccaattgcgaacgactatagcctaactcccaaagtgaattcaggccgcgcaacacagcagcggcatcacttgatccaccgcccagtccagccgcaaccggaatatgtttttcgatatgaatccgcgcaccttggcggatgttggcatgacgttgtaacgccagtgccgctttataagccagattgcgcggatcctccggtaaaaagccgctgtccgtggaaaccttgatcgtgcggctcggttgaatcgtcacataatcagccaagtcgactgatgtcatcaccatctgccactcatgttcgccgtcagcatggcgatacaaggcatccaaactgagattaatcttggcgggtgctttttcgattagttccatgctaaccaccagtctttggcgatgcatacctttatagctaccaaagtctagctacaagcgccgttgcatgcatctaccgtatagttatttttagtatactgttttgcgttgtgattttcattgccggattttaaaaacggcgttagaagttaacagcaagcaaaaagccctgatgcaacatgcaccaaggcctcctgaaataaacgatttaatcgtcggttactatctgaaattatgacgctttctcttcgccttcgaaggtgatcttgattgacttggtcaaaagatctgcgtaactgtaagagacacgctcgaacgcattctcactttggtcaagatcgaccacaaaaatagccggataggtttccttcaaggtcccccgccgccgcgtcactttcttgcgtccagcttgtgcaacgaccgttaagttctcaccgattttcccatcgagcttccgtttgatgcttgctagtgtgattggcatgcacttcacctcttaagtaacattctatcacgaaagcaagaaatttgcaattataccacgcactcttattaatcgcaagcaataatagaagcgtaacaaatgcgtcgcgtcaggcgtcagcgcgcacgccgagcccttctcctcgcaacgccgtatccagccgggcaaagtcggcaattgccaactgctccgcccgcgtttccggcgcaatgtttgcagctgccagtgctttgcgaatcgctggcctgttttccttgccaaataatgcaacaaggttgttccaaagcgttttccgtcgggatgcaaaggcgccgcgtaccaagcgatcgaaactgtctgggtttgtgacgtctgctaatggctcggatcgttgggttaacgtcacaatcgccgaatcgacattaggggccgggacaaaggcatggcggctgactgtgaaagctgtcgttacatctgccaccaactgcaccgcaatgctcaagctgccgtaatcttttgaccccggggccgcactcagccgcgctgctacttctttttgcatcatcacagtcatgctgtgcagcggcaaccgtgcccgcaacaggtgcaacaaaatcggcgtcgtgatgtagtacggtaaattagcaaccaccttcagcgtatgcttcccgtcaaaatgctcagccaccagcgcgcttaaatcggttttcaaaacatcttcattcaccactgcggtattaggataatcggccagcgtttcggccaaaatcggcagcaggcgctcgtcaatttccaacgccaccacctgatgggcgctttcggcaagaaactgggtcaaggcaccaatgcctggtccgatttcaatcacatcatcctgtgacgacaaatcggcagctgcgacaattttttgcaaaatctgcggatcggtcagaaagttctggcctaagcctttgcgcatgcgaaacccgtggcgctttaaaatggcattggtcactgccggctgtgcgactttttcacgcatggtcatcttggcctccattcacctgatccagtgccgcaaaaaaggcagcccgactgatgcggaactcagtcaagcggcgtaatagctgtttgccatttgtgtagccgatgtgcaacaactcgcccagctgctcgcgacggtgccgcgatccatcgccgccgatcaaatgcgcagctaacaggtcctgctggctgatgatttgtggcgcatccggcacttcggtaaataaatgctgaagcgctgcccgcaatgctgccggggtcgcatgttcgatacccagcgaccctttatgtgccgggacgccttctgcccgcggcaaaaaagcgtgagtcacgccaggaacggctcgcgaaattgttttgcggatcttctcaccggggaaatccggatcggtaaggacaatcaccccgcgtttggcctgagcctggcgaatgcgcgccaaagtggcgtcatcaatcgcactgccgcgagtttcaatggtatcaatatcgccaaaagtttcttttaatcttttcgtatcatcgcggccttctacgaccacaatttgtttaatggttgtcatgcgtcttcctttaatctgaaaattcggtgggcattgtcccaagtctgttgggcaatcacgtctggggtggtgtcgcgtaattttgccaaagcttcaaccacataccgcgtgtagcccggttgattctgccggccgcggtacggtgtcggcgtcaagtatggcgcatcggtttctaccaataagcggtcactgggaattattttggcactggcatgctcttccggcgcatttttgaagctgacaatgccggaataagagatgtacaggcccaaatccaaaaagtgtcgcgcccattcggcatcaccggtgaaactatgcatgatcgcaccaaattgctcgacatgcgctgcttttaaaatatcgtaagtatcttcaaacgcatcacgactatgaatcgacaccggcatgtgcagggaatgagccaattctaactgacggcgaaacacgcggcgttggatctcgcgcggggaggtgtcccagtgataatccagtccgatctctcctaacgccaccactttgggatccgccaactgctttaacagcagcgcttcttttgctgcatcgtaattctgactcgactcgggatgccagccgacaatggcgtataagttgggatactcatgggctaacttcaaagcgccagcattcaacgccgtgtcggagccaacaatcgccatttttttcacgcctagctgccgcgctgcctcaatgtaatcggcttccttgccgcgataaggggtgtcatttaagtgggtatgcgaatcgaaaatattcatgcaatcactgctttctttctgcttctgccattaatggcggcaacaaacggatcacctgactcggcttcttagcggcaaacaagtgttgtaactgcgccactggtgactgggtcaacgcgcggatcaactgggcgattcgcattggctgctccttagcgacgggattcatcaacataaacgcccactcaaccggcagtatgcggctaacgtctgccagatccttaaacgcaatgggaatttcaaagtgaaccacgaccaatcgcccttgctgcactaaatcgccttccagatgcggaatcgcaatgtttggcagccgatcggcaatctgattcagctgcataccggatggaaacgtctgctcccgggcgatcagcgccgctttgcctgctggcagcatcaccttttgggccacgagctcgtgactgatgacattaaaaaagtcctcttgcgtcggcgtgttcaaaaagtataccaacggggttgtgctaaattcagccaagcttttcacctatcttttcataaactcgatatggttagagtatagcacgctacttgctgttcctcatgatcggctccacttttggttaaagcttctattattcacccattttcttggagtttcatgaaaatcctcggcgaaaaatgtctattgttgtcattttgttctatactgattttgtactgaacatttaaggattacctaggaggtatttttacatgtctgttaaacttactgctggtcagttagcacatttgaagcaattgtccaatgatgacaatgtgatctcagcattagccatcgaccaacgcggttccctgaagaagatgcttgcagccgctgccaacaagccggctgatgaaaccaccatcgttgatttcaaaaaggctgtttctgaagaattaaccaaatacgccagtgccattctgcttgatccagaatatggcttaccggctgccaaggtgcgcgatcctaagtccggtctattactttcttatgaaaagaccggctacgatgccaccgaacctggccgcttccctgatttgatcgacaaccagagtgccttgcgcatcaagaatgaaggcggcgacgcggttaagttcttgctgtacattgatccggatgaaccagactcaatcaacgatcgcaagtacgcctttgttgaacgtgtcggtgccgaagctaaggccaacgacctgccgttgttccttgaattggtttcttacgatggtaagaccaacgaaaccggcaccgctgcatgggccaaggctaagccagaaaaggttatcaagatcaccaaggaattcagcaagccacaatacaatgtttccgttttgaagcttgaagttccggttgaccagaagtttgttgaaggctataccgacgaaggtgtgaccccggtttacagcaaagaagaagctgctaagtactacaaggcacaatccgatgcaacggatctgccattcatcttcttgtctgctggtgtttccaacgaattgttccttgaagaactcaaattcgccaaggaagcaggttcaacctttaatggtgtcctttgcggccgggcaacctggaagccaggcgttaagccatttgctgctgaaggcgaagctgccggcaagaagtggctggaaaccgatggcaaagctaacatcgatcgtttgaacaaggttttggctgaaaccgccactccttggacggacaaggttgaaggttagttctgataaataagtaagcaagaaggctggccgcattgaggtcagcctttttcattgcaaaagaacgatcacatttacgaaaattttcactaaccattgcagcccactgatacagtggtagactaatcatgaatgcggtttcttatactaggaggtagtatggtttgatcacaattgaaaataatcaattcaaagcgggcattgccgagcgcggtgccgagttgcagtcattagtcaacaaaagtgacaattacgagtacatctggaatggtgataaaacattttggaatcgtcatgcgccaattcttttccctgcgattggtaaatcgaatgaggatcagtatcgcttaggggcaaaaacattcccgatgagccaacatggctttgcccgagattacgattttgacgtcagcgataaaagtgattcagcagtgacctttacgcaacatcaaagcgccgagacgttgaaaaagttcccgtttaaatatacgttagccgtcacctacatgttgaccaaagacgggctcagtattcattacaccgtgaccaatgacgacaaggattcaatgccgtttgcactaggcttccatccggcgttcaatgtggcgttaaaggctgatggcagctttgatgattatgatcttacggttgaaccgctgaatagtcccttgcagcggtttggtatcgggccggtgccatttcgtaatggcgacgttgaggacatccccggcgcagaaggcaataaactgccattgacgcacgagttgctagatggcggcttggtcatcctcgccaacagcgaaatcatgaaagcgaccctatcatctccgcaccatgatcacagcgtcacgctcgatatcaatgacttcccttacctcaccatctggagtcctgaacataaaaaggcaccattcattgccgttgagccatttgacggcctgcctgaccaagccggcgaaccctccgactggtacaccaagcttggcaacaccaccttgtcagcaggcgccaataagcaattggcgttgaagatcgctttaaagtaaacatctgtttttagcgttcgagttatcatgcttgttgaatgattttgattcactgagctccaaccgatacgccagctttaggctattagttccatgtcgcgccaaactccgcaatctccggccagagggtgctggaacgtggtgggcacgactttaagcctcagcaaaaccggctgagtcttaaagctcggccttgtactacgccgggaagatcgcccggctagtacaatctcaccactgagccccctctggcctacgattgctccgctttggcacttatatcttaaaatttctgacgaattgcccatgaagagacagagggcgaacgaaattctgataacggaattttgttcgcccttttcttatggatgtggatcacgactgaacttcttacaagccttcacactttccgctatttccacccggctgtcgaaatttaaccaaatgcaccagaacatcagcacagttgcggtaaaataaaagcatattggcgaaagggatgattccagatgcacattgcacttatcgacgatcaagcagcgacccgcgaagcaaccgttaaaatgatccaacagttggctcagccgtcgcagccgttgcaggtggcagcttatgcaagtgcggaacagttccttttcgccgaacagacgccggatcttcttttgctggacatcaagctcggctcggggatggacggcatgtcgcttgccaaaaaaatccgccaacacgatcctgacaccgccatcgcttttgtcagtaactacgacgaattcgtttttgacggctatgatgtcaacgccatcgactacatcatcaaaccgctcaccaaagagaagctgcagcatctgattgataaaactgcagcccgcacacagcctaagttgttgccgctgcaaacacccaacggcctcacccgtgtgccgctttacgacattagcgccatcgaagtgaccgatcatcggctgcaagtccatactcagaaaacaacgtacaccgtgagcggccaattgaaagacttgttgccgcgcttagatgacaacttcattcaaatctaccggtccatcgtcatcaacctcaactttttatctcagctcgatcaccacaccgttgtaatggcggacgggacgacttatcccgtttcccgacaacaggcgccggtggttaagcaagcctttttcaaacattttcgggggctgacagatgacagtgaatgattggatcggcctcggcgcgtttctgttgctgacagtgggctgttgctggcagttatggtggatctttcgccgccagcaaaattggcccgtccgctggttgaatctcgccatcgtcgcggttgcacttggcagctggtggctttggccgcagccgatcgtgcgtgttttactttttgtcggcacggttctggcaggcagcttggaatttgtcttgattcgccagtttctcagcgatcaggacgcggtgtttgcgcgcagtctggataaaatgatggcccagtactcgcaggaagtgcaggagctgtacgcgaacatgcgcggctggcgacacgattatcatgaccacctgcaggctttaaaagcttacctagacaaccaagacacgaccggcgcgcgccaatatttggatgaactggaagataaactggacgccgttgatccgctcgtccactccggcaatgccatgctcgacgccatcgttaacgcgaaactcacattagcagaacgcctgcagattccggttaacgaaaaagtgatcgtggggaacacgccgcttatcaaagatgtggacttggtggtcattttaggcaacttgctggataatgccattgaagccatcactgaacaaccagctgatgaaaagcgccagctgcgcctttatatcggcattgtgaaacaacagttttacatctccgtcaccaatacccgtccggctgaccaggtgattgactatcagtacgcctccaccaaaagcgataaacgcggcctcgggattcggcgggtgaataagctcgtcgccaagtacgacgggatgatcaaccgccaatatgaggatgaggtattcgtcactgaaattgcgattcccattcacgcagtcaaaccgaccactcacgcataatttgcgtcagcgcgtcggttttttggtaggttaagatcaacgaggtgagtgggatgaaaaaatatagcttatggaacaacctgcgctggtacatcaagtatctgcgtaaagacaagccttccttagcctggacagcaagcggtctggccattgataaggctgcggccgctttgctgggcgtttttacgccggcgctgttggtcggagcaattaccgggcacgctacgttagaccaatttgcttggctggcaacattaaccggattggggctcgctctgaccagtgaaatcgagtacctgttgctgacccatgacagcgtctcaagttccgtattgcgcggtgttatcgaaatggattttcatcaaaagcaatgggatcttgactacgaccagatcagcagcggcaaactccaagggctagcccacaccgcattcgaaaaagggctgagcaacacatatgccggcgccgaagctatctatctgtatggccgtggaacactagtagacctcacaacgctgatcgtgttcctagcgacgttgtcatttgccgttccgtgggtctttgcactggtcctggtcagtgccgccatcagttatgccggcatgagttggtaccgccactggtatcaacaaaacaatgtcaagtggaacaagctaggacgccagcaagattacattacgcgcaacgcctacgctttggaaaatggcaaagatattcgcatgttcggcatggcgaactggtaccatcaccaccttgaccgcttgattcagttgcaagatgcctggcagcgccgtaactcgctacgccggtttctgggagaacaaatcggtcaacttgccggcttgttacgtgacgccattgtctacggcaccttgattgtggcaatcatgcgcggcagtctttccatcgcccagttcactttaatgtttgggatgaccaatagtttcatcaccttattggatcaacttttagacgacttcggcaagttgcaaaatgccagtctcgacttgcaggaactccgtgattttatgaaactgcaaccgcaaacgccaacccgcacgctcacggaggcagagcagaagcagttagcaaaacgtcctgtcaccatcaccttttcacatgtgacttatcaatatccgggagccaaaagcgccagtcttaaagacgtcagcttcacactgcaggccggaaagaaattggcgatcgtcggtattaacggtgccggtaaatcaacgcttgcccgcctcatgatgggcctattgcatcctaccagtggcaccatcaccatcaacgggctaaatgccaatcttttaccactagcagaacgttttgctttatttgcccctgtctttcaggaaaccattatcctggcccagagtttagccaacaatgttgccatgaccgagcatcccgatttgaaccgggtcacaactgcattaaccgaggctggcttgggagccttcgtcaaaacgttgccgcaaacaactgccacgccgatgacccgttacaccagagatgacggggttgaattatccggcggccaggcgcagaagctcatgctggcaagggcactgtataaagatgcgcccgtcctgattttggacgaaccaactgccgcactggatgcgattgccgaaaatgagatttaccaagactatgcgcaactagcggccggtaaaacttctctgttcatctcccatcgattagcatcaacccgcttttgtgacagcatcctgtttatggatcatggccaggtactcgaatctgggactcatgagcagctcatggcaaagggcggccgttatgcccaaatgtaccaaatccaaagtaagtactatcaaccggacgcaaaggaggtcgcagtcaatgacaacttctaaagattcagaaaaaaccatgccaaaacaaactgttcatcgggccttgcgggtggtgcgtgtgattcaaagtctcgacccgcttgcgatcccggtcgaatttctccgcgcattgacaactgtcggcatcccctacctaaacatcgctttccttggcttggtgcttaatcaattacagcaacgcgcaacgttccggcggatggtgcttcttgtcggcctattcctagccattcgctacctgcttcaattatcgagtcaatggtttgctaaattagccgaagatcatgaaagcggcgtaaacaggcggctcacccgcgtaacaaccgagaagttgttgacggtgagttataccacccttcaggatccagatatgcgtaaacagtatgccggcgctcaagccgggcaaacttttaatggcggtatgacttcactcatgacaaatggcatgcaagatttcttttcgctaatcattgcgattggcttcggtgttgctactttgatcagtctggcacgggcaactaaccatgtaacaacctggctgaacgactttcgctatccactattgattttggcgctactcatcttcccgattgtcgttggcagctggagtattcaccacagtaatcagattcaacaagaactgatcagaaaaatcatcccaagcaatcgccgatttacgtacttttaccacttcacggaaaatatggataatcatgaagttattcgcctttatcaagcaagccacttagtcatgaacaatgaacgcaatgacaacaacgaattctttggccaacttagccacggttattggcaaatggccaagttcggtcactggcctaacctagccattgcgttatcggtcatcggtttgtatatcctggttggcgccaaagcgttaatgggtatcatcgctattggcagcatcatgatcgccgtcggatattttcagcaactgatgacggctgcctatcaatttctacagcaagtcggcatgtacatcaacatggtcgattacctgcaattctacgctgattttcttgctttaccggatcacgataaatccggcacacttccggttgaaaaacgcaatgacaacgaatttgccattcagtttcacgatgtcagtttcaagtatcccggcagcgaccagtgggccttgcgtcacgtcagcctaacgctgaacatcggtgaacggctcgcattggtcggccgcaacggcagcggcaagacgacgttaatcaaactgctcgtgcgcctgtttaaacccaccgaaggcaccatcacgttaaacgacattgacatccagaaatacgacgaagacgaataccgcagtctgttaggtgtcgtttttcaggacttccgcctttttgcttacagcattgcggaaaatgtggccgccacgactgatccagatcgggcgcgcgtttgggaagccttgaaggttgcggatgtcgccgatcgcgtcaagcggatgccgaaaacgatcgacacgccgatcaccacagccttaagcgatgatggtgtgaccgtttccggcggcgaagcgcagaaaatcgccatcgcccgcgcttggtacaaagatgcgccgatcatgattctggatgagcccacggcagcgctcgatccgatttccgagtatgaaatctatcagcgttttgacgaacttatcgaaggcaaaacagccatttatgtctcacaccggatgagctccacccgcttttcacaacgcatcgtcgtccttgatcatggtcaaatcgtccaagatggtacccacaccagcctcatggcgcatccaggtatttaccgggaactattcaacgcccaggcacagtattacacggaagaccgcatcaaagcggctcggaaaaaggtcgcggctaccacgacggcagtggcggattagcaatgcattcaaaaaggacaccgacaaagatttgccgcgtgtcctttttgaattatctagtttaaccaaccaagctgccgttttgtagattctcggaaacttcaagtaaggtaatcttcttaccatccaagctttcggctgatagcaacataccctccgaaatctcgcccttcattttccgcggcttgaggttcacgaccgccatgactttcttgcccttcaatttctcgtaatcagggtagaattcacgaatgcctgacaggatctggcgtgtccctttatcgccggcatcgagggtgaacttcagcaacttgtccgcacccttgaccggttcaacatcgaggatttctgcaactcggatttcactcttatcgaattgtttgaactcgatttccgacttgcgggtcttgtcatcgactgctgctttggccgtgcctggggtcatctggctcttgatataggcaacttcttcttcagcatccagccgtgggaagatcggtgtaccttgttcaaccactttggcgccagcaggcagtgcaccccacttgacgattttatgatcatcgttttcgtggtctaagcccaattggccaaaaatctgcagtggcgcatgggtcatgaccggctgaatcaataaggcaatcaaccgcaaactttcggccagatgtgccatgacggaatcaagttgatcctttttagccggatccttggccaacttccacggttcggtttcatcgatgtacttgttggcgcgggaaacgatcttccagacctgatccaacgcatccgagaagcgcaattcgtccatcagcttgtgatactcggtcaaagccgcttcggccacatcgccaagctctttgtcgaatggcgtcacatccggcttgaaggctggcaaaataccgtcttcatatttattgatcatcgcaatggtgcgattcaacaagttgccgaggtcattggccagatcatagttgatgcgatcaatgaagtcttccggcgtgaacaggccatcattgccaaacggaatcgcccgcatcaggtaataccgcaaagcatccagaccgtaccgttccacgatcatatccggataaacggcattgccttttgacttgctcattttcccgtcgcgcatgactagccagccatgtgcataaattttcttcggcaatggcagacccaaggccatcaaaataatcggccagtaaatgatgtgaaagcgaacgatttccttaccaatcagctgcacattagccggccaatacttgtcaaacaaggcgtggtcgttgctaccgtagccaagtgccgtgatatagttcagcaaggcatcgacccaaacgtaaaccacatgcttagggtcagacggaatctgaacgccccagttgaagctcgtacggctcatcgccagatcttcaagccccggtttaatgaagttgttgatcatttccgttttacgcgaagccggttgcacaaaatcaggatgctcgtcataatacttcaacaggcgatccgtgtacttactcattttaaagaagtaactcggctcatgaaccagctgaacctcatgcccggatggcgcctttccgccgacaacgttgccatctttgtcgcgataaacctctgacaactgtgattcagtgaaatattcctcgtcttcaaccgaataccagcccgtatattcgccaaggtaaacgtcaccctgcttaataagccgttcaacaatggtttgaaccgcttcaacgtgggctttatccgttgtccgaataaatttgtcgttggtgatctcaagggtcttccacaactgtttgatttgtgccgccatgccatcaacataagcttgcggtgtcacacccagtttatcggctttttgctcaatcttgaggccatgctcatccgtcccggtgaggaagaaaacatcataacccatcaatcgcttataacgcgccaaaacgtccgccgcaatcgtggtatacgcattgccgatatgtagtttgccagatggataataaatcggtgtcgtcacataaaaagttggtttgcttgccatgcaaggtgcctcccgtactttaattcagaatgagtccagtataacagagtatgagcagacttgctcaaaaatggcgaataagtggctgcctcacaaccaccatcaatcattcgccgccagccaatgatccagcacatcaataaactcatcgtgttgatccagcagcgccaaatgccgactgttcgcaaacaaatgccattttgcccccggaatatgatccaccaccgtttttgcaatcaacggtgtgcacagatcatccgtaccgctggtgactaagaccggaacatgaattttatgaagctgatcagtgacatcaaaatcgctaatcgtcccgttttcggtaaactcattcggcccttccgcaatcagactggcccgcttgccgttggttgggcgccgcagcggctcaggggagttctcgtcagggtcatcccagcaatacttctccatgtaccggtcattggcggccagatacttgacgtttttaaaatccccggtccgttcagcttcggcaattgcttcctggtcttcataactcagatacttgatcaggcgatgctgctcctgcacccacagcttaatcgaagccggtgacccatcaatcatgacactcttaatgccttgcgggtcaaagctcgtcagataatacatctccaacatgccgccccatgactgccccagcatatgaatctcgtccaaatgcaaaaatttgcgcagcgcgatgagttcttcagcccatgtctctttgacgtaaacggccggatcctctggtagcgatgacttaccgcaaccgacttgatcatacataatcagttgtcttccggtcgcagcgtaatcgtccatgagttcaaaataattatgcgaagaaccgggcccgccatgaattaacaacaacggcgccttatccgcgctgggttcacccacaattcgataatacgttttgtactcatgaaacggcatgtagccttctataatcttcatagcaatccgcctttcgaagcaattaagcgccagattcagtgattaaaaattgctgaaccattttggtgaaaacaatgtgtttaccgtgattgtactacaccagtaccagactgtcagaccgaattcggcgcggcaacacaaattctaaaacaaatccaattgtcgtggcgccaatccgggaaaatccaatcccagcatgtcaatgaatgcctgcgtatttgcggcggcgtcatgtccgccattattgttgaaaataacggtgacgtttttacttttgagatggtgcacaatggtggcaaactgttgcaattctgcttggctatagcgataattcgtccgttctgtggttttggcaccgctctgaccccatgcctgattacggccatgcaggcgcagaatcgttaagtcgggattcgtggcaattggcaccagcggcaccgaaccgccgaccgtctgagcttcatccaccacgacatggatgtcgcctgccgcctgcaataacccaattgtggcatcacgataggccggcagataccaactggcatgacgaaattctaccgcaaccggcagatcaggcagccactgattgagattttgcagataccggacattctccgccgttacgccaaaataaggtgggaactggcacaacaccgcctgcagctgatgcgctgcaactaggggcgccaccatatcattaaaccgcgaaaattccgcaaccagatcctgtgtggcttcgtgcttggtcatgagcttactggccttcacaataaattgaaagctcgctggcacctgcgcctgccaccgccgaatctgctccactgttttcaacccatagaaagtcgtatccaactcaatcaccggaaaatattgggcatagtccgcgaaagtactgcgcttaccatttgctgcaatgctaggatgatcggccacactggttaagccgacgttaatcatggcgctcaccgtccgtaatctgaaatttctgtagcacatcgccggtaaaatacgacgcgtaatcgtgcttttcgccatttaaagcgtatcgcaacagcggctgcagatccggtaccaatcccggattatccgccagcaaccactccttggaaaaggtcgccagaatcccttcacgagtcgcttgcggcatctgaagccggtcaggcgttttcccgagaaaggcatagagctcaccgcgaagttcgccatcgacatgccaaaaaacgcgccccacactgcgcaattcgttcgccgggataatgatgtgactttcttcctgcaattcacgtgcagcgcagacagccggcgtctcgtcaggcaaaaacttaccacccagcgtattccacatgccgcgataaggcggattcgtacggttaatcaacagccagccagtgggcgtctcaaccgtcaccaatgtatatttcttgaccatgtgcatccccttttcaaaaatgatctgcttaaggcagttgaagcaaaaaggcgccgaaacggcgtctttttacagacttcggtattgctaccgaaatgagttatttcattttttcgagtgtgtccttgatgatgcctgccgaatggacatacttagcccgttcgtcatcggtcaatttcaattccggtgtgttgacaacgccgagcttaccaatcgttgccggatagccgatcgcaatgccgaattcaggatcgtaattggcgcatgggaaaatccgcttggcatcgctgatgatcgcctgggtcatttcagtcgcgatcgttgcaatgccataactggtgtagtgcttcgcattgtaaatcttccaaccgccagcccgcgctgcatcagccagctgatcgtaatccactttggcgtactctgcgatcggttcattattgacccgaaccgttgaccatgccgtgaactgagattcaccgtgttcgcccatgttatagccgcgaacatccgcaacattcacatgcagcgtctcggcaaccgcgcgccgcatccgataagtatccaacgatgtgccggtgccgataatctgggacttcggcaaatcaagcaagtactgccagtagctagtcaccgcatcgcagggattcgtaatatccagcaagacgccatggaagccagacgccttcagcttcggtgcgacatcatccaacgccgccttggaagttttagtctcgccgatccggtcgccatttgaaatcgcgccgatattgccgactgccgaaatcaccacatcagcgtctttcaacgcatcgtaatcattgaccacaatgtcggtatacgtcggcaacccgcctaacgcatccttcaagtcgtaactttcgccttcagccaattcggctttctggtcaattaacaccagtttatctgcaacacctttgctgaccaaattgaatgccgtcgtcacaccgacatggccaataccaatgataccaatcgttcttgccatattaaaaaatctcctttcatcataacgcgttcgccagcccagaaacctgcgtgtaaggacctcggtcgcaatggcctaagaccgggccatcacgcccgaggccacttacactccggtttctaaccgggctggctcacgctcactcactcttttggaccacgtaatagatgtcgctcaacacgctggtccggaattgcccacaacaataacattaacaagtccagtatgatcgttaatggcggccaaagcaaagccaaaatcatcgcgataaatgccatgataatcgatccgaccgctttccagtcatgctgatggccgtatagcttcaccaacgccgaggtcgggccgttgacatgtcgcagggtgacgaccaaaagaaggtaactgacattcgacatgagcacaacaaaaccataaatcagctccggtccgaatgcgttcacatgcccttcaccgacccagctagttgcaaacgggaacatcgaaatggccagcatgaaaaatgaattcgcccacatcacgcgccagtcaatccgattgaccaactggaacaaatgatggtgattgttccaataaacgatcaacgtcagaaatgaaactaaataaattccaaacctgcctcgtaacgcccaaagcgacgccagtgagccactgtgaggtggatttaattccaacaccaagatcgttaaaataatcgcgatgaccgcatcggtaaatgcctccaagcgtcctttactcaccgtcaaatccccttttcgtcatgattgttcgtgactagacgtgcaacttggcaaaaacgtcaacggcatcccccaagaccatctgcgccccttccggcaaagcaatccgttcacggttcacggccacaatcgttgcatccggttgtgcatagccaattaacccggcaaatggatagacaacaaagcttgtccccacgacaattagcaagtcggcctgcgcaatggcattaatcgccgcacttaccgtatccggattaatcggttcaccgtataagacaatgtccggccgtaaaataccgccgtctgcttcatgtacgtcacttttcaaatacgtttgatagtcaaattgtttgcgacagatttgacaataaatccgataaagattgccatgaaattccaccacatgtttggcgccggctttacgatcaagtccgtcaacattttgcgtgacgatcgtacctttttgattggtaatcgccgccattttttcatgaatgacattcggcttggcatcgggataatacatgttctcgacgacaaatttatgaaagtcctcgtgatgggcctgcagattatcaatcgataacgcatactctgggtcaaccttgtcggcatataagccaccttttgatcgataatccggaattcccgaagctgtcgaaacgcctgcgccggtcataaacgtgaccctttttgcttgatcaatcgcggtttgcaaatcaaacatcgtttccatctcctaacacgctgaacagcgcaacattcttaacgaaaaattcacctcacaccaggcaaaacgtttagcttgcccgccagtcaccaattagtgaaactgtcactatcgcgctggctgatttggaacaagttcgtcaccctaggcgtaaaaggtgtaatattatttataagaaacattgtagaaaggggtcttaataccatgaagtcctttcggtggtcgcacttttttagttatttgtttatgatcctagtcctcattttcttccttttcgtcttctaccaggttgtgatgcttggtattcagtccgtgactaacggcttcttcattaattttggccggcattaacggatggtaaaatcgagaccatacttcgtcagaacgctgtctagcggctgttgatacagctgttggaaagcttctggcgttgtttctttttcaggcagtggcagcacaaacgcattttggtcatcgctgcgccccattgcgacataggcaggttgtttcgtgtcccgatcgcggtagctgctgtgtttgatgaggtaaacctgatcgagtgtgagccgcagttgtcgcttcgacaaaaccggcgacaccgtggcaaattcatggtcattggtcggctggtagcctaacttctcaatttgggcatcgaaacgctcaaacagatgcacaatcgcccggcgcaagccaaatggtgaagcaagtttctgttcgtctagtaagctgaatagttcttgggcatacggcaacgcttgtggatacgcgcttgccagctcatcgggtagctgcccgtccaaaaagcctaaaagatccagcaacgacagaatacggtaaatcaccagctgatcatcagcttcggctggcacattctgcttgaagcctgccaacacctgcgcaaccaccttgtctgtcagcaagccatgttcccgctgccaagcaaccaccagcatatgcactgcagcgttatacaaggctgtactggtggcataaagctggtcatccacttgcggatcaccgctcaataaatgaaattgcaactgaggataccctttcatctgaaacaataagtgaaggagttcgtgacttaacgtgtacgccacattcgttgtatcggtcacaaccacctctagcgtaccatcttttttcaggcgctgatggctttgatcatgggtcagcacgccgcttgcttcaccgttaatcgctacttccagcgggtgatcgtagtgacttttaacttcatcaagtaatgcctggacatctttttgcatgtttattcaaagctccttgttatggctcaattcgatctgcttgatctgcttgtggcaataaaaatatttttaatccgaaattggctttcgtaatttcaatctactatcataaaggtagcgataaaagggaggaaattcaaatgaaactatccgttccgcttgtcaatgggatgctggctgatcgttatggcaagtatgccactggcgccgatgtcaaagatggctatccgatcacgagttttccatttaccattgaagatgctccggaaggcactgtcagtttcgcactttggctcctcgactatgacgcggttccggtcggcggactgccatggattcactggaatgcggcaaacattcctgccaatgtcacgtcgatcccagttggcgcgagtcacagcgatcagattccaatggttgaaggcaaaaatgcatccgcagggcacttggttggtaacactgatccatttacccagcagggctatgtagggccacagccgccagacaagaatcatgattatacgttgatgatttttgctttagacaccaagttaccactgcaacccggcttctggttgaatgaagcccgccatgcgatgaaaggtcatgttttggccaaagccgaaattgatttgccatcgcgggtttaagcgactgcctgtggcaaccgtgctcagatgctaagacaccattcacaaatacaatataaaaacaggcatactttctgcactgcaaatcgagtgcagaaagtatgcccgttttttcaccaaggataattagttacggtgtttaagattatagtgccaatgcggagcaatcgtaggccagatgagcctcagtggtgacattgttgttggtggggcgccttttgccccgcctacaacaaggccgagcttagagactctgccgcttttgcagaggctctaagtcgtgcccaccacgttccaggctcagatggccggagattgcggagtttggcacgacatggaacttatagcctaagcttcctttgtcctcttttatttcacccaccgtcaccagtattcatccacaacgcaccggcgccgactgcagccagcacaccgatgccgatgatgccgactaacgcaaatttgaaaatggcaaagccgccgagtgcaaagagtgccaagctgataaatggatggcgcaaaatcgcacctaacagtttaattactaagaacaagataatgatcaccgcgacaatggcaccaattgtgatggcgcctgtcaacgtgtgactgctttggccagtttgatcactgaccaagatattaggcaacatgaggccacctcgtttctaacttaccaagttgcggttattaaaactgactccgaatccactgggcaataccgttaaagaaactaacgatgccatcccagattttctgcaggaaattccggttttcttcagtgtttaggcttttattgagcttatcaaacagcccttttgccgaattttgaattgaattggctaatttgcttgcctgtgccttgaaatcggtattctttaaggaaccggctttttgcacattcaccagcaagttaataatcaattgacgttggttattgttgatgatggtcgttaaattattctgcttaagctggctgtccacaatattgccgatttggttctgggacaaagtttgctggccattgttactttgggtcgccatttcctgcttggcaccggcaacggcattattgagctgcttgtccgaatagccgtctttgtctttgttggcttgggtaatcgaactaagcgtgttaacttcctgctgggcagcgttgatttgctgattgttgaggttgtcaccgttttgggcaaacgctgcgtagaccccggctaacgcaccggaaccgtcgattttgacggcactggtgatgtacaaattggcgttgctgacgcccgccgttaacgcggcattgcgatattgatcagccgtaatggtcgtaatgttattcgtaccgttatacggcacaatggtgacattaatcccgccattattggttttctgcaccaatgcactggaccagacaccagagttctcggtgaacgagctacccgaaggattgagatatttcactaaggttgcgccattgaccgtcagttgactggcgttggaaacacccgcggcattttgcagcgtgctgagcgtgccgcttttttgatcgcccgtcaacgaggcgccaagcgtggcaaccggttgcgaccaggtatccgcccgcaccacgcgtggcgctgttgttaataatgccagaccggctgcagccaaccccagccatttgatcaattttttcatagctcaaaaccatcctttagattggtactttcattatcgctgtttggacgcattccgtcagcaaatcagcatgctttttaagcaatgattaactaatgctcccgctgcgccacggcccggctgttgaggtgatcataaagcgcgccttcacgtaagccaaactgggaaaaggtcagccgatcggaatcaagataccggatcatggaaatcaccggcaccaagccgcccacaataatgtccgcccgatacttcgctaatccgggaatggcttcccgggtcgccagatcagaactcagaatctctttaaaaatattgttcgcttgctgggttggcatccgataaccatgaatcgcttcgaaatccgcaagtttttctttgcggcgctcgattttggctaatgtccggttactcccacccagcgccacaattggcagattctgggctcgccgcagccaccaaacgctattgaaagtttggtgaatgaacgtactcaaggaaaaatactccgctgccgaaataacatccgggctcaaaaagcgttcggacaaattgaccgacccgaatggaatcgataccagatgctgaagcttacgattctgcaccaaaaccagttcagtcgatgcgccgccagtatccatgattaaggcgttttgaatcggcagcgtattgaccacccctaaaaagtcatactcggcttcacgcgtgccgggaatcacgctaatcgtcaagccggcctcgtttttgacccgcttaagaaaggccttttggttcttggcttggcgaaccgctgccgtggcaacggcttttaaggaaatatcttcatacttatccagttcggctttgaacccttgtaatgccttcaatgttcggtccatggctgccggctgaagggttcgcgacgtccccatatcttcagacaagcgcaccatttccttgagtcgcttgaccggcttcacgacttcctgatcaatcgaccagatcgtcatgcgggcagagttactaccaaggtcaattactgcgaagtgatgcgtcatgcatcatcatcctcctttggtgccgtcatgggaataaacgcgtgcgtcgcgtgcaaatcttcaggtgcctgatcgatttcttcacggcgcaacgcttcacccatggcgactgcgtgtttaatgaaataagcctgtgcattaagcttggtcacgccgcgcaattgcacgcgggtccaagtgctatccggctggagaacgcgggttttaacattatcgtcccacataatcccgaagatcttgatgatgcgctcgcgaatatcgtcttgtagaatcgggaaaagcagctccacacgtcgacttaaattgcgattcatcaaatcagctgaagaaagatagacgttttcctgaccatccgcgtaaaagtaataaattcggctgtgttccagcaactgaccgacaatcgaatgaacggtgatgttatccgaaacgccgggaatcccgactttcaagttgcaaatgccgcgaaccagcagatggatttcgaccccggcatgcgaggcttcataaagcttctcgatcatggcagtgtcggacagcgaattcatcttcatctggatcaaggctttacgaccggctttagcagcagcgatttcctcgtcaattcgatccatcagatagtcgcgaatgccaagtggtgcgatgaccagcttgtggaaatacggtggttccgaaaagccggacagcatgttgaaaatattcgatgcatcttcaccgatttcgttgttgcaggtgaacaatcccatatcggtgtaaagtcgggcggtgacgtcgttgtaattcccggtcgccatgtgcatgtaacgtttgatgccttcttcttcacgccgaacaacaagcgccaacttacaatgggttttgaggccaaccaagccataaatgacgtggcagccggcatgctcaagttcttgcgcccaatgcacgttgttttcttcgtcgaatcgagctttcaattcgactaagacagtgacctgcttaccattttcagcagcctgcttcaggtaacggataatcggcgatttgctcgacacgcgatacagggtcattttcaccgctaagacttgcggatcctgggcagcttcacggataaaatcaatgactggctggaagctgtcataaggatgctgcatgaacacatcgcgttccttgatgacgtcaaagatcgattcgcgctcaaacgccggatccatataaggcgtgaatggtttaaacaaaagctctttatggccgtgaacctgcttcacaagcttgctgagaaaattcagatcgatcggcccatgaatttcgtaaatgtcttcgtctttgacattcatcgccttggtcagccgcttccgcaggtgtttgcccatgcctgcctcaatttccaggcgcatcaccttgccgcgctgacgctttttaagttgtgactgaatctctttcatcaagtcggaagcatcttcttcagccacgtccatatccatatcgcgggtcacgcggaatgtcgccgtttccttgatatcggcgccgacgaacaactcaccgacgaacatccggatgacttcttcaagtaaaataaacacgttgtcaccgccgggcagccgcaaaacgcgcgggaacacatccggcacctgaaccatggcaaatgaacgcgacttatcatcttcgctatcttctggccgaaccagccgaatcgccaaattcaggctgttgttacccaggaatgggaacggccgagtcggatcgactcccatcggcgtcagaaccggataaagttcataatgaaaatagtctgacacaaaatctcgctgcttctggttcaaatcgctaggatgaagtaactgaatatcgaccgccgccaattttggcgtcaaagaccgcaccagcgtgttgtattgcttttcaaccatcgcatgcgccgtcttggaaatcgcatcgagttgttcctgcggcttcatgccggctgcatccggtttgtcataattgaccgtcaccattttctttaatgaagcaacccgaatgttgaagaactcgtccagattactttgggtgatgcccagaaaacggacgcgttccaacaatggattatttttatctcgcgcttcttctaacacccgatcattaaacgcaagccaacttagctcgcggttattaaaatagcgtggtttggaaaaatcaagcttcttcatagtgtgtttcgtcctttcaactcaagccctactccgaaaacttccgagaaaaatttgccttttcgtgccaacgtccagcgttccagctcaatgtcatcatttactttagccgacaacaagactttgtttggcttcactgagacgcgcagttgttgaattttctgctggcgggaggcatcgaggctgtcggccacgcgcaaaatggcggatagcttggcgacaactaagcggttttcggttgacatcatcggaaaattcttcaagtctgactgtggcgtcaccgagctgtggaagcgggtaatcgttgcgaccatcgtcacttctaactcgtttaaacccataatttctgaagccataataatgtaattcgagtgggcataatgtttgtgggtttcaatgtagctgccaatatcgctgacagtcgccgccacttccagcaacaggcgttcacgtttgcccatcccatgcagtttcttgagccgatcaaaaagttgcaaagcaaacgtgcgcgttgcctccatgtgtttgtcgtcgacctgataacgtttggctaaattattagcgctgatgacaatttcttcatcaggatcgaagccgagttttttaaaaccgccagcgtgcgccgcgtggacttcgaggccatcaatcgctttgagatccgaaatccagattgattggctattcagtgtttcgatcagacgatatacaagcaaaaccgttggcaacaccagcgatgtttgacttgaggtcagatcataagtatcggcaaggtactggtcggacgctttcgtcacttcatcgtaaagcatgtcaaagcccggccgatcggtttcgacctgccgtttgccttccgggatcagattttgaaaaatcgacaaactgctgcccatcaaaatcatgttggtatactcaaccccttgcggcagcaagcgcatgaagtccagtaagcggctgtcgatataatcacgcatcacttcgacataattcgtcaccgagcgttgaagatcgctcataatctcatacacccgcaacggccctagagacaagttacgggaaaagccaaacgtcccctggcaaaaggtcgtcagctccaccgagccggaactgatatcaatcaacaccgttcctttttgggtgatcgaggcaaactgtggaaatttaaccataatggcctgcgtacggaaaaaggcctcttccgacaatgaagttgtccggatcagccaaccggtgcgggtataaagttggtcccgaacaaactcggcattgtccgcctcagcccagctagtactggcgtaaacgttaaccgtcgtcacgccatagtccttaaaaatctgattaatggcatcaaacgcctgcacaatggtatcaacggtttcagggaggatttcgtgttcggcataaaaatcatccccgatggcaactggatatttaccgcgttcaattgttttaagtgtccttaaattcgtgatgctaaaaacgatggattgtgcaccgatcatcgcgaatccctgtatattatttgccatgtccgttccgtccattctttttaaattcaccaaaaccgaaccgttcatcctaatgccatcatagcacggcatattttggttgcatgagtttttagccaagccttatttatctgcttagccactccaattcaagtttaccaaatatttagccgatacttcgccgaatttggcgtagattcacaacttcttccaattatttcgctaccatatggaggctaggccaatgtgacccagtatgaccacggtttatataaaaatatgcgattgtcgccatctttttgcgcaatcgccaatatttttgtgataatcttagaccatcatgaaacgacgctgaaggaagtctcacttttgacgctgatcaaccttcgtcactctggaaaaagcgatatcagctgtactttttccttataaaaagagactgactgcatcgtctacatttaactttacataaagggagtctctcatgaagaatcaccttgatgacatcaccaaacttatggcgcttggacctaccgctgatagttatgccgttcaacgtcgccaaactgctcatcgcattgccattgccgacgcatggcaagttaaagccggtgaaaatattctggaaatcggttgcggccaaggcgacttgagtgcggttttggctgatcgcgtcggtcccagcggccacgttaccggtatcgatattgcctcgcgcgattatggggcaccattgacattgggacaggcttgggatcacttgttgaacggcccgctcgccagtcggttaacagtgcatttcaatacgaatctcaccaacggcctcggcacgttagcggatcagcattttgatcgaatcgttatggcccacagtctttggtactttgagtcggccaatgctttggcgttgctcctaaataatgtgcgcacaattggtgattttgtggatgttgccgaatggtcgcttcagcccacggcgcttaatcaaatcggtcacttgcaggcggcaatggttcaaggactgctttatgcgattgctcccagtgatgtcgccaatatccgcacgttgattacaccggataccttgactcaaatagctcatgaccacacgtggacctacactcccgggcaactcatcgagaatccggatttggatgacgcccgctgggaaattgcgaccaccagtgccttgttgacagagctgaagttaagcaccaatttgcgcgatcgcgtgaagccgcaactggaagcgatgcaccacaacgggaccgctaccctgccaacttttaccggccgcatcacattttaattgccaagaaagtcgatgatgaacgatgatcgaatttaaaccggcaactaccgcggacttgccaaaaatagtcgcgatttacaacgaaaccattccgacgcatcgcgcaaccgcggatttacaaccgcaaaccgtggcgcaaaagtcggcgtggttcgccgcgcacaatacccattttccggcgtgggtgatccaaaaccaccacgagacagtcggctggctgacgctctcggcttacagcgaccgcgcggcgtatgaccagacggctgaaatcagcttgtaccttgatcaagccgcccgcggccatcacgtcggcaccgccgcactgactttcgttgatcacgaagcccctgcccacggcctgaccaccgttattgcccgcatcttcggccacaaccaagcaagccgccacttatttcaaaaatttggctacgaactctggggtcacttaccggcaatcgcaaccttgccagaaggccacgcggatctagaggtttatggtaagcattttgggatataggcccgtaaatagaaacagacaaatgagtttcagccgcagtatttgcgaaactcatttgtctgtttttttgtagccttgaataacggcaactcactcttgctcaccagcaagggtgtcttcctgttgcctaatacgccgcatggtgcggacgtaagagctgaccagcactaacacgctgccgaaccatgccaagggattggcggcggacgcgccggcaaaaccgaatgggacgaccaggaaaattgccgcaaatgcccgcatgccgagttcaaagaatccggcaacagtcggtaccagtgtctggcctaatccttgcagcaaattgcgaatcgtgaacagaatcgccaacaaccaatacatgctggcattgtaatggaaatacgtttgggccaaagcagtgaccgctggctgattcgggccaaggaacaagttgacgagcggcttactgaataaaataatcaaggcacctagacccagtgataaaccgacgttgacaataagcgtttggtaaacgccgcggcggatgcggccataggcttttgcacccaggttctgggctgcaaacgtggccatggccactccgaaagaagcggaaggcaacgttgccagctggtcaatccgtccagccgccgtgtacgctgcgaccgcgttggtgccaagtgtgttgagcatgacctgtaagaacaccgccccgatagcaatgatggacatttgaaagcccatcggcaggcccacttttagatggcgtaaaatatcctgccaatcgattcgcaagtcccggcgccggatcaccaatagcggaattcgcatgcggatatatacccagcacagcaatgccgcgatcacttgcgcactgacagttgcgtaaccggcaccggcaaccccggaatgaaaaccaaggatgaaccagaagtccaacgcaatattgatgatggtcgcgataatcaggaagatcagcggtgtgcgcgaatcacctaatgcccgtaacatattgctcagcaaattaaacaccattgacgcaatgatgccaaagtaaatgacccgtacgaaggcaatcgaatcgtccatgatgtccggcggcgtctgcatcaccgcaagtaacggccgggtcatagtgaccgcgccgaccgtcagaatcagggaaatgccaagcgcaatccagacactcgtcccaaaactccggcgcacccgccgataatcgtgagcaccataagcttgcgccgttaagatcgacaatcctgccgttgtgccttgggcaaagccgataattaaaaaaacaatactagatgttgcaccgacagctgccaaagcatctttgccaatcgtccggccaacaatcagcgcatccataaaactgtaaagttgttgaaaaagattcccgattaacagtgggatcgtaaacaacacgatgagttttaatggtttgccaattgttaaattgcgcataggttatcctccaaaatttgtaatgtttgtctgactgcgggtgggggaaggcaaagcttctttcttactcccataacgcgctcaccggcgcagaagcctgcacataaggacctcgagcctaaatggccaaagaccagccatttaggctcgaggccacttatgctccggcttctaaccgcgccggttcgcgcttaacaatttcaccaccatagcacaaaaaaccaggcagctgaataactgtctggtaaatgaaacatatttgcaatcaaacgtcggcgccaccgccaccggagctgccgccgccccagcttgagccaccgccggatccgccgccaaagccaccaccgaaaccgcctccgccgcctcttcggcctgcggagagcaaggcgtcaatgatcagccatagccagaaaccgctgtcgccatcgcggcggcgacctccgcggccaccaccgccacggccgccgaagatgactgcaacaacgacaaccgccaggaaaattaaaatgattttccctaataaactgccgccttgactgtggcctgtgctgcgatactgattcatggtttcatcaggcaccgtgttctggtctttaggaaacttgtatttcttatcaatcacggtcgcaacggcattaaacaccttacgcaacgctcggtttaaatccgccttgttgtgtgacttaatcgatttcagattgctgtctagaatctgtccggccaaggcatccggcaaatcgccttcaaggccatagcccacttcgatccgcagattttgtttgccattattgtcggcatacagaatcaggacaccattatcggtaccctttttaccaatgccccacttttggaataaatcaggagcgtagtctgacaacggatcgccgtgcgtggacttcaaggctgcgaccgcaatttgcggctgctgcttggttccttgatagtagcgattcttttggtcgactaattgcttggtattattgtcaaggtattgatcctgatccaggtagtaatggtcagtcggtcgtgccggcagatcctcggccgctgccaccggatgggctgcaccggcaaacagcagcaagcccgtcagcgcggcgaataaccacgctaaatgcctgcgcatggcgccacctacttcccggaactggagctattacttgaaaaatcaacgcttggtaccgtctgggctgacggggtggctttgaaggtatccttcttgcctaagcccatcatgctggcaaaaatgttcttcgggaacgtcacaacactttgattgtaatcacgtacttggtcaatatagcgtttgcgttcaaccgaaatccgattttcactgccttcaagttgcgtcatcaacgtgtttacctgattactgctttgcaaactcggatagttttccttgatgacgttaatcaaggtacccacgctcttattcaactgatcgtcggccttggccttgccagtcgttgtgttcgcgttcgcataggacttgcgggcttcggcaatctcaccaaaaaccttttgttcctgacccatctggcctttaacggcattgaccaggttaggcaccaaatcggcacgccgctgcatgacgttttcaacttggctccattgcgcttcaactgcctgattctgcttcgctaatgagttatacgtgccaatgccaaagatcaggcaaatggccacaatcacgccaagcacgatacttgtcactgcaactggacttagtcgtttcgttttcatcattcaattctcctctgggacgtacctcggcagcaaaaaatcgttgctaggccaattcgcgtccgtaatcaagttttcacttcctttttattttaccatgccggtacgaatcgacatccggctaaagacggatctggttatttaaagtagttgaaaccgatggcatcgcgaacttcctgcagcgtttgattggcgaccacattggccttggctgagccctgtttgagcatttccgcaaccgcacccatatcttccgcataatgggcccgccgcgtacgaatcggttcaagcacggcttccatgacatcaatcaggtaccgcttgattttgacatcccctaagccgccatgctgatactgctccttcagcttagccacctgtgctttatccgggtcaaaaatatccagataagtaaacacgacattgccttcaaccttacccggatcttccacatgaatgtggttggggtcggtatacatcgacataatctttttcttaacggtatcgacatcatccgccaaataaataccattattgaggctcttactcatttttgcgttaccgtcaatgccgggaaggcgccctaaaccttttggcggaaaatagccttctggttcgactaacacctctttgtgataagtacggttaaacgtacgcacaatttcgcgggtctgttccagcatcggttcctggtcatccccgaccggaacggttgtcgccttaaacgccgttatgtcggctgcctgactgaccggataaatgaaaaagccggccggaacactatcaccgaatgccttttgtttaatttctaccttcacggtcggattgcgttccaaacgattgacggtcaccaagtcgagatagtaagcggtcaactcaaacagtgccggaatctggctctggaccaagattgttgttttttctggatcaatcccgacagccagataatccaacgcgacttccagcagcgaatgccggattttctccggatcattcgcgttgtcggtcaatgcctgtgtatccgcaatcatcacaaaagtctcgtaatcgcctgaattctgcaattcaacccgattctttaatgagccaatataatgaccaatatgcaaccgtcctgttggccgatcaccggttaaaattactttttttgccatgtcagctacctccttcaattaaaaaagacgccctatgttattgcaacataggacgcctgcgcgcggtaccacctaatttgtccgaatttcgaaccactcttggcttaaggcgcacccaccgaacataacccaaacgacccaacttcacctatcccggtcaccggcttcacagcaccaccgactctcttgagaccgcttggatagactactcatcacttgggtgaatatgagtttaggttagccaactataaatacaatgtcaatagtaagcgcgtgaactggtgccatgcaactcaactaacttaaaataaatactgcaaatcactctgtgcactcggatacgcatagatctgattaagctcagccggctttttacctgcatcaatggctgcggcgaaagtattgatcaggtcttctgccaagctggccagtacgaccgcaccggcgagtttgccggttgttttgtcgacaatcgtccacacctgcgcgtccggatcttgcagacggtgataggtgtaccattgggtggtatcgttatgaatcacctgataccgatcaggcgcagcttctgcgtcttcgagggccacgccgactttggcaagctcggtcggtccaaagacaatcgttggaatcgccggataatgaatcggctcctgatcgcccagaatctggctggccacatagcgtccttcaaatccggcaactggtgtcagtttcggttgcggcttcaaattcacatcgccgagcgcatagatatttggaacaaccgtgcgcaaatgatcatccaccggaatcccgcgggtgtccgccttaatcccagcattagcaagaccgaggtcagcaacgttggcaatgcgccccatggccgtaatcgccatatcgacattcatgtcaaaatcatccgcatgcagatgcgtcatcgtgccgagcggactgattttcgtaagttcaacattagggtgaaaatgaatgccggacttgatcaacaactgcttcaatgcttcggtggcaactttggggaaggctcgcaacaagcgatcggagtgcccgataatatgcacttccgcaccgccagcggccgcaatattggcaagctcgacgctgacatagccggcaccgataaacgcgatgctggtcggcagctcatctaaatccagaaaatcgcgactcgttttcaacaaattggcgccgggaatatccggaaagcgcggcgtgtggccagtcgcgatgacaatatgttcacctgtgacattttgcgaaccgactttaacggcgtgttcaccgagcaactgtgcccggccatataatgttttaatgccggtgcgggttaagccgttcaaagtcccagccggaatgccactcgtataaccacgcttaaacgccatcaaggacggccaatcgattttagccgttccgctaatcccaaaaccgttcatccgcaaggcggcatttttcacttcaacaccgcgatacagcatctttttcggatcacagccgtagttgggacaggtgccgccccacagatcgccttcaatgaccaataccttctgttgcgccgcgagaccataagcagcagctaagccaccggggccgccaccgatcacaatcgtgtcataatcatatgccatcacgatcactccgtttctgtattttgatcaacaaatgcacttgccagataagcaaccacactatgagtattgaccacaaacgtgccatggtcactattcacctgcaacgtttcatgtgcgtctaacagcggcaatgcttccgccagcgtcaggttaccgcccactgcatgccgcgctgactcggcgaccgcaaacggcgccagctgactcaaggtcacctgcaacccttgattggcctgtgcgcccttgaaaagatcggcaacaaaatcattcgccggctgagtcgcaatcgcttccggcgtatcgacctgcaaaagcttcccgctgtgcatcacgccgatccggtcacctaacttcattgcctccgccatgtcatgcgtgacaaaaatcacggtcgtcttcatagcgcgatgcagctgcaacaacatatcctgcaattgggtccgcgaaatcggatcaagggcggaaaatggctcgtccattaacacaactttaggccgtgatgccagtgcgcgtaaaatgccgatccgctgctgctggccgcctgaaagttcactaggcatgcgatcacggtattcggccggcggtaaatcaaccatcgtcaacagctcatcggttgccttgcgaatcttttggcgcgaccagcctttcatttccggaatgacggcaatattttgcgcaacggtcatggtcggaaacaacgcaatttgttgcaacacgtagcctagattccaccgcaaatcgcgaaccggataatccgtgagcggtttgccggcaaatttaatggtgccgcttgttggctcaaccaggcgattaatcattttcagcgtggtcgttttgccgctgccggaggtcccgaccaagacaaacaattcaccttgctccacattcaggcttaagtcatcaaccactggcttgccatcgtaggctttggtcacgttttccaagctaatcagtgccatcagcgcgcctcctttagcaggccatgccggacaaggtaacgatgcgccactgttgcggctttttcgcggcggacactgaccgcatagttcatatcctgcatctgcttttcggtgatgtggttcgccagcttatttaacgccgtgaccaactgcggatggcgcttggcaaaactgttgcgcatgagtggcgcgccgcgataaatcgggaacaagcctttgtcatccttcaaagcgacaaggtgatactgccgcagttgcgcgtctgtcgtatagccgtcagtcaggttaatctgtccccgatccaatgcctgatatcgcagcgacggatccattgagtcgaccttgaactggaggccatatttctgcttaatgcctttatacccatcctggcgatcaatgaattccaagtcgaagccagcgcgaatcgacggggcaattttggccaaatcactaattgtcttcaactggtagcgcttggcgaaactggctttgacaaccagcgcgtaagtattgttgtacgccatgggtttcagataacgcagtccttgcttcgccagtagttgctgggccagcggatagttgtttttgcctgccgccacttgtttctgttgggcggcagtcggcttcgtcaagctttccagcacggttccggaaaactcagggtatatgttgatcttatcggtttgcagcgcattgtacaagaagctcgtctggccaaaattcggtttcagcgtcaccttcacatcagggtcggctttttggattaattccttatacatgctaattaaaatgtccggctcactgcctaatttgccggcaatcgtgatggtttctttaggtgccgtcgcccagttgtaaacctgggtgccagcaaagcccagtaatgcaataccaaccacgctgacactcagcttccaattgactttttgcagtaaattcagtagccacgaaaagacaatcgccaacaacgccgccgccagcgcacccatcaaggtcaatgaagcatcgttgcgatcaatgcccagcaggataaacgtccccagtccgccggcgccaatcaacgctgccaaagtggcggtcccgataatcaaaaccatcgcggtgcgcacaccggataaaatgaccggcaacgcaatcggcaattcgactttgaacaatttgcgcagtcggctcatgccaaatgcatcggcggcttcttcatacgacggatcgatatcctgcagtccgatataagtattttgaaaaattggcagcagtgcgtaaacgaccaacgcaatgatcgccggcaccgtgccgataccgacgaatggaatcaacaaccctaacaaggctaatgaaggaattgtttgcaaaacgccggttacctgaagtaaaactgccgctactttgggatgcgtctgtacccaaacagcgagcggaatggcaatgatgactgccaaaacaagcgcaatcagcgatatttcaatatgttgtcctaaggcattgagcaattcaacgtggcgctcggaaaccgtccgccataaatcagccatgtcaaacctccatttactttaattattcataagtgtaccaccttgatttccgatgcaacaacaagtgttatgtcgcattactttacttttcaggccgctgggcttaagattgttgacactattttaaacacgagaggagcgccgctattatggagaatgcaaccaaagcagaagaacaagcacgcgtcacggcggttatcgagaagctgaaggcaaggttagcggctattcatgagcaaatcgaagcggcgcaccgcgaaaccagccgcattgaacgggcttacggtgaaaacacgaaagtcaacgtcaccgaagtcgatgaccaaatggaaaccaacgccgctgttcagcagcaaaaagtcatggtcgcgcgggccgttgaaaacgaaacgatcctcaaacacgaaggtgatcgcctgacactactggcggacaatccttattttggccgtattgacatcgatgaagatggtgagccagataccctttatatcgggacggcgacgttcattgatgaaaatggcgattttctggtgtatgactggcgcgcgccgattagttccatctactacaatggcacgctgggtgacgtcacctatgaaacgccggccggagaacaacacgcggttttgaaaaataagcgccaattccaaattgaacacggccatatcaaaaccatgtttgataccaacgaaaccgttggcgatgaaattctgcagtccgtgcttggtgatcagtccgacgaatacatgaaaaacatcgtcgcgacgattcagcgggaacaaaatgacattatccgtgacacttccagtgatttgctcgtggtgcaaggggtcgccggttccggtaaaaccagcgccgtgctccagcgtgttgcctacctgctgtatcacagccgcagcgatttggatgccgatcagatggtactcttttcacccaaccgcctttttgccaattacatttcccaagtgttgccaagtcttggtgaaaagaacatgcgtcaggccacgttgtttgaattcttggccaaccgctttaccggcctgcacgtggaaaccctgttcgaacggtatgaacacgacgcggcaggtttgccacaagctgccgagaccattcgccggttcaaagaagccccgagttacttggaagccatttatgactttgccaaaaatccggatcgtacgccgcatttcattgatgttgaatttaacggtgaaaccttcttttccgctcctaatattgccaagatttaccagtcgcagccggcgttgatgcagccagttgacaagtttacagccactaaaaacgccttgatcaaacgcttgaatgcccgcattcatatggaggccaagcaagactgggcgcagttgcaggtttcggatttatcgcaaagtgaattggaaaccttaaccgccgatcatgaatttgcgaccggtgaagacgagcagcaattcgtgtcggaagccattgtctccaaggcttttgccccgatttacgacgcgctttacaatgatcacttctatgatgtgttccaggattaccaacacttcatggcccaggtcgatgcgccagtcagcgaaccggtttggcagaccatgatcaccgccttttccgatgggattgaatcgcatcacttgcgtcttgaggatgccgcgccactgctatatctgcgcgatctgagtacgggcagcgggcaaaacagcctgattcagtacgtctttgtcgatgaaatgcaggatttcagtatggcgcaattgctgtacctgaagcacgcgttccctaaagcaaagttgacgttgctcggggatgccaagcaggacgtctttaccagcaactatcagcctagtgacttcattcatgaaatcaaagatgtttttgctggctataagattcggctcattacgttaaacaagagctatcgttcgacacagccgattacgaattttgccaaagccttgttgcctgaacacgaccatatccaagccttcaatcgcgctggtgacaagccggaagttctaacggttccgcgcgcggatgcgaccgcggccttgtccaagttggtcacgcggctgttgacggctgatggcacagtggcgattttaactaaagacgcccagactgcggatcagctttacgcgacgctcaagctcgacaccccggtcacgttattgtccgcgaacgatcacagtctcaaaagcggttgtgtcattctgccggtatacttggccaaggggcttgaattcgatgcggtcgtcggttgggatgtctccgcgtcaacctaccaaaatgaagctgatcgcgatattctctataccctgtgctcccgtgcgttgcaccatttgaatctggtcgcgctggacgcgcctagcccattgatcacggcattgccgactgatctctatcgacacgctggcgatgcttcggaggcaagggtttagttgtttcgacttcactgagttccatgccgtgccaaactccgcaatctccggcggggtctgggctggaacgtggtgggcacgacttagagcctctgcaaaaccggcagagtctctaagctcggccttgtactacgccgggaagatcgcccggctagtacaatctcaccactgagcccgcccccgcctccgattgctccgctttggcactaatattttgttccatcaattctgtaatatactcacaaaaatcggcactaacgatgactgatcctgatcgttagtgccgatttgattttgcagctagtattatgctagcttattaatagaaatttttaatcaactttctaaataaaagtcccggaggcaacgtcttgttcaatctgcttcgaaccttcatggcggtttatgaaacccgcagcttttcattggccgccgagcaactgttctccagccaaccgactgtttcgcatcatattcaccagttggaacatgagctgaatgtttctctttttgagcggaacaaacgcagtgccaccattccgacagcggcagccgatattctctatgaatttagcagcaacttgctcgctgactgggataaagccaagcaagcgatgcaaaacacagcgacaaccgcttcagtcgaactgaatatcggcatttcgcaaagtgttgccgttgttttgttccctagtttggcacgcggattgaaaacagccttcccttttctggaattcaatgttgccgttttgaattcgctccaagtggtgaagcagatggaggcgcggcggcttgatctgggattcatcgagcaaccgttgacgctaaaaggtgcggtcagaaccacgctttgtgcggatcaattggtggtggcaggctggcctaccggtacttggctcacgcgcgaggaaggctccggcatgcgctattacacaactgcctatctacaagaagccggcatcacacccgatcatctcatgaccgttaacaacaacagcatgctccgagcgctggtgcaaaacaaggtcggccaggcgttgctgtcggatcggatcgtcccccaagaagtgccgcagcaaaccatcggcgcaaaatttcgccggcatttttacctgttgcaaaatcccgatgttcactggccgcacaagcaagccatgctggacacgatccagcatttagccaacaaggttgactaaatcaccaccatcgccatcagctaattaatcagtcgtatcccgcggcgcttgctgagtctgccaggcggcgcgaatatttaagtgcaaaaagcgcaggtaatgacccgtgacgaataccagcatcaacgttgcaactagccattcgctccactgcaccacgcttaacaggttatgggcaacaccggtttttgcgaaaatgccgatgaaacgcgttaacgccgtggcggaaatgactagcggaaacgtaaacgcggcaaagcttgggtaaaacgacaaccgcgtgtactggcgaatgctgaacagcgtgccaaaatataagctctgagcaaagatcaacatgccaagtgcaaaccagaaattaggctgattgaagctggcgagataaccggtcaagcacagcgaggccggtgccgccataatggttaacagtggctgggtagcctctggtaatggtaccacccgcacgcgatgcacgactacaggaaacaacgcggcatacaggacaaatgcgatccagaaaagcggttgccccaaagcaggcacaaattgggcactggtcaccggaataacgcctaatccgacaaacgtgacgaaccaactcgggtaaatcatgtgccaggctttttgctgcgtgagcaagtgccgagacaggaagaatgccatcagaccgaagtgaatgagcaccgccatcacccacacaacagtcgccacttggataggcatcccccaagcggtgaagtaggtgcacaaaatcatgagcgtcatcgaaaatgtcggcgacaccgaggcgatgatcggatcctgtaaacttttggcagcatgaagcggggtcaggcaaagcttcagtaaaatcaccgcaaacagcaaaagcgccacaatcccggtgacatcccccgccaattgccatccggctaatttatataagttccctaacgatgccaggcccagcgtcaagccagccattggtaacggtacttttttcaaaaatgttgtcatgtcagcctccttcgcatgccattgagtctaacaagaatgactggtggtagctaaatgaatctattgcatcgttaatattcagaaactgaataagactgaaaaacgttgacagtcagccgcaaagccgaccgtcaacgtttttcagtccgcacacgatttaaactaacaggatcgtggcattgttaagcatgtgtaagccaatcgaatagcgcatgtcgcgggttcgcagataggtccaggccaagacaccaccaagcgctgcgtaaatgaagaggttgtagtcaatccgtgacccgacaacgtgggcaaagccgaacgcaaaggcactgactaaaatgctgacccactgccacttgcgctgtcgtaatgagccaaaactgttcatcaataagccgcgaaaaaggtactcttcaacaatcggacctccgaccacggccagtaatttaatgccccaaggataagttttcaccagatgaagcaaattgctctgattcgctgcttgcggggtatgtaacaaatgcatcagtagcgaattcgttagttgaatgacgaagagcaagccgattccctgccaaatgacagcagccggatgcttcactgtcaagggaccttgctgccgataccaccggcgatagaccagcattaacagcccgatcaataccccaaacgaaatgacaaacgcgccaatcgcgccataagcaccccaagccgcttccccgcgaaccagtgccaactcagcaaacgagtataagataaacccaatgccgacgcctaatacctgtaaaaaagaatggaatattttcaaagttaacgtcctttcaagggagagtcgttactgtttcatcataccaataatttcttgagcaccaaaatcttgggctttcgttggtcacgcagatcgttataaggtttgctcgcgttccaaccttttaaatgcagaaaaaaagcccaacagatcaactgacctgtcaggcaacgtcatttgcagccgtctatcgggcttgaaccgacgacctcatccttaccatggatgcgctctaccgactgagctaagacggcaaatgtttcggttgtttaaaaacaactgcctaattaatgtacactaaatctcctgcactcgcaagccttttttggaaaaagtcgtcaggattgtcgactaagaatgggctgatttcgaaaaaatcatcaacaagcttgcaaacgattccttgccgatttcatcctcgtaaattatccgagtgccgcctgcttactagtaatgatcgcgacaggaaataattgtcatcgtgtttgcctcaatttcgtaaattaagcggtgttcttgcgtgattcggcgcgaccacataccagacaagccgtgtttcaatggttctggtttacccaggctatcaaacggtgtccggtcgatcgatgtgatgagccgattaatttttctgagcgtggctttatcagcttgctcaaaccaactgatatagtcgtgctaggcatcgtcagtccagcgcttaatcatccccgccaccgacatcctttaaatcgtgttgccgggttttaccagcggcaatttgggcttgaccacggcggatcttggccatgagttcaggattcgacaaaatcctcatcgtttcttgcatggcatcaaaatcacgtttattcatcaagacggcagtatcagcctcattatcacggctagtaatcaagagtggcgtggaggtgtcattgactgcttgaaggtagtgcttgagattgcggcggaaaactgagtaggaaacagcgtccatgagatcagcctctttctggaattcattgcgtcagaacttgctgaattaattgtgcaattaaatgtgcatgtaaagcaagatttggtgaatggtcgaactccctaaatgaactcgttgagcgtcgcaatgggcacagacacatctcaatccccccgacacaatcgcctcaaaccgtaatcacgcggtcgagttgatctttaatttcacgacgcagattatgggtcaccataattaatgtggttttcggcagtgataccagcagcttttcaatggagagcccagctttcgcgtccagtgccgcggtgccttcatcgctgatgatgagccggctttgtctgatcagacccctcgccaaggcaatgcgctgtttctgcccacctgacaaatcaccaccattgtgtttcaacaccgtatctagcccttgcgtttggtgcttcataaattcagtcaattgcgctcctttgatggcctgttgtaacacatcgtcatccacttgccgcccaagcgttaaattaaatcgcagcgtgtcgttaaaaatgtaaggggcctgttcgatgtaagtaatctgatcccgtaaagaacgcggatcaagctgccggtaatcgtgcccatcccaggtgatctcaccgcgataatcggccaacacatcgctaataagtcgcaacaacgtggttttcccccgcccagatggcccgacaagcgccaccttttgattggcctgcaacgtcaggttcagatcattgatgaccggctcgtttttatgcgggtatgtaaaggtcacattttgcagcttgatagcttcggtcagcggtgtcacaggcgttttcgcctcttgtggagccggcgctgacttggcaaacttatcgaaaatcggggcaaccgacttgacggtggtcagggcaaagctcatcaacgtcaagccgctaaacgttgtccctgcaacagaatgtatcgtcaccaccgcgccaaccggaatgatgtgattgtaagcaagtaacccggcctgaatcagtaagaatagctggctccccaagttaaccaaattgatcagaaactgagtggccatattaaactgaatgtagccgacctgcgcatggccagcgtcatccgaagcctgctgcacccgctccaccatgacgtgacgccgattggccatgaagagcgtattaaaaccttcaaggatgtcggtcaatcgattggttaacttctcgttttcctgactccatgttgccgcggcggcgcttagctttttgcgataaatcatcggtaccgtgattaagagcacggcgcaaaccaatgtcgtgataaacagcgaagcatgatacgttaacaaaacgaaaatactgagaaccacctgccaactggcctgaatgagatatgcgacattgcgtagcccctgcgtgttaatggtgttgacatcattggtcatccacgaagtataaaccgcatctgaccgggaatggtactgttcaaacggcatcgtcgcaatgctcttggtgatctgcgtgcgaatgtcattgttcaaccggcgttgaagcgagatctgataaatgttgaccaacgtctgcacgaccaattgcaaaattgtcgctacgaccatcacgattgccgcagtcacgaacgcattgaccttaaattgcgtcaatgccgtaatcatgttcccggtaaaaaccgataccgccgtcatcgcagcaatcatgacgccatacattaagataaataaaccaaaccgccattttagtcggaaaagatactgtcgaaaagtcactgaaaatgcctcttttcataaggaacacgatccgtctatgccggaaatgcaaactgacacgccgagcaatgccacaatcaacgcattggaatattagaataagcaaataatagcatcgaattctcataataacaatcgttgctcattatttccgtgtgctattgtgtttttgcgcatttgcctgacgttgggcgttagaacgatggaccaattttaaaaggtgttgagtttttaggtgaatatcatgctgcatctgttgtagatttgacgtggacataaacatttcttcgtatattttgggtcggctcaactatgcgccgcggttcagtttgtgtttgttttgatactaaaggatcccaatgtatgaggattttagcgcatattcaactttaacgttttagtttatatgtagaaatcctaccttgacctatacctgcatgaggtacataatgccattattgtcggttagcaacgatcgttataaggtataaaggcacttttgtcagtcactagcaatctattaggtagtcccatcacggttctaagtttaagtctccccccttacatataatgagccccatcttataagcctaatcgttgcaattaccacgaaaactgtgccttttattgtgacattcagatgctgttaccaaaggaggaatatctgttgataaaatatcgagtcactggctttatcattttagtgatgaccatcctttttcttggattggatctacttaatagcagcaataagctacttgctctgttatctgcccttttttccctgctaaccgctgtttggttcatctattacaacaagaaagtcagaaagttcaataataactaggtgtattgccagtcttcctcgtaaaaagaccgttcaatattcgttcggaacgttgagtcttttggctgaaatgggaaagaaataagaactaaaaagcaaagatgttcctccgaatatgatttttcattatatttggggggatttttatatgctgtggtcaggaagtaggtcttcttagtcctctgccacgttttatttcttgccaacctattggttacttgttcacactacatccctttgctcatcgctcgccgcccaactcggccttaaattccgtcaaaaagtcttccataacctgctgccgatgttcagcaagttgcttggctgctggggtattcagctgatccttcagcttcaacaatttctcatagaaatgattaatgatggtgctttccttcgtgcgataattgcttggcgttaaggcagttcgcggtgccagttccggatcatacatgcgaccaccatgtgtgccaccgtacataaaggcgcgaccgatgccgattgccccaatagcgtccaatcggtctgcgtcctgcaccagctgaccttccagggacaaaggctggcgcttccctaaattggctttaaaggacatgtggtcaataattgcgataattgcttgaatctgttcgtccgtcaaaccggctgctgccatcgcatgacgcgcagccgacctcgctgcggcgacatcgttaaccagtttgtcgtcataagtgtcatgcatcgtggctgccgcgacaacgacggccgagtcaacgcttggagtttcggcggctaaccgctttgccatcgcgatcacccgctcaatatggtcgaatccgtgaccgctatgatcctgtgtggaaacggagcgcgcataggctgtcaacgcctgccaatcaatcatgtaacgtaccttccaatctttcaaatgtgattacctgaactaattaaccgataagctaccctatttgttgcatggcttaacctcgagagttcatacttaaagtataaagaggttatgtaaaagggggaactttaaaatgaaaaagcattgtttgtcggcgagtcaatcggttaaccaattccatcgacttttctcaccagtgtcatcttcggacatcccattgaatcagcaaaatctgctattctggatggccacggagctgacaccaaaaacgccgacgagtcttgccaaggagatgcatgtcaccaaagctgccatcaccaaagccagcgggccgttgcttgaccgcgggttgcttgacaagcagcctgacccggacgactaccgcagcttcaaactcgtcctcagcgaagcgggacaagacgccgtcgaggatctggggcctgaatatatggggaaccttgagcgcctgtacaacgaattgggtgaaaagaaatacctcaagctcattaaactgctcagccaggccaccggtgtcgcagtcgaagaataagccaatcggtcatgttcggcaatccgccttacgcagtgcttgcgtgaggcctttttcgtattttctcaactgcgttacaataaacccatagtgacatatcactcaacattaaacagtttactaattccggcaaaggagttcgattcgatggcaattccagatcatatcagtgttcgcggtgcctatgtcaataatttgaaacaccttaacgtggatatccccttaaacaaactcgtggcgattaccggtcgttcaggctccggtaaaagttcgctggcgatgggcgttttgtacgcggaaggcatgcggcggtatatgagcgctttgtcgacttatacgcgccggcggttagggcagacaagtccagcggcggctgattcggtcaagcatattcccagtgcgatcgccctcagacagcggccggttgtgcctggcattcgctcaaccgttggcaccgccacggaagccttaaatgtgatccgcctgatgttttcgcgtctcggctcaccggtttgtccaaatggtcaccgcgttccgccgacacttgatattgccaaggccatggatctgccaaatgatggcgaaagcgggatgggcatgatcacctgcccaacttgcggggttcactttatggcgttcgcggcagaagattttgcctttaactctactggcgcatgcccaacctgtggcggtacgggtcaagcgcggacgctggcggccaatcgcctcatccccgaccaaacgctaaccattcgccaaggcgccgttgcctcatggcggcttcctggacgtaacttcatgccatacgtcgcccaggcaatcggcattgacatcgatacccccttccaggatctgcccaaagaccaacaagaacaggtttggcatggtcaacggaaaaaatacgccatcaacatccccagcaaaacaggcagagttttccacatggaccatgcacaatacgaaaatgccttcaatgcggttgaagattctttagccaccaccaagaatgaacgtgcgattcagcgcctgaatcggttctatgaattcggcgtttgcccgacctgtcatggcagccggttcgcgccgaaactgttgtcacaacttttggttgatcaaaatatcgcgcaagtcagcgacatgaccctgacgcagctttccgcgtttatcccgaaaatctaccaatggctgccgcaaaatatgcaggcgttggcgcacgacatcattaaagaattgacgcaactgctcaaaccgatcatggatctaggcctgagctacctgacgttaagccgggccgccgcatcactgtccaccggtgaattacaacggatccagctcagtcgaacactacgcaccgaaacaaccggcgtcctgtacgtcctcgacgagccttctatcgggttgcatgccgccaatgttgccggtttattggaagtgatgcacggcttggttgatcaaggcaactcactggtggtcgtggatcacaacacggcgatcatcaacgccgccgatcaaatcgtcgaaatcggcccgggtgccggcgttgacgggggtcgcattctcgatcagggggatcccgccaccgttagtcgcaatccgcattcgttaattgccccatttttaaccggcaaaacccaactcatcgtccgcccgcaagctggtgccgaagcagttgccaaggccaagcaattgcagctgaccgtcaccgatcgcttcaacctgcacaacttgcatgtcggcttcccgattaactgcttctccgttgtatctggcttctccggcgctggcaagtcgacactcattttcgacgcgttagtcccggcattgtcagcaacgaaagatcagccgagcccgacttttgtccgcgatctcaaaagcggcggcattcggcatgtggtcgccattgacgcgacgccggttggcaaaaatgtgcgttcaactgttgccacttatactgacattctcgatcacctgcgccatctgttcgccgctttgccagacgccaaagccaagcattataccagcagtcacttctcctataacgtcaaggcgggtgcctgccccacttgtggcggtaccggtgtgatcaatctggacattcagtatttgccggatatgcagcaaacctgccctacctgccatggtcgtcgctataatcccgaagtgttgaaaatcaaatggcacgaccgcagcattgccgacctgctagatctcgacgtcgataccgcactcaaggtgttcaaggacgaaccggcaatcgcccataccttgcagacactccacgacatgggactgggctatctgcatttaggcgaaagcacaccaacgctatccggtggcgaggcccaacgactcaagctggtcgcacacatgggtcgttcccaaaaagacacgctattcgtcttcgatgaaccttctgttgggttgcatccccttgatgttcaaacgttggtggcagttttccagcgccttttaaaaaccggcgcaactgtcattgccattgaacacgacctagatgttattgccaacgccgattacgttttggacttaggaccaaaaggcggggctgaaggcggccaggtcatggcagccggcacgccacaagccatcgccagccaaggccacggtgaaaccgccaaatacttagcggcacatctggcggcttttcaggttaaatgagaacaaacaaaatcggctccagagatcatctctagagccgattttttatatccagcgcaacctgctcgcgccttatgcgttcaaaatatcatcaatttgttgaacctcttcagccgtgaatgtcagatgttctgtcgccttgaggttatcctcgagatgctcaactgaggtcgtgccgataatcacgctggtaacgactggatcacgtaaaagccatgccaacgccatctgggacaatgtctggccacgtccttgggcaatctcgttcagatcgttgagctttttaaccacagcatccttgcctttcgcaaaagtgcctttgttggtgcgatggatctggaagctatccggaatgccgttcagataccgatcagacaataatccttctgataatggaccatacgcaatcaacccggcgccattcgccttcaaagcatccgtcaggccggaagtttctgcctcgcgattgaacatgttgtaactgaactggttcaagacaaacggggtatgcaggtctttaaacatcgcaatggcctctttggtctgctccgtatcataattggaaatgccgatatacaaagccttgccatcccgcacggtttgatcaagcgcattgacggtctcttccaacgccaccgtgtcatcgaaacgatgtgcataataaatgtcgacataatccagacgcaaccgtttgagggagtcattcagtccttgaatgacggctttacgtgaagtgccaatgccatatgggcctgggtggatttcatagccgaccttcgtgctaatcaccagttcatcacgataatccttcaaatcagttgccagaatctgtcccaacagcgtttcgctcgaaccgtatcccggatcaacatcgccgttaccataatgattggcaacatcaaaatgaaaaacaccatgatcaaacgcatccagaatcaccgaacgccgtgaatcaaacggatccagattgccataatgctgccacaatcccaaagaaattgccggcaacatcagccctgtcttgccggcatgacgaaccggcatcttcgcataacgatctgttgctgcatgatacatgaacaaatcccccgctttcctagttgtcagtgagcgtgagccagcccggttagaaaccggagtgtaagtggccttgggcgtgatggtcgggctttgaccattgcgaccaaggtccttacacgcaggtttctgggctggcgaacgcgttatagtgagcgtgagccgacttctgcgccggcgaacgcgttaatggcagacagttacaaaataaaaacgttacaacatttaccatctctatggtggcaaacgttcaacaaacaagcaactggaaaccctgttttctccataaaaatttatttttcaaaaaattccgttaaaaaatgtgccacgccgtcatcgacattggtatcggtcacataccgagcaacgcgcttgacttcaggcacggcattgcccatcgccacactaacgccagcggcctgcaacattcctaaatcattaaggccgtcgccaaaagcaatcgtgtggtccggcccaatgccggtcttttcctgtaattcgcgcacagcattggctttatcgacatgcttgggaattaattccaagttagtatgctcagaagccgagacatgcaaaacatcacgcgcctccaaggccgtttttccggcaaccaaagctttcgtatcattgggtccaaaaataatgccgttcgtaatcactgcggcgtgggtcaatagttcccttatcgatggcacgccgaccaccttaatttcaaccgatttaggtgcaaacttgcgggcggctgcttcaatggcgggtggcagtgttccggtgaaataaacggtatcatcactaaagtataaagcgttcagattcagatcggcactgacttcttcaactgccgtcaatgcttcttcaccaagtgtgtgatgcacccgttcaccggaaaagtcatacacggcgccattagaagcgataatgctggcgtcgggctgaaactgtttggcaaccacttctgccagcgcatgcatgcgcccagtcgcaacataaaaagctgcgccggctgccaccgcattttccaatgcctgagctgtgtttactgtgacatcatgatgattggccgttaacgtcccgtcaatatcacttacgattaagtatttggccatggatattccctttcttttgagtgagcttgaaccagcccgattaggagtcgtcaaacgcgttataacgagcaaaacactatatgaaatcggccatagaaacatcacaagtttctatgaccgattctctttaacactcatctatacaatcatttcaaatacgtttccgataaccgcttaaaccaaacgcttatcgcaatcgttgcttaaagtccctgcggcagcttatcaatctgcgcagcataccattcttgccatggtgtttccggagcgccttgtgcattgtacttaaccttaacctgcttcagaagatccagcagattacctgaccgatgcgtcaacaagccgctcgtcaattcctcccgcgttaaagtacggttgtcgaggagataatggttaatatcggccaaatcaccttgcttatcaagctgggagaaaacgtctaaccccgctccaaagaaccggttaaggtaaaattttgcaaaagtttccagtgcggtctgttgtgccgcttcattcaattgatcgatcgttgtgttgctagctgccatgactaatttcgtcctttctattttattccattataaccacttttaggcagtttttgaaaagccctctaccggcaacgtcgccgttttcaaaaaataaagaaatatttttaggattttgaaactttccgcctctagtaccttgatattggagaacgaatgttataatatgccacttatgttgggaatttttgaaaggctggaggcattatggaaaaagaaaaattacatctcggggacgctgtggtttgtcaggttaaggaagacatggaagcgccttttaccgggaaaatcgaaaaagtttacgaaaactctgcattgctcaccattactgactatgcagagcaagaccgacagaatgcttcagagctgaattttaaaattgtaacaaatttccacgccatgactaaaaaccttggcggcggcactgtcttggcattcccaccagaatcagccgaggatcagaaaaaataatcatccgataacgatcagccaagcatgacttactaacgctgtggccatgccggttgttattgtttacttagtcgcatcccaatagaacaaactacccccggcagcccgcaaactaggctagccggggtttttaatagctaaaacttaacttaggtgtttaaacgacttgtagctatcttgactgccgaggcattttcgttgtcaagatggcgaatttgggtacaataagtggcgcggttcacacattatcattaaaaggcggcaatccatatgcaaaccaaagatcaacccatccacgaaagtctattaatcggcacgttgcttaccggcgctgccggcagctttgatgcgtttacctatttgctgcatggcgaagtttttgctggcttgcaaaccgggaatgtcatcctattaggcgtgcatcttagtcaggcgcaatggtatacggccattcgttatatcgtaccgattctggccttcatgttcggcacgatggcggcacgggccattcaactgcaagccgataaacgtcagcatcccttgagcgaacaacgctggatcattcgttacgaaatcggattaattttgctcgtcagtctgctgggtcgctggctacctgacttagtcgccagcgccatggtctcgctcattgctgccgcccaacttcaggagttccgccggttacgcgggggcccgtttacttcattaatgatgaccggcaatctccggacagctgcccagaatctctatgatggcttcattcgcggccagcaaaaaagccgcgaatccgcagctgtgatcggtaccattatcctgagttttgcggctggcgctggtatcaccagcatcctcacccactatatcggcacctatgctttggccggcgcggcgctgtgcctaatcgccattgacggcattttctggcaagaccagattaaactgcattaagcgctggcttccccagccactttctgcccctgatgcaggaagcctaagtcattaaaatccgtgacccgaaaacgctcgttagtccaggacaatttggtaacactggcattgtcgagcatttcccgtccatcaatgttgtagtggatgtaattcaaccacatcaacgcagcggttccgtgggtcaccaccaaaacgcgctgccaatcttttgtctcggcttccacggcaattgcgcgcaaagtccgattgagccgttcctgaaccatgcgattcgtctcggcagtattcggatgttgatccatattagccgcaaacgccgcatcagccgtttgcgccaaggtaatttcgcgattggccaaggctttgtgaaaattggcaacacccatggtcgctaacgaaaaatcattcgccagctgcccttcaaacttgccataattttcttcacgtaagcccatcagcgttgtgaccggcaacggttcatctagcccgcttaaaataaaatgcgccgtgtcgattgcgcgggtcaaatcactcgcaaatgctgcattaaatcgaatgcctgctgtcttaaaccctaatcccaatgctttggcatccgcaatgcctttggcggttaaggcagaatcagccattccctgaacccgtttttgaacattaaattcggtttgcccgtgacggacaagataaagcgttgtcatgataataatcccctaatttctgtgagcgtgagccggcgcgttcaggagccggagtataagtggccttgggcgtgatggttggtttttggccattgcgaccaaggtccttatacgcaggctcctgcgccagcgaacgcgttattttcatcgttgacttgtccctaagccagtttcaggtaatctgctaaataatccgcaacgccatcgtgttcgttatcacttggcgtatgcgcgtcggctgctgcaagaatggccggacgcgcatttttcatagccaccccatgaccggcaaattgcagcatgtccaaatcattcatatcgtcgccaaacgcaataatatgcgactgatcaatgccgtaacatcccgccacataagccaatgcccgggatttactcgtattgcggctagtgacttccagcgccgtgtactccccgctccaggcgccccaggtcttggccgccagatgcggatacaacgccgcaacctgcgcggcaaccggcttgaagatcttggcttccataaacatggtgaccgaaatcggcgcctgccgcaacccctgctcatccaacaacgcatcaggatgcaggcgatccggtaaaaacgggatgttggcgtatggccgatccgccaccaacaagcgcttgccttctgccaccatgaccttgaacgcaaactcttgcttcaactggcgcaaggacaaggcaaccggaatcggaatcgtgacttccttttcatactgccagtggcggtgcggcatgtgaatcaaggcaccgttgaaattaatcatcggcccttgcagtttcaaagcatcataaaattgttcggaaatcgcatccgggcggccggtagcaataaccaccaaatggcctgctgcctgcgccgcctgcaaaacagcgatcgtgccagcgctcaactgaccatcagcgttcaaggtcgtaccatccagatccagtgcgataagataacgattcatgcagcagcctcttttcaatcatttttcgaaagcgatcaaggatagccatctgcaacccgttcccctacaataggtagttagaaagcgaggacaagatggctgaatcaattgtactttatacagacggcggcaaccgcaacaccggcaatcacgctggcggctcagtccgtcccaccgataaaagcgcgtgggcggcgttactgatctatggggagcacgagaaaatgctctctgaaggcgattacggccgaaccaataattatatggaaattatggcggtgattcaaggattaaaagcgatcaagcgcacggacattccagtcgacgtttactccgattccgcatacgtgatcaacaccatgcaacagcgctggtgggtcaagtggcagcaaaatggctggcgcaaccacggcaagccggttaaaaacgccgagctatggcaggcactgttgcatcaagttaaccgctttgatcacgtgacgtttcataaagtgaagggccacgccaccaatcataacaacaatcgcgttgatgaggcattgaaccaaaccatggatcggctcgatgatcgctcctgatcattttacccttgatggcctaaaaaagcttctccataggtctccgccaagaacccgttaatcacctgctgcattttttggacagaaggtgattttttaatggtcggattaatcaccaaacataacgtccgggaaaatggttcagaaaacgggtaaacattaacatcacccaccagcttctgcaaggccagtttgggtaaaatgccaagccccaggcccgactcaaccatcgataaaatgctttgatcgtcaattgagtaattaatggtattcgttgacacatgataacggtccagtgcgcgcttggtgtcgcggtcatagtcgatttgttgaagaatgaagttccgcttttcgacatccgcctgcgtcaccgttttaccattcttgggcttgaaacttttcggcgtgatacagtaaatcggatccttcaacaacggctccacgaccactcccgggccaaccggcagtgatgaaaaccccagatcagccgttcccaatcgcacggcatccacaattcgattgaaggtgccttgaaccacgctgatttcaatgtgcggataccgcttcttaaaccgttgaataatcgtgggcagccagttcgtggataccgacgaaaacgcgccgatacgaatacgcccggtattgacgccattgatgttatcggccacttgtgacagctgttcttcaagattttgaatactctgaataatcggcaacacctgcgcaccgtcttcggtcaaggtcacgccggtgcgattgcgaatcagcagcggaaagcccaactcactttcaagttggctgatgctgtggctgaccgcactcggtgtgacattcaattccgccgccgcttgtgccagtgtgccgcgttcgacgactttgctaaaaacctcatacgaaaaattacccatgatattttttcttccctttcaccgcgaagctgaagtgacagcgcttgtcacttcggcaagacaaatcccgtcacatcaatcgccaagcgtgttcgttctttttaacatgaacaatattcaacttaacctgaaatagttgagctttactcaatcatacgagccgttttacactagtgtcaataagaaagcgttgatcggatttttgaaccagcgcgacgaaggtatcgcgccgcttcttgcatcgataccaaagggggattttcatcatgaaattcgcaaaacgtacacaaaaaaccggtaaatcaggcttagaggatctgttcgcggcttccggcccgaatgtgatttcctttgccggcggttatccggatcgcagcctgttcccgactcagcagctcaaccgcgcttttaagcacagttttaccagcggcgataccgaattgttgcaatacgccagcacgcaaggttacctgccattacgggaaaagattgcggcgcggctgcgagccaccggtatgccgacccgtgctgccgatatcatgatgacgcaaggtgcccagcaaggcatcgatctggtcgcgcggttaatgcttgatcctggcgacggtctggtggttgaagccccaacctacttaggcgccttggctgcgtttaatgcttatcagccaacttactacgaagtgccgatgcaggacgacggcattgacatcaatgctctgcaacgagttttgatgagccgctccgtcaagttcatctacacggtaccggattttcaaaatccaactggcatcgtaatgtcgcttgccaagcggaaggccatgattcgccttgccaatcaatacgatgtgatgatcctcgaagacaatccttaccgtgatcttcgctatgatggcaagccactgccaaccatcaaatccatggatacagaaggccgggtcatctatctcggcagcttcagcaagatcctctcacctagtttgcgaatgggctggttagttgctgcaccggagcttttgaaagagctgatcgcattaaaaggcggcagcgacctagaatccagcaacttaacgatgcacgggatcaacgactacatggaagaaaacgatctggacgcgcacatcaagcagattcaggatcgttaccgtgagaagaaagacgcgatggttgacgccatgacccgctacatgccggctgaagcccatttcaataatcctgatggcggcttcttcctatggctcaccatgcccgccggttttgacatgggtgccttcatgaagcagcatctattgccggaaaacaacatctcctatgtgccatcggccaatctatatgcgacctccgcgcaagtcaacggcgcccggctcaacttcaccggcccgaccttggatcaaattgacaccggtatcaaggcattaggcgatgctttgaaaatggcattgcaccaacctactctggttgccgaacaggcttagtcacctgacgaatcgtgttgcttaggcggtaaactttacaaaatgacaaagtaaccatcacattttcgtcatactttgccagtagtattggcaccatagaaatgagccacccactcattcctaaaccccaacctaattttcatttttctcctccaaagaaaaagatgattggcccccatccgatcatcaccccaaaaaaggctcgctgcgtttggcagcgagccttttgttgtggacctataacttttcgaaactaatcaacgtgatacttaaactaaccggtcaacgccaaagcttgatggatcgtctttcttgtcatcctgcttttcatcggtctcagctggcttttcagtcttgtcttcgtcggttgacttgacgtcttttttagcgtccttcttgtcgtcgtccgtttcttcaggcttcttaggtgcagcctgttcacggattttggcttcgatttccttagaaatttccggatgttcatcaagataatgggaggcgttcacgagcccttggcccaaacgctctttgccatagttgtaccaggatcctgatttcgtaatgacgtcaaatttactgtctttttccgtcactaagttgatcatgtcggtgttgtgctcaatcccatgaccaaatgacatcgttgtttcaaccgtcttaaatggtggcgccaccttgttcttggtaaccttcagcttgctggcaaaaccgatcacatctttgccatccttgacttgctggccttttttaacctcaatacgaaccgaggcatagaacttcaaagcgcgtccgcccggcgtaacttccggattgccaaacatcacgccgactttttcccgcaactgattgataaagatcaccaatgtattggtattgttgatcgatccagccattttacgcagcgcttgcgacattaaccgcgcttgtaagccgacatgactgtcaccaatggcgccttcgatttcagccttgggaaccaaagcggcaacggagtcaatcacgacaatatccacggcggcagattcgatcagcatttcggcaatttccaatccctgttcgcccgagtttggctgggataacagaagatcatcaatgttgaccccaagttcagccgcatattttggatccatcgcgttttcggcatcaatataagctgccttgccgccggacttttgcaactctgcgatcgtctgtaacgcaattgtggttttcccggtactttcaggaccatagatttccacaatccggccgcgtggcaacccgccgacaccaagcgccaagtccagtgaaagaatgccggtcgaaacaacatcaaccttcagttccggccgatcacccatcttcatcacggcgccttcaccaaacgccttcttgattttctgcagcgccttttctaattcggtttcgcgatctgtggtatcagattttgtattcgcattctttgtggtcgttttcttcgccatatttgtctccttaattacgcgcacacagcgcttaaaatacactagttacattatcgaacatgcgtttgttttttgcaagcttttcattcaacaaaacggatttttctgcgtgccaaattggtttcccttctattttacctgaagcatccgggcgattgggaaaaatctgctgttattgatgggttgaaacgtgtttgctggggcaggagtctgcgtgtaaggacctctaaacacaagttctctgctgcgtctctgaaacgcgctcgcaggcccagaaacctacgcataaggacctcgaacctaaatggccaaagcccagccatttaggttcggggccacttatgctccggtttctaaccgggcctgctcacgctctgttgaaacgcgttcgctgggccagaaacctgcgtgtaaggacctcgggcgcaatggccaaagcccggccatcacgcccgaggccgcttacactccggtttctaagcggcccagctcacgctctgctgaaaacatgctatgatggttcggtcagtgatggcaatcatacacacaaggtggagaaaacaatgatgttcatgggttccattgtcaacggcttaaccattatcggtggcggtctactcgggctggttttgcacaatattagcgacaacgccaaggatacgattaccaaaagtctgggacttggcacgtttgcgctaggcattcagatggcgttgcagaccaagagcttcattgtcatcatcattagcctgtgtcttggcggtctgctgggtgaatggctgcatattgaagacggcatgaatcatcttggcctcaagctgcaggagcgctttgcaaaaggcaacagccactttgcagaaggtttcgtcacggctactttaattgccgtcattggtgccatgagcattctgggcgcgattcaagccggcgtttccggtgataacgccacactttacacaaaagcggtcatggatggattcatggccatcatgatgaccgcttcacttggcgtcggtgttatgttttccgccattccggttgtcctgtatcaaggtaccatcacgttgttagccagttttttagtccaattcatccccaaaaccttactggcgacgtccttgcgcgaaatcggcgcgatcggcggtttgatgattctaggtatcggcttgaacctcatggacatcaccaagattcggatctccaatctcttgccagggttgctcgttctcctggcaattctgactggtcagtactttttataaattaggtatctaaaaagcaggccgccttgacctgctttttaatagtccgttacctattacttttttgcggctccgatcagaaattaggaatcaatccttgccggccgctttgaaaacgccgataaaccaccttacaatgccagtcacggattttggctaaaacacgtgagttcgcatcgtgataccaatagcgcagatcgtctttaatgtagagacgattcagccatgcatgatcatgccgcaaaaacgtgaagctctcaagtaaatcctgctcacgccaaacatccggcagcagaaattggctccgcgtaaagcgttttaactgtcgtcctgaataataaacccgttcaatccggccgatgaaaaacgcggtatgccctttaccgacgtatggcgccattggtgcgacaatcagtccaccgcgcagacgctcaaaccagtcagtttgcggacttaccttaattgcatgcgtaacatctttgggtaaccggaagtccaaaaccaacccatccggacggcggacccgtacaacgatatgttgcttcttcatgttaccaccccacttaccttggcccctaaaggcgacttgtcctgctggaaaaagtttaacacgaaatgttcggatttgcataaataacgtttgttccgttaattaacttgttgccgaactaaccagcccgtcaacgcaaggggcaaattcaaatgcgaacacaatcaccacaaagatataatagaatattgcatttgccttcacatttcattcacacactgtcggtagtataagaaacatagaaatgagccacccactcattcctacaaaccccaacccaactttttcatttttactcctccaaagtagaaatcgtcgatcgtcccccaaacgatcagacacccccagcagaccgcccacccagcggtctgctttttttgtgtgagcgtgagccagcccggttagaaaccggagcataagtggcctcgagcctgaatggctgggctttggccattcaggctcgaggtccttatgtgcaggtttctgggctggcgaacgcgttatagaaaacgaaagcccgcccctcacatttgcctcagatagaacatcctccaacgcaaaaaagtctcccgcaacatcgggagacttctccaccaacaaacaccctaccgcttaaacaacgcatacaaagcatccggcgtccgcgccgcctgaaacgccttgacaaagtcctcatgcgtcagcaacttcgccgtattcgacaaatacttcaaatgactaccgctatcatgctccggaatcaaaaacgaaatcacggctgtcaccggtttaccatcaaaagtcttccaatcaaccggctgtgccaaatgcaacaccagcattgccgactgcttaatcgtggcatcctgtgcatgcggaatggcgatgcctttttccatcccagtcgaaccttcctcttcccgcgcaacatactttttgaaaatggcatcggcatccgtagcaaggccattcttaaccgccatgtccgccaaatagtgtaaaacatcgtcacgcgttttcgcaggtacgtcaacttcgatattttccttactcaaaatgtcactcgggtcaaaagtctggtcagcctgatcatcgaccggtgccggctggttgcgtgccgggtcaaccttcaccggtgccgctgtcgcatcatctgcagtgccttctgctgctaaagccgcttcaacaacaccggttttcacgccgcgttttctagcagagcgcccggcaatcatggccaaaagaacacctgatgcagcggcgccaaccagaatccatgcgacccagagaaacggtttgttcaccagtggcaaaacgatgaacccgccatggggtgccggcacttgaatgcgtgacatgtacgtcaacactgccgcaatcgctgagccgaccataaaggcaggaatgttcatcagtggatttttggctgcgaacggaatcgcgccttcggtaatatgcgtcgaccctagcaaagcattgacgtaaccggcactgcgctcgtctcgattataggctttaggattcaacaaaaccgaaatcgtggttgccagcggcggcgcgatgcaggcggctgacacaccggccatgaaaaagtaattaccttgtgcgagtaatgcagtacctgtcagatacgcagctttgttaatcggaccgccaaagtcggcagcacacatgacaccgaccacgacgcctaaaataatcgggctggaactttcaagtccttttaaccacgccatcaagccgagattcatcgccttcatgggcgtgttgatcagatacataatcgaaccggcgatgaagacccctaataccggataaaggaaaatcgcttttaagccacgaaattccttgtcaggcataaaggcaaacactttttgtaacattagaataaccagtccggccatgtagccaccgacaattgcgcctaggaatcctgacccgttgccgccgttgtaggcgatcatcccgactgccatgcccacaattaagccggatcgcttcgccacggcttcaccgatgtatgccgctaagaccggcaccatcaaacccatcgctgcactgccgaccgcattgagcatggccgcgaattggttgtattcggcattcttcgggtcagccgagtaaatcccccagaaaaatgaaacagcgatcaacaccccgccggcaaccaccagcggcagcatatgcgaaaccccgttcattaagctggtataaatcttattgccaatgccggcagtgctggtttcaacgttttcattggtgccagccttggctgtcccaccttttggcatgtaaaccggcgtgctgtcgctcaaagcttccttgatgagtttgtccggctcgcgaataccggctgctaccggaacattcaccaacggcttgccggcaaagcgatcggcatccacatcaatgtccgaagcgatgaccacccctttggctccggagatttcatcctgggtcaacggatcgtccacaccggtctgcccatgtgtttccaccttgatcgttaagcccatctttttggcggcctgttccaacgcttcttgcgccatataagtatgcgcgatgccggtcgcacagccggttgccgcaatcaaatcatattttgccattatctaaccctgctatataaaacgtggaagaatgtctctttgacaccaataaaggttttatatatttcctttcttgattgacatcctacatttcatttagtcccgtcaacaacggtattcccactctgaaataattcatcatgacattgaccgcctcctgaactttaagagtatagcctaccccgtaaccttcgatttcgcataagcaattagattctcaaccgcattttcgtctcgtcgcaacctgacgccacactggtaacaatgataatcatcatgacccgtccgatgtttcaagttgccgcttagcgtgacccgttcatcagccgttttcacataaccacagcgggaacagcgttgagtactagggtaaaaacgatccgccagcaccaacgtatttccataccagccagccttgtactgcatgatcaccttgaacttaccaaacaatgatcgatgcaggttcttggcgagacgtttattcatgcgcatatggtgattatccagatcctcaatcccaattaggtcataatcagtgataagcttcgtcgta

SEQ ID NO: 331 - DNA, 62922 bp, Lactobacillus casei
acgtttattcatgcgcatatggtgattatccagatcctcaatcccaattaggtcataatcagtgataagcttcgtcgtaaacttttgcagtaaatccgtttgaatccgttcaactcgttggtattgacgcttcaacttggttctcgttgtgcgataagccttggagttaaaatgcttgggacttactttccgtttgcgggctaattggcgctgataatgagcaatgcgggcataaagcactggcaaacgatcaggcaaggtgggttgggtggcatagccattcgacgtttgatagtcaaacttgccgatgttggcgtcaaccccagtagccgttagaaccggccgcttttcaacggaagtctgaatctcaattgaaaaggaggcatagtagccatcggcatcttgaacgacgccaacttgtttcagttctccttgccagcggggttgttcggctagtttgatgtcataccaagcaccagcaccatgaggtttatctaaacgtaacttgccagtcacaagttgcgcccgatccgtcttaaaagttttgcgggatcgtttcttagatttccagttgggcttatcatgatctggcatcttcggattgaagtagtttttccacgctttgcttaaatcatttaccgtgagctgcaaaactcgggctgattgttcgtactgccagtcggttttgttccaaaccagctcgtcccgtactttgcgttcattaggccgtaacgttttatccgccatcaccaaagatgcgtcgtacatggcattccaagtttcaagagcttgattccagcaaaaccggcgatagttaaacaaccgctccagttcacactgcatggttgcgttgggatagagtttaatcttatgcgttttaatcaaaagttgtcacctcctctcaattagctggttaaacgccacttgagaggaagctcagagtaagcgttcaaactaatgctagctagcggaacttcggtaagaaccatcatacattaccgattcaggctcttgtcaatacatttcgcagattagcttgggtttgaacacatggacagcttccacttaattattctgtccatgttgtaccgctttaatccatattgttcgtcatatttgagtgttgttaacatcctccagttgcttgatctcaatttgcgtcagtaattcatctgtctgggtaaaatccgtaatccacgcgcgccgggccgtgtcgctgccagccgcaatcgctaatttcaaagtagcggccaaatcctgcttttgatacaacccggctaaaaaggtgccgagcatggtgtcaccagcgcctgccgtgttgagcacgtcaattttaggcgcattaccgaccagcgtaacttcatgattcatgaacaaagctccctcagcgcccagtgaaaccagaatattctgcgctccggcatccagtgcccgatgccccaaagctaccatggttgacagatcagccgcgccggattgatcaaaccaactcatcaattccgcatcatttggcttcactaacagtggccgatacgccaaagctttgacggcttcaggataagcactatcgatgatcaactgaaaacctcgcttctgactcaaggcacccagcttcagcaaaaaacttggctcaatgccccgcgcaaaactacccgaaacgcaaagccaatcttcggcacccagcgtagtcagttgttgatataattgttttaatgttgccgagctaatttctggaccgggattaaccagcttgtattccgtattgtcactcacgacccgcgtaaacacattaatccgggtaaacccggcatctctataaaaatgattgcgaatgccctgctgcgtcaaaaagtcggcaatataatccaacgtaaagccgccgcccacgccaagcgcgacattatccacaccgcgccgcttcaagatacagctgacattgacgcctttcccattcgcctgaatatcatagctatctgtccgattcaccgtattgggagccattgtctgggttttaataaaaagatcaatggccggatttaacgtcagggtataaatcaaaattaaccgctccttcatgtcattcgtttttgcttatctctatgttaaccgctttcatttgaaaagagttttctgctttcagcgattttgtcacctgatcgaaaatgtttttcaggaggttgtttatggctacactcagtccaacagaagcgtatctttgggattacatcgaaaaccaccagcagacagtcgtcaacgcctcgatcacacagttaagcgccgcagccaatgtgtcgcctgccaccattgtcagaacgatgaagaaaaaaggcttcaacggctataccgaatttcggcatgacttgttgaaacgcattggggatgctgaaccttttgggattcttgatcaagtggatgaccagattaaaaaagtgatcatgcaaaatcaaatcgaagttcacaacaccctcgacaatttaaaagtttccgtcattgaagattccgtgcaattgctcgccaaagccgagatcgtcctggtactcgcccgcggcttgtcagaatcgatcgcttctgagatcacgctaaaacttcagctgcttggcaagtatgccgaatttttcagtgatcccaacattattcaaaccattgccggacagatcagtccaaaagcagtcgccctcacgattaccttgaacggtgaaacgcctgaactcgtcgccgccgccaaaacgctggcagcacgcgacatcccgcaaatcattttgacgaccaacgccgaagcgcccattgtccaatacgctgatgaattatttgtgggctataaatcaaaggccgcctattttgacaaatatgaagtggcttcgcgtttgccattgcaagtgatgagtcggattttactggatagttatgtggtgcggaagcggaagcaggcgcgttgatcacgttctgtcgtttttaaagactgaacattcaacatactaaaaattcagtcgagctactttttataccagacatgcagctatttttaaataacataagtttgttaatcaacaagtctcaaccaattgcaaaaattgtcttgttcaattggtaatatatgctatgctagttgctaaatcaggttgtaacgcgaaaatgtgtcagacctaataccattcaggagagaaaagttggactcgaaagtacattacaaacgctacaaaagcggtaagttctggataaccgcactgatctcagtctcgtttggcatcatcggcagcttagccgttccacagctttgcgaagccgttcccgtttacgcaacttcaataacagatgtttcaattaaggttggacctaatgagttttcccagtattttaaactcagcggttcagcctctttttatcccaaagattcaaagacgcaagtacaactcacgcctaatttgcccgatcgcaccgggagcgttgccttaaacaccaagattgatatgagccaaagcttcacactcaagggccggttgtatctgggtgatgacccggacggtgctgatggggttgcttttggattcgccgatacgaaacccggtgtccttggtgatgccggaaatgcttttggcttaggtgggctaaaaaacgcttttggggttaaattcgatgtgtattataacggcgttcggacagagggagctttgccagatgtttatcgcgccaaccaaatgaacgttatctacacggacgacgcaaagggtaacatagtagctggcgttgacggtggcgaaggcgtgagtcacgccaaaattcagggtgcaaacggccaatactccgagttgatcgtcaattacgatggtgacaaccggatcatgaccgtcactggaagcggtgcgacgattaaattcaatgcagcaccctatatcaaaaacgatcaactgtcgatgttcatctccggatcaactggcggcaaaatgaatcaacatgtgttcgactttgaatcgtttagctttaccccgggattagacacggtgaaagaaaacttaaaaaacaatctgccccccacgatcaccgcacctaaaaacgctattaatcaagatcccacattgacgaatgcgcaacgccagcaattgtgcgatgcgattgatcaggcgcttcagaacggaaaatccgcgattgaccaggcgactaaaaccggtgatgccattgcggctttcgatacggcaaaggccaaaattgacgacattcacaaatccggtccgccactggccgatcaaaaggcgacacaaaagcaggcgttaaaagccaaacgcgatcagattgccgatgtaagttataaagattatgcgttaacgatggctgaaacgaagcaacaaacgctcgctgctgatcaggccttggcagatgcaacggcggcggttgatgcggccagtgatgcaaacggcattagtcaggctgccgaaaacggcttgaaaaagattgctgcggcctatcaaccaggcgtgcctttagctgaccaaaaagccgcccaaaagaacgcactcgccaatgcagcaaccagtgctaagcaaaccattcaaaaagacccgactttgacaactgcacagaggaaaaagcaattcggcctcgttgacaatgccgtgacagatggggaaaccgccattgatgcagccaatactgctgataaaatcaacaaggctcttgcagctggtaaaatcagcgtcaatcaagtgcatcaatccggcgtacccttagctgaccaaaaagccgcaaagaagcaagcattgaaaaccaagcgcgacgaaattgccgacactagcaccaaagatctgacactaacaatgcaagaaacgaacgatcaaattgcccaagccgacaaggcactatcagcggctaatgcagccattgatgcagcagccgaggcaggcgtcgtcaatcaagcggcaacagacgggctacaaaagattaccgacgcttatcaaccgggagcttctttagctgaccaaaaagcgacacagaaaaaagcgttgaaagccgaacgcgaccgaattgcggacgtgagttataaggattattcgctcacgcttgccgaaacgaagcaacaaaccagcgttgccgatcaggcgctagccgatgccagtgcggccgttgatgcagcagcaagcgcagatgcgatcaacaaagcgaccgcaagtggtttgaagcaaatcgccgctgcctatcaaccgggggttcccttagctgaccaaaaagctgcaaaaaaacaagccttggcaaatacggctgacaaagctaagcaattcattcaaagtgatcgaactttgacaactgctgaaaagaagacccaacttgctagcgttgatacagtgttaaaagatggcgaagctgccattgatgcagccattactgctgataaaatcaacaaagccgaagcaactagtgcgtctgccattttaaatgttcatcaacgcggaaccgacctcgccgatcaaaaaactgctcagaaacaggcattgaaaaccgagcgcgataagattgcggacatcagctttaaagacttgacgttaacgatggccgaaaccactcgccaaacggatacggccgatcaggcattagcagctgccgaaacggccattgatgctgccaatgatgcggatggcatcgtgcaagcagccgatgatggcatacaaaaaatcacggccgcctaccaacccggcatcccgttagctgatcaaagagccgcacagaaaaaatgctggcaaccgaagccgccaacgctaagcaaacgattcaagccgatccgactttgacaaccgcagaaaagcaaacgcaacttgcgagcgttgataccgctttgacagatggcgaagcgagcattgacgctgttggcaatgccgacaagatcaacaaagctgcggcagccgccaaagacaagatcaacaagatcccgcaatccggggtcgccgttgccgatcaaaaagcagcgcagaaaaaggcgttgcaagccaagcacgataaaatcactgatgtcattaatcaggatctgacactgacaagtgaggcccagaagcaccagattagccaagctgataaggctttttctgatgccacggcggctatcgatacggctgccgatgcagataccattaaccaagccgccgaagatggtttaaaagcaattgctgcgacttatcacccgggaacgccattagctgaccaaaaagttgcgcagaaacaagcacttaaagctgaacgcgatcggatcgccgaggtcagcaacaaagacctcgcgttaaccatgaccgaaacaaatcaccaaatcagtatcgccgatcaagcattgaccgatgccagtgcaatcgttgatgccgcggcgagtgcggacgcaatcaaccaagcaaccgcagacggcctcaaaaaaattgccgccgcatatcaacccggcgttccgttaaccgaccaaaaagccgcgcaaaaaaaggccttggcaaatgatgccgccaatattaagcaagccattcaaggcgatccaacgttgacaaccacgcaaaaggcccagcaagtcgccaacgttgacaccgccttggctgatagtgaaactgcggttgatacagcgaaaacagctgatgccatcaacaaggccgtggccgctggcaaaacgtctatcagcaacgcgcaccaactcggcatcgccatcgccgatcaaaaagctgcgcagaagcaggcgttgacttccaaacacgctgaaatcactgatgttatcaacaaagatctcacgttaacgaacaaagaaatgaagcggcaaataagccaagctgatcagatgctaacggaggccaaagcagcaattgatgctgctgccgatgcagatgccattaaccaagcggctgataacgggctcaaaaagatcacttcaactcatcaatcaggcacaccgctggctgatcaaaaagtcgcgcaaaagaaagtgttggccgatgcagccgataagaccaaacaaagccttcaaggtgatccgaccttgaccacggcgcaaaagcaacaacaacttactagcctcgacgctgccctagctactggcgaagccaacattgacgcagcaactagcgctgacgccatcaacacagctgcagcggcgggtcaggccaacatcaccaacgcccaccaatccggagctgccattgccgctcagcaagcccgccaaaaacaggccctacaagccaaacaagctgccgtgatcgatcgcatcatccatgacccaacattgccggccacggaaaagaaaactcagactgcgcttgttgatcaggctcttttaactggtaaacaagccattgatgcggcggtgaccgctgatgcgattcagcaagccgccaccgtcagtcaagacaacatcgacaaagcccatcaatccggagtggcaatcgatgatcagaaggcggcgcaaaaggcccagctcactgcccacgccaagcaagttgaacaagccatcaaagatacccctactttgaccactgccgaaaagtctacccaacttgacgcagtcgccaaagccttaacgactgggctgaacaatatcgatgctgctaccaccgccgaccagatcaacgctgcttccgttaccggtaaaaccaacattgcggcagcgtatcaagtcggtctccctttgaatacccaaaaagacaacaaaaagaagcagcttaagaacgccgttacccaagccaagcaaaccatccaaggtgacgtgactttgacatccgctgaaaagcagcaccaactcgataaggttgcccgtacctccaaaacggttagcgatgcaatcgataacgctaagaccgcagatgctatcaatgcagcgtttgatgccggcaaagtcgatattgaaaaagtccaccaactcggcacacctttaactgctcaaaaagatgcccaaaaacaggcactggccaatgagctcgccaaggttaagcaagccattcaagctgattcgaccttaacaacggccgaaaaacagcaacaagtcaatcatgcaaaggaagccaaaaaagcagctgctaccgccattaacaatgccaagtcagctgacgccataaacgccgcgtttgacgctggcaaagccaacttggccaccactcaccaccccggcgccgcaattgccgttcagcaagcagccaaaaagcaggcactgaatcaggaactcgccaagatcaagcaagctattcagcacgacgcgaccttgactactgccgaaaagcagcagcaagccgacgcaactgataacgcaggtcaaacggccgcaacaacgctcgatgctgccaaaacagctgacgcaatcagtgccgcatttaacgctggccaagctgccattaaaaagacgtatcacccgggcaaagctatggctgatcagaaaacagcgcaaaagcaggcgttagataacgtaaccgctaaaatcatccaagcgatccaaggcgacgccacattaacgacttcccaaaagcaacaacaagccgacgccgcagccaaggcagcacaagcaacggcaactgtcattgacgcagcaaaatctgctgatgacatcaaggcagcgctcgtcgcaggccaagtcaccgtcgccaaggttcatcaacccggcagtccgatcgccgcgcagcaggctacccagaaacaaacgcttgaccaggaagcatccaccacccatcaagccattcagcatgatgccacgttaacggctactgaaaagaaccggcaattcgctgcagttaccacggccaataaaactgcccaagtcgccattgatgctgccaaaaccgctgatgacattaacgccgcgtttaccactggcaagacagccattcaccaagcacatcaagccggcaaacctatcgctgaccagaaaaccacccgcaagcactcactagccagtgaggttcttaaagttacccaaaccattcaaagcgacccaaccttaacggctaccgagaaaagccagcaagccaatgccgctgccaaagccggagaaacggccaaaacgaccgttgaggcggccaaaactgctgatgacatcaataccgcatttgctgctggcaaaatggccatcgccaagactcatcaacctggcaccgccatcgccgatcaacaagccgcgcaaattcaagcgctggctcaggcagccgccaaaactgcgcaggccattcaagcagatcctactttgacaactgccgaaaaacagcagcaagccaccgcagtcaccaatgctcagaaaacggcgcaaaccgccatcctggctgctaaaactgccgatgcgatcaatgcagcaaccgttgccggccgcatcgccatcaacaatactcatcaagccggcaccgcgattgatcagcagcaaatcacccagatccaggcaatcgctgataaagctacaactgtcaaacaagccattcaggtagacgcaaccctcaccgctgcggaaaaacgccagcaaataactgcggtcaaccagattgaaaaaacaactcaggccgctattaaggctgctgccaccgctgatgcaatcaacactgccgctacaaccggaacaactgccgcagccaacgcccatcaaaacgggccatcccttgctgaccaaaaagccgctcaaaagaaggccattagctccgtatctgctaaagtcaaaaagactatccaggctgatccgacgctaaccacaccggagaaacaacagcaactcacggctatcgtcaaagcagaagcaactgctcttgccaacatcgatatggccacatcggcagataccatcaatgcagcgtttgatgccggcaaggttctgatcaccaatagttaccagactggcaccccgctcgccgatcagaaaacggccatgaagcgattgctggtttcaaaggtggaccgcaccaagcgaagcatcaaaaacgaccccacgttaacgatagtggacaagcggcaacaaaccgcggccgttgacaatattgatcacaccatccaagccattctcactactgctgctacagctgatgccgtgcacactgcaaccactgccggtatgactaactgcaccaacgcctatcaagccggcctctctattaccgatcaaaaagtacaacgtaagcgagagctagacgatgtgactgctaaagccgttcagaccattcaaaccgacgtcaccttaaccgcaaaggagaaaaaagcacaagccgacgacgttcataaggttaatcaaacagcggtggcggccatcaatgcggcaaagaaagccgacgccctcaacgccgcttttgcgatcggtaaaatcggcattaacagtgtgcaccgggttggccagtcgttggaaatccaaaagacgcaccaaaaacaagcagtagcaactgccgcgaataacgctgaacaaaccatccaaagcgatccaacgctcacggctgcagataaaacgcaacaaattacggctgttggcgagacagcaaaacttgctgcaaatgcgatcgacaaggctacctccgccgacacgatcaaaattgcagccactaacggcatcatcgctattaacaatgtccaccaagccggcacgccgatcgctgatcaaaaggcccaacaaccgacgcctgatgtggcaacgatcgccacagacaatcaagccattgccgataacactgcgcaaatggtcacagagaagtccgaacagtctagtactgttgatcaaacggtccaacaagctgaagctgctctcgacgcaacaccgacagccgatgccatcaacaaagcactagccgtcagtgaagcaacaccggatcagccgcatcaaccgaacgcatcatcaacccttgaaaaagctgatgaagaaaaggtaacacagtccgaacacgatcaagtcactgaacggatcacaggcagtaaggttctggaccgtgaaccccaagcttctgccaaaatcacgctcactaatcagcagtcatcagacaaggtcttagctgataaacaacgcgaagttatagaaataactgatattgagaccgaagatgaacaggagcaactcgaatacgatccgttgttagcagtggtacaaaaggatacagaagaatcccaaacaattcgcgaacagccagaccaggaaaaggacatcaccaaaagccccgtgcaccatgaaaccaagatagacactggcaacacgcctaatattccgaaacctgaacagctccctgtccaggaaacaccagaagtcgttaacctcgctaaaccagcaaaccaagccgcttctttaccacagactggtgacaacaagtcccatgggctagcggttttaggtacgctaattttaggcattgctggactgacaacctccggcaaaaagcgcaaacgtacgtgagatcaaaccattgtgacagcataaagttggtcagcattttcaccaatgaaaacaagccttcaatcggaactggcaacagctcacaattgagggcttgtttgtttgcaatattcctcctattcatagcagctgccgtgatccttcttggtgtcaccgttgtcggggccttgatccccaccgtcgtctccgccaacgtaccgcttgttttcaaaaccggcaaagtcgttctgaaggcacagacggtactcaatcaaatcatgccgtcgctggttccggtggcgttggttgctttaagttactggctgcttggcaagaaaaagatgaattcaacacgcctcattgttctggtgttgattctcggcattgttttaggtgcttttgggattattggaaagtcttaaattctcgaatattagccggaaatcatcaatttataaaaacgattctacgcattttgcacgattagccaaaatgcgtagaatcgttttttatgtgtcaatgtcaattttcctaacaatgaacactcttgtttttatagttaactaataatatgatgagcttttaaaataattaggctgctacattattaacaattgtagctttgattaaccaaagataccaatgtgtttctgtatagtactattttagatcgtttatgatgcaaattactttacccaaaagaacgaaacatgatactcttcttgtgagaaagtgaatagatgaacattgtccctcgctttaaacaaggagaagaaaaatggaaagaaaagtacactataaaagctacaagagcggcaagttttgggttgccgccctcatttcagtgtcgctcggaacggttggggttatcaccattccacagatttttgaggccgtaccggtctatgcggatgccagcccgactgacgtcaccgccacggttgatcctaatgacttcttaaattatttcaaattaggtggatctacaggagcgggtaaacagccagcaattccctatccagccgggcaacaaggttatcaggttcagcttaccgctgatgcccaaggacaagcgggaaacgttgccttaaaaacaaaaatcgatatgacgcaaagtttcacgcttacgggtcggctttatcttggcaaaaacgctagcggtggcgatggcgttgcttttggctttgccgatgccaatcctggtgatatcggtcaaccaggtaatgcgttcggtattggcggattgccgagagcgtttggggttaaattcgacgaatattacaacggcggtggcgacaaatatgctgcagcagatttggacccaggtgactaccctcaaatgcgagtggttcatacgggtccaggtgacaatccaacacaggtcgtgggagtcaaaggtgcaaaaggagtgttctacaacaacatccccgcgccaaatggacaacatgtagacctggtgatcacctatgatggccaaactaaacagatgaccgtgaagtatggcaccgtgggaattactttcgatgcaggcccgtatattaaaaacgaacaattagccatgtttctcactggctcaactggtggcgtcactaaccagcatttgttcgattttctaaagttcacatacaccccaggactaaaagcagttcaagccgatcttaaaaacagattgcttactgaagcaaacactcaaaaagcagcagttaacgctgatccaacgttaacaactgacgatcgtaagagtcaaacagacaaaattgatgtcgctctcaaaacagggcaagacgcgatcgacgccgcagccacgacgcctgacgcgattaacgcctttgataccaataagccaaaaattatcgcggtacacacgcccggccaaccgctagcagatcgaaaagcggatagaaaggccaaattgcaggctgagcacgacaaaatcgtaaaagacatcaacagtgatccaaccctgaccgctgcggaaaagactcagcaaatcactaatgctgatacagcgctaagcaacgccaacacaaaagttgatgctgctactgatgcggataatgttgacttagcattttcgaatggaaaagctgcgattgatgccgcccataagccaggtgctactcttgacgcacaaagaaccgcaaaaaaggcagcactagatactgaggcagccacgattaagcaagccattcaagacgacgccaccctaacctcagccgaaaagaaaacccagtcagacgccgttgataaagccttaaccgatgccaaatccgccatcgacaatgccacaacagctgacacgatcaacgccgctgcggatactggtttagccaatattagaaatgcccaccaatcgggtccgtccttggctgaccagcgcaccatccaaaagcaggcgttaaaagctaaacacgatcaggttgtcaatgacattaccctagatccaacattgacggccgccgagaagaaaacgcaaatcactaatgcggatcaggcactcaccgatggcaatgctgccattgacactgccgccacagctgatgcgatcaaccaggcagcgactgttagccaagcaaacatcgacaatgcgcataaagtcggaaaaccgctcgaggatcagaaaaacgcgcagagacaacggctgaacaatgaagccactgcggttaagaaaaagattcaagatgatgtcacgctgacaaccgcggaaaagacccaacaaaccgctaacgttgataaagcactgacagacggtttaaacgccgtcaataacgcgaccaccgctgacggcatcattgcagccggcgatgacggaattgctgccattgataaggtctatcaaaccggcacaccccttgatgaccaaaaaaccgccaagaagacggcgattgataacgcggccgccattgccaagaaagccattcaagacgatccaactttaacaacggctgaaaagaagctgcaaactgatgcggtcgacaaagctgtcacagacggtaaaaaggctatcgacgccgctaccaatgcggatgacgtcaacaaagctgctaatacggcgattgccacgatcaatcaggcccatcagccgggtaaatccatcgacgaccaaaaagacgccaagaaaaaggctattgataaagctgctaccgacaccaaaaaagccattcaagacgacccaaccttaacgacggctgaaaagcaacagcaaagtgatgccgttgataaagctgctgacgccggtaagaaggctgtcgacgccgctaccaacgcggatgacatcaatacggctggtgacaccgccatcaccgatatcggcaaaatccaccagcctgggaaatccatcaatgaacaaaaggacgccaagaaaacagagcttgacaatgaagcggccaaaatcaaaaccgcaattcaaggcgacccgactttgaccaccgatgaaaagaacaagcaacttgacgcagttgacaaggcacttgaagccggtaagaaagcaattgatgccgccactaacgccgatgacatcaatacggctgctgacactgctaaaaccaacattgacaatgcccatcaacctggcacttcaattgacgaccagaaaaaggcacagaaagaagcactcgcaaaagaagctacgactgtcaaagaggccattcaaaatgacccgactttgacgacggccgaaaagcaacagcagaccgataacgtcgataaagcgctaaaagacgccgaagctgccattgataatgccacgaccgctgacgaaatcaacaccgccacggccactggcaaaaccaacatcgacaacgcccacaagcctggcacctcgcttgacgaccaaaaggttgatcaaaagaagaaactcgaggacgaagctgctgcagtcaaaaaagctattcaggatgacccaacgctaacgactgccgaaaaacaacagcagacagcgaacgttgacaaggcgttaaaggatgccgaagatgcgattgacgccgcaacaaacgcggatggcgtcaatcaggcattttctgatggtaaagccaagattgacgcggcacatcagcccggtcaaacgctcgatgaccaaaaagctactcaaaagaaagcacttgaagacgaagcagcgacagtcaaaaaagcgattcaagatgatccaaccctgacaacggccgagaagcagcaacagaccgacaatgtcgacaaggcgttaaaggatgcaaaagacgcaattgacgccgccaaagatgccgacagcatcaaccaggccttttccgatggtaagcaaactatcgacgcggcgcaccaacccggcaaaacgctcgatgatcaaaaagctgcccaaaagaaggctctcgaagacgaagctgccgccgttaaaaaggccattcaagacgacccaacgctgacaaccaccgagaagcagcaacaaactgccgatgtcgaccaagcgttgaaagacgggacagcggccattaccaatgccacgaacgccgatgaagtcaaccaggctttcaatactggcaagacgaacatcgacaacgctcatcagcctagcacctcagtcgatgaccaaaaggccaatcaaaagaaggcgctggacgacattgcggccacagtcaagaaagctattcaagacgacccaaccttaacgacggctgagaagcagcaacaaaccaccaacgttgacaaagcactcaaagatgctaaagacgcgattgatgcggccaaagatgccgacagcatcaaccaggcattttcagatggcaagacaaacatcgaaaacgcccatcagcccgggcaaacactcgatgaccaaaagaataatcaaaagaaggccctcgatgacgaagctaccaagattaaacaagccattcaagacgacccaactctgacgactgctgagaaaaaccagcaaattgccgaggtcgataaagcggtcaaggagggcaaagccgcgattgacgccggaaccaacgctgacgagatcaacaaggcattcacggatgccaagaataacgttgaccaagcccacaaacctggcaaggctgtcgatgatcaaaaggatgcccagaagaagctgcttgatgatgaagcaaccaaagtcaagcaagccatccaagatgatccaactttgacgactgccgagaagcagcagcaaaccgataatgtcgacaaggcactgaaggatggcaaagcggccattgatgcggccaagaatgctgacgaaatcaatcaagcctttgacaccggcaagaccaacatcgacaacgctcatcaaccaggcgcaagtatcgatgatcaaaaggccgcccagaagaagtcactggccgatgaagctgccaaggttaaaaaagaaattcaagacgaccctaccctcaccaccgctgaaaagcagcagcaaagcgaaaatgtcgataaagcactgaaagatggtgaagctgccattgacgcggccaagaatgctgacgaaatcaaccaggcttttgataccggcaaagtgaacatcgacaacgcccaccaaccgggtaccaatctcgatgatcaaaaggccgcccagaagaagtcactggccgatgaagccgccaaggttaaacaagaaatccaagacgatccgaccctaaccacggcggagaaaaaccagcaaactgccaatgttgaccaagcgctcaaagatggcgaagctgctattgatgccgctaaaaacgccgatgaagtcaatgacgccttcaacacgggtaaaatcaacatcgataatgcccatcaaccaggcaaaacgattgatgaacagcaaacccttcagaagaagtcgttgaacgatgaggccgccaaggtgacccaggaaattcaaaacgacccaaccttgacaactgctgaaaagcaaaagcagatacaagatgttgctgacgctctcaaagccggcgaagctgccatcgatgcagccaccaccgccgatgaagtcaaccaagcctttgacaccggcaaaatcaacattgacaatgctcacaagccaggcacagcagtcaatgaccaaaaagaagcccaaaagaagtcacttgctgaagaagctgccaaagttaaacaagagattcaagatgatccaaccttaaccacggcggaaaagaatcagcaaactgccaacgttgaccaagcgttcaaaaatggtgaagccgccattgacgccgctaccaatgccgatgacatcaacaaagcgttcgacatcggcaaaatcaacattgacaacgctcatcaaccgggcaaatctatcgatgatcagaagaatgcccaaaagaagctgctggatgaggaagctgccaaagtgaagcaggacattcaaaatgatccgacgctgactgccgtggagaaacagcaacaaagagaaaacgtcgacaaggcgctcaaagacggcaacgcagcgatcgacgccgctaccaatgctgatgacatcaacgaggcgtttgacaccggcaaaaccaacatcgacaacgcccatcaaccgggcacgagtctcgatggccaaaaagaagcccaaaagaaatcactggccgatgaagccgctaaagtgaagcaggacatccaaaatgaccctacgctcaccaccgcggagaaacaacatcagtcagaaaatgttgataaagccttcaaagatggcgaagcggcgattgatgcggcgacgaacgccgatgacatcaacaaagcgtttgacactggcaagatcaacatcgacagcgcccatcagccaggcaccgctatcaacgatcaacaagccgcccggaagaaggcactcgatgaggaagctgccaaagtgaaacaagcgatccttgacgacccgaccctaacaacggccgaaaaacagcaacaaaccgccgatgttgaccaggcgctcaaggacggcaaggcagccattgatgcagcgacgaacgctgatgacatcaacaaagcgtttgataccggcaaaatcaacatcgacaacgctcatcaaccaggcaaaacgatcgatgaacaaaaagccgcgcagaagcagtcacttaatgaagaagccgctaaagttaagcaggacattcaaaatgacccaaccctgaccgccgcggaaaagaaacagcaaaccgaaaacgtcgacaaggcgctcaaagatggcactgctgccattgatgccgccaccaatgccgatgaagccaaccaagcgtttgctaccggcaagatcaacatcgacaaggcgcaccaaccgggcaaaacgcttgacgatcaaaaggccgcccagaaacaatccctagccgatgaagctgccaaagtcaaaaagcaaatccaagctgatccaaccctgacgacagctgaaaagcagcaacagtcagaaaatgttgacaaagcactggtagacggccaaaaggcaatcgaccaagctcaggatgccgatagcgtcaacacggcatttgcaaccggcaaagtcaatatcgatgcccagcatcaacctggcaaatcattggcagaccagcgcttggcagcagccgccgaaattgacaaagaagtggccaaagtcaaacagcaaatcgacaacgatccgctgctgactgatacacagaaggacgagcaaaaagccaacgtggatcgcgaagcagcactggcgaaggaggcgctggcgcaagcgattgatgcggatgctctaaatgccgcacttgctgagggtatcaagaaaatcgatgcccagtacgtaccaggcacagccccagcccccgatccaacaccagggccgataacggttgatccacgcccgacgccgacacagccactatcaaccatgcaagcgccaacctccccattgccgcgaaccggcgacaaaccagcgaccggcttagctgctctaggtgcgttcatcctaagcatgttcggctttgcgctaacgggcaaaaaacgcaaacgtttctaaaggtattcctaaaggtaatatcgaaccacctgaaagccctccataagtaacccaacaagccccctgatcgaaatgccataacggcgctcgaccagagggcttgtttcattccaagttactgcttctgtcattcgacaaacggcgatttgataacgtacgaaagatgcttcacgtactggctattatattgcatgcccgcaaattttcgtcaactgctctgaaaatcttgacttatttattatcgacattctcttggttatttttatggcaacgcggttaatcagtattcgattatagttattcattattgtcatttatggcatgtattgtgaaagttttcgaatatattagttttgtcaaataagctgttcgaaaattagcacataatatagtttcctaaatatactacttaataatattttatattataaagtgcttccatataaaaataatatgtgctattctacttgtataaaaacagacagcaacgcattatcacaattttaatgaggggtagaaaaaatggaaagtaaagtgcactataagcgctacaagagcgggaaattctgggtgaccgctttgatttcgatttcactcggaacgtttggagttatcaccattccgcaaatttttgaagctgtaccggtgtatgcggataccacaccgactgatattaccgctactgttaaacctgatgagttcttgaactttttccaattgggaggaggcacggatccaagccaaggctctgccgttcactatccatcaggtgaattaggttttcaggttcagttaacccctgacgtaccaggccaaatagggacggccgcgttaaagacgaaaattgatatgaataaaagttttaaatttcaaggcaggcttttccttggaactaaagctaacgcggcagatggcgttgcattcggctttgctgatgaagatccgggtaaaactggtaaggccgggaacacatttggcatcggcacattaaagaatgcatttggggtcaagtttgacgagtattacaatggccaggaagaccccggttcttatttcaaagacccaggtgttgaaaccgactatcctcagatgcgcgttattcaaacagtaggcccactgggtaaagttaaaagcatcgaaggagcagaaggcgagttttatcaaaaactcgaggatccaaagggccaatatctaccattgctcgtcgattacaatggcgattctaagcggttgacggttgcttatggcaacaaatcaatttcatttgatgctaagccgtatattcaaaacgatcaactatccatgtttattattggttcaactggcgatcaatccaatcagcatctgttcgactttgaatcattcacgtacactcctggactggatgcggttaaagctgatttgaaaaaccgattagcaactgaagcagatactcaaaaagcagctgtgaatagcgacccgacgctaacgactccggaacgtcaaaagcaagtcaccgacattaacaccgctctcaaaacaggccaggatgcaattgatgctgcaaccacaacgcctgatgccgtccacgcttttgataccaataagccactcattattgcgattcaccagtctgggctaccactagatcaacgaaaagcaaataaaaaggcggagctgaaaacagaacacgataacatcatcaccgcgatcaacaacgatccgacgctgacttccgaccagaagaaccagcagcggggtaatgctgatacggctcttaccaatggcaatacagcgattgacggtgcgactgatgcggataaagttgaccaagcatttttaaatgggaaaaaagcgattgacgacgctcatcaacccggcgccacgcttgatgagcaaaaaaccgcaaaaaagcaggcattagaagacgcggcaacaaaagttaaacaagacattcagaacgatacaaccttaacgactgacgagaagaaggctcaaaccgataacgttgacacagccttgaccgctggcagagacgcgattaataaggccgataccgccgacgccatcaataccgctgccgaaactggcttagccaatattcaaaaagcccatcaacctggcctttccttggatgagcagaaaaaggctcaaaagaaagccttgaaggacaaatacgatcaagttgttaacgatattaataatgatcccactttgacgaccgcacagaaaaaaccacaaatcaaaaatgccactgatgcgtttaatcaaggtaaccaagatattgataacgccgccacagctgatgcgatcagccaggcatccacaaccagtcaagccaacatcgacaacgcccatcaagccggcaaaccacttgaggatcagaaaaacgcccaacgaaaacggctgacggatgaagctactgcggttaagaaaaagattcaagacgatgtcacgctgacaaaagcgcaaaaggccacgcaaactaccgcagttgatcaggccttgacagatggcttaaaaaatatcaatgacgctaaaaccgctgatgacattaacaccgctgctgacgctggtatcactgatattgataaggcctatcaaactggcactccgcttgatgcccaaaaagccgccatgaaaacggctattgacaatgcggcgactaaagctaaaaaagacattcaagatgacccaaccttaacaaacgccgaaaagcaacagcaaattgatgcggttgataaggctgccacggttggcaaagatgctatcgatgccgcaaccagtgccgatgacatcaaaactgccactgatgacgcgattaccaacatcaataaagcacatcagcccggcaaatcgcttgatgaccaaaaagagaataagaaagcggccattgacaatgctgcaaccgatgcaaaaaaagccattcaagacgacccaactttaacaactgctgaaaaacagcagcaaagtgatgcagttgataaagctgccgaaaacggcaaaacagctattgacggcgcaaccaatgctgacgccatcaacactgccgcagacaccgcgatcaccgccatcggtaagatccatcagcccggcaaactgcttgatgagcaaaaggacgccaagaaaacggaacttgacaatgaagccaccaaagttaaaaaggatattcaaggcgatccgacgctgaccactgccgagaaaaagcaacaaaccgatgacgtcgacaaggcgctgaaggatggcaaagctgccattgacgctgccaaagatgcggacagcatcaaccaggcattttcagacggcaaaacgaatatcgacaatgcctatcagccgggccgaacgcttgacgagcaaaagaaggatcaaaagaaagccctcgaagaagaaggcgagaaagtcaaacaagcgattaaagatgacccaacgttgacaacagctgagaaaaaccagcaaattgctgaggtggataaagcagtcaaagatggcggcgctgcgattgacgccggaaccaacaccgacgaggttaacaaagcgttcacagatgctaagcaaaacgttgaccaagctcacaaatccggcacggacatcaatgaccaaaaggacgctaagaagaagctactcgatgaagaagcggttaaagtcaaacaagcgatccaagacgatccgaccttgaccactgctgagaagaagcaacaaactgaaaatgctgataaagcgctcaaagatggtaaggccgccattgacgccgccaagaatgcggacgaaatcaatcaagctttcgacaccggcaaggccaatatcgacaatgcgcatcaaccgggtgcaagtatcgatgatcaaaaagctgcgcagaagaagtcactgatcgatgaagctaccaaggttaaacaagaaattcaagatgaccctaccctaaccactgctgaaaagcagcagcaaagcgaaaacgttgatcaagcgctgaaagatggtgaagcggctattgacgcggcgaccaatcctgacgacatcaaccaggcttttgataccggcaaagtgaacattgacaacgcccacaaaccgggcaccagtctcgatgatcaaaaagccgctcaaaagaagtcactggtcgatgaagccgccaaagttaaaaaggatattcaagacgaccctaccctaactacagcggaaaaggaccagcaagccgccaatgttgatcaagcacttaaagacggcgaggccgccattgacgccgcgaccaatgccgatgacatcaacaaagcgttcgaaactggcaaagtgaacatcgacaacgcccaccaaccgggcaaatccattgacgatcaaaagaatgcccaaaagaagcttctggatgaagaagcagccaaagttaaccaggacattcaaaacgattcaaccttgaccgccgaagaaaaaaagcaacagacagaaaatgtcgacaaggccctcaaggacggcaacgctgcgattgacgctgccacgaatgccgacgacatcaacaaggcttttgtgaccggcaaaaccaacatcgacaacgcccatcaaccaggcactagtctcgatgatcaaaaagccgcccaaaagaagtcactggccgatgaagctgctaaagtgaagcaggacatccaagatgatccaacgctaatgactgccgagaagcaacaacagtccgaaaatgtcgacaaggcgttcaaggacggtgaagcagccattgacgccgctaagaacactgatgaaatcaaccaggcgtttgacaccgggaaagcaaatatcgacaaggctcatcaaccgggcaccgcgattgacgatcagcaaaccgctcgcaagaaagcactcgatgaagaagccgccaaagttaaaaaagacattcaagatgacccaacactcacaaccgcggaaaagacgcaacaaagtgccgatgttgacaaggcactaacggacggcaaggcagccattgacgccgccaaaaccgccgacgacattaacaaggcctttgacactggtaaaaccaacatcgacaacgctcatcagccgggcaaactgattgatgaccaaaaaaccgcacagaaaaagtcacttgacgaagaagccgccaaagttaagcaggacatccaaaatgacccaacgctgacgacaaccgaaaagcagcaacaagccgataacgttgacaaagcgcgccaagatggccaagctgccattgatgccgctacaaatgtcgatgatatcaaccaggcgtttgaaaccggcaagatcaacattgacaatgctcaccaacccggcaaatcgctcgatgatcaaaaagccgcccagaagaagtcacttgatgaggaagcggccaaagttaaaaaggatatccaaggcgatccgacgctaaccaccgctgaaaagcagcagcaaagtgaaaacgttgacaaggcacgcaaagatggacaagccgccattgatgctgcgaccaatgctgacgacatcaaccatgcttttgaaaccggcaaagtgaacatcgataacgcccatcaaccgggcaaaacgctcgatgagcaaaaaaccgtccaaaagaaatcactggatgaagaagcggccaaagttaagcaggacatccaaaatgacccaacactgacgacgaccgaaaaacaacaggccgaaaacgttgacaaggcgcacaaagacggccaggccgccattgacgctgccacgacccccgatgaagttaaccaggcttttgcaaccggcaaagctaacattgacgcccagcaccaacctggcaaatcgttagccgatcaacgctcgactgccactaccaaaattgacaaagaagcggctaaagtcaaacagcaaatcgacaacgaccccctgctgaccgatacggaaaaagccaatcaaaaggctaaggcggatcacgaagcaacactagctaaagaagccctagcaaaagctattgatgccgacgccttaaatgccgcactcgctgacggtatcaagaaaatcgacgcccagtacgtgccaggcacagccaaaacaccaactcctgatccagcaacaaaaccgctgaccgttgatccgcgatcgacaacaacgcggccactgtcaaccacgctaacgccaacctcctcattaccgcgaaccggtgataaaccagcgaccggcttagctgccttgggtgcgttcatcctaagcatgtttggctttgcgctgacaggtaaaaaacgcaaacgttcttaagtaaagtcagcaacctgaaaatcctccaaaagtaacgcaacaagccccctgatcgagatgccgtaacggcgctcgaccagagggcttgtttcattccgatgtaccatttaaatcattcgacaaacggcgctttagaaacgtacgaaagatgcttcacgtactggcctttgtgttgaatggcagcatattgctgcgtggcatcatagcctttgacatgcttcaacgtataagaaagcttttgacccgttttcgagtaaatcttaacgtcctgataggtctgggtctttaaaggaactttggcaaagcttgtttcttcgctgataaacggattgattcgatccgtccattcattgtgaatcgaaagcagcgctaccacactgatcacaataagtgcgccgacgacgagcagcattttcttcgtacgcgccatgattcattgcccccccttttccaatcaataaccatcacaaaataccaccatgtcagtaaacttggttcagtttcttcatgctcaaatattatgatgacagattgatatttgcaatttttttgacccgttacttgcatatgtgaaaatgcgagggaagcggctagcttaaaatgttcttttgataatctcagtctgttgcctctcaggctatcacccgtccacctgcgcaagcttacctgccatcacctgctgcagttgctcgagcgccgtcatcacgacatccgcattctcacccaaagcatctcgcaaaaaagcatcgttttgttcaaagtacgcacgaatatgcgccgcatcgtgttccgctttaggggtaagctgaatcgctttataccgagcgtcctcttttgaaggcgttcgaacgatcagtgctttgcgctccataagctgtaacagtgccgtcgccgatgacttttgaatattgaattcccgctcaacatcggtttggtaaaggctgcggtgcgaaccgttgcgcgccagaaaatcgatgatgctcatctgcacctgcgtcaaccccatttgcttggcctcgcgatctgcgtatcgttgtaggtcattattcagtttcttgagcaagatacctatcgaatctgtcatcatatcctccattatctgaattactgctggtccagaaccagtcatctgtccgaataacttgctttcagaaaaataagtcgctatagtaacatatagttctatatagaactatacacaacggaggtttttatgacaagaaaagtatcagctaaattgtatctctcgattctcgccactggcctcatggcgttttgcggtgtcttaatcgaaaccgccatgaatgtcacttttccgactttgatgaaacaattccaggtcaatacgggcacgattcaatggctaaccactggatatttgttagtcgtgtcaatcatcgtccctatctccggattcttaaaacgccgcttcaccaccaagcagcttttcttaaccgcaacagcttttttcatcctcggtttagccatttgtagtgttgcaaatgattttgcgcttttactgattggtcggctgattcaaggctgcggcaccgggattgccttacctttaatgttcaacattattctggagcaggcaccgctggataaaatcgggtttttgatgggcattggcacgttggtaacggccattgcgccagcactcgggccaacttatggcggggttttagtggatttaaattggcatctaatctttattttcctgctagtcgtcatggtgattgccttgtttctcgggctgttttcgattacgcaagtcaccaaaccggtccatgttcatttggacttcatcgcttggctcttgatcgcgatcttctttgccggtgctatcttaggccttaatcgcatcgaaaacgcgcccgggcaagcagcgatttacggcgtcgttgccatcttaggcctcatcggttacaccttgcgttccttgcatgtcaaagaacccttaatcaatctacgccttttgaccaacgcctcgtttgattggcacgttatcacgtttcttatcattcagatcgtgaacgtcggctttgcgtttgtgttgcctaactacctgcaattagtcaaccacacaagttcattaatcgccggactgctcctgcttcccggcgcggcattaggagctttaatggcgccaatgagtggtaaattatatgacaatttggggccggccaagccgatttttattggcctagctttgcagctggttgggattctgcttttgttagtcactgccttgacagccacgccggtcatgttaatgcttggttatgcagctgtcatgttagggaccggctttgccatgggtaatatcatgaccagcggccaagcgcagctaaccaaagccgaaacaacagatggcaatgcgattttcaacaccttgcagcaatttgccgctgccttgggaaccgcatgcgtctctttgattgttgccttggcgcaggtgcctaagaccacggcacacacaaccgcggttggcgcgttacacgccttttggttcttattaatcctggcaatcatcggtgatcttgcgattgcgatcggtttaaaaaccagacatgcccaaacccaggccgcaagtcacgatgcttaatcgtcatagcggctaatctcgaaagctaaagaaagctgagatgaaaagtctccctgtcgaaagtgaacaggtgtgactttttatctcagctttttcttttgctatcattcgctgacacttggttgcataaatcctggctttaggcttcggctttacccgccttcacgtcttccagcgacagcccgagttgttcagcaatgcgactaccatattcgggatcggcttggtagaaattatgcgcagcaaggacgcggacttcctggctcgtcacctgcttgaggttattgacaatcgttgtgactaggcgggtgcgctcgtcttcactcatgacgcgatacaagcggccggctgccgagaagttatcttcgtcgtaaggtttatagttgccgattttgccattgacagcatcttgatggattcgagcgctgtggtcttcttcagggccgccatgtgaattaggctcgtagttaaccgaccgatcctgtttggcagccatgaacccatcacgcgcataattgtgcaccggattcaacggccgattgaccggcagttgctcgtaattggcgccgagtcgatagcgctccgcatccttgtacccaaacaatcgcccttgcagcaacttatccggagatgcttcaatcccaggaacaaaattggccggtgaaaaagctgcttcttcgacatcggtaaaatagttttccgggttttcattcagggtaaactcaccgacttcaatcagcggatagtcgtggtgagaaaccactttggtgacatcaaaaatatcgtacttataatccaaaccttcctgatacggcagaatctggacatagaccgtccacttggggaagttgccagtttcaatggcactaaacaaatcattttgcagataatcagtatcggttccggctattttggcagctacttcatcggtcatattctggacgccttgttggctgatgaagtgatacttaacccagtaagcctcgccttgtgcgttaacccacttaaaggtgtggctgccataaccgttcatggtgcgatagctcgcgggattgccacggtcgcccatcagataagtcacttgatgggtgctttccggtgagtgcgcccagaaatcccactgcatgttgttatcgcgccgatgcgtgcgcggatcacgtttttgcgaatgaataaaatcaggaaacttcaacggatcattgacgaaaaagaccggcgtgttgttgccgacgatatcataattaccggcttgcgtgtaaaacttcagcgcaaaaccgcgaacatcgcgaatcgtgtcgggatacccgctttcaccggcaacctgcgagaaccgcaataaaaccggcgtctctttgccaacgccattaaacaggtccgcctttgtgtacgccttcatgtcatgcgtcaacttgaacacacctttggcacctgcgcctttcgcatgcacaacacgttccggaatgcgttctcggttaaaatgggccagtttctccaacaattgataatcctgcaacaacaccggcccacgttcgccagcggtcaaactatgattattatccgcccacgcctgaccttcgcctgtggttagtttatctgtcatgatgaaattccctcctgagcgtgaaccggcgcgcttagaagtcggagtgtaagcggccttgatcgcagacttctgcgccggtgaacgcgttaatgtgagcgtgaaccagcccggttagaaaccggatggacgccattattcagttattaggttgtgcacaaccattgttattcaatgataaggattattcaagcaaacggctcgcttggcaggcattttcacgcgcctttaaaccaacacctcaacacccgctttttccaaactcgtcgccagtggttgatccggtcgcgcgtccgagacgacggcttccagctcatcttcgtggcacaggcggtaatagcttttaacgttgtattttgagtgatcgcacaacaaaatcgttttctccgcatgttgcatcatggcgcgcttcacgctggactgctcctgactggacatgaaaacgccatcgttggttaagccgacacaggacataaagaacaggttcgcccgaaaattattgagaaacccaattgcatcatccccgataatcgaacccgcgccgttgcgcaatcggccaccagtgacaaaggtcttgatgctcggcaacccatcaagttcaaccgcaatccgcaacccattggtaatcacgatgacatggtttagtttggcaaggaatggtgccaaaaaggacgctgttgagcttgaatcaatgaaaatagcctgattatccccgagaaatacactcgccgtggcggcaattcgatgcttctccggcgctcgctcctgtccccgaaacagatacggtaattctagattgtctgctttcaccaattcaacataaccaaaactacgatgcaccttgtccaatcgctctaaagtcattaaatcccggcgcaatgtggaattgctgacaaataacgttttctccaaatccgtcgtgctgaccacttttttatgctccagaatcgtcatgatccgattgagcctttcatttttaaacacaatatcgtccccctattcacccttaaacagtttaaagggctgagaaagcggttgcaagaaatgacgctttgtggcgaattatgaagcttcttcgacgcgtttcccgcgctttagccagaatgttcgccaagcgccgctacgacagcgttttcaactataatgacggtaatcaatcatggaaggaagttattcaaaatggaaatgatgtttcaggcggaacgtgacgatcttgcccacacagtcagagtcatgttcgatcgcaaagataccaacgtcgcaggcggcaacatgtcggtcaaggtttttgacgaacaggaacatccctacatcctcatgacgccgacgtttatgtccgaaacttactactccgaactacatccggcgcagattctggtcatcgatgccgagaccggtcaaaaaatcgatggtgtcggcgacgtgacccgcgaagtcaacatgcatgagaaagcctacaacgcacatccgggcattcgctgcgtctatcactcgcacgcagaagagtccatgttctgggccactgccggacttgatatgcccaacgtcaccgaagccacccgcgagctaggccgcatccgcgtgctaccatttgccccagcaacatccatggaactcgccaacactgtctacacggcgttgaaagaaatcggcgacaaggcaatggaaaatgtcttcctattagacagccacggcatcctcatcaccagcaccgacctgcatattgcggcacgcatcatggaaaccttggaatggaacgcccgcatcgcctatcaacaagctatcttcatcaaattgggcttactcgacgactaccactcctgcggccaaaattatcaaaaaccctacaaagaagtcccacccatcgccgtccccggcatcccaatcaaagccaagcaagtcccactacccaaaaatccccaacgcccagccagcgaaatgcagccaggcgaagtcacgccagccagcaccgtcaaataggcgatgattcagccccactgccgcttcatcccagttgtatcaaaagacaactaggacgaagcggcttttttaattcagcggcaacggctcaattgtgctaagccgcaaaaagaccgaacactcccattgggaaatgttcggctattttgattatcaaaagtttcacttgctaattcaatacgctagaaagcctaccagtgccaaggcgaagcgatcggaggccagagggggctcagctgtgaagttggtcttaaacgggcgattttcccgttttagaccaaggccgagctttgagactctgcggtttttgcagaggctcaaagtcgtgcccacagcgttccagccccctctggccggagatcgcgaagtttggcacgacaaccaatccacagcctacacttttagtctcactatgaaatgacaccctttttcaaaatcaaatttccgtacaatgcctgctcaccagtctgaacaatggcgaagcactgcttggaatgatcgtaaaagtcaaaccgctccagcgacttcaggtgaaagtccggaaatgccttggcgagctcagcgcgatagtcgtgccagatcagcggctcaccttccggaacattcttgtcacccggcacaaccgcttgaaccaccgcctgataatccgcatacggatccagcggcatcagcgtcaaaatgccttgcaacaacgtcggaatcgtcagcccatcagcccgaatcacccgcgcattattcgttcgcgccggataattagcatccgccaacaaaatctcgtcgccatgccccatctccatcagcgcctcaaccagcgccggtgacaattgttttggaatatgcttcagcatcacttcaccctctcacgcatgcttcgtttcccaataatgttcgatatcttccagtgtccgccccttggtctccaagacgttccggtgaatataaaccaccgccagcaccgacaacgccgcaaaaatgtaaaagacgttaatccctaacgcttccagcatcatcgggaaaaccaaggagagaaggccattaaacagatactgcgtaaacgtaatgacgcccatccccaatgcccgcgcttttaatggaagaatctccggtacatatgaccaaaagaccggtcctaatccaaacccgaaagcaaagacatatacgaagatcgcaatgatcgcaatcgtggcatcgttggaccacagacacagcacgatagcaggcggcacttgaccggcgagactgatttccagtaactttttccgccccaaccgatcaataaacggcagcgacatcaaggttgaaatcaccaaagcgctaccgactgcaaaatcggcaatgatactggcattggccatccctaagttgtggaaaatctcaggggcataatacaccgcagcgttgataccggtaaacacctgaaaaaaggtcaaggtaaacagcaacaacatcgccggtctaaaggcgccaaacagctcacgcatcccggcctcttgggacttcaagctatcttgaatatcctgaatttccgattccacttcatcgtcagtggcacgaacccgttttaaaaccttacgtgccttgtcaactttctgatcacgaatcaaccaacgcggactttgcggcgacaacatcatgccaatcgcaaaaaccgctgccggcactgccccgagccccagcgtccaccgccaactatcagtcggcaggttataggcaccaacggcataagccgccagaatcccgacgttgacactcaattggtaaagcgacgacattaacccgcgaatatgcgctggcgccaattcagaaagatagatcaggccatacatattggcgatccccgccgcaaccccgaggacaaagcgggcaatcatcagcatcaacgtatctgttgataacgcgctgaaaatactgccggcgatgaaaatgatgccgccgaggaccaaaacattgcgtcgttcaattttcttttccatcgcggtaaaaacaacgatcgacggcaacgcgccgaacagcagaaacgaaacaactaggcctttttctgctgaatttaagccgaatgcggtggtaatcgacggcaaggccagcgaaatggcgcctgaatcgtagccatataacagcccggcaaaaccgcccagaatggcgaacagatacacaatcggttttgttgccggtttggtgacaggttgcttcgatgtcgtccccatatcacttcgcctccatttttggtgataactcagccgctacagccttgcctcgttcgacaatctgttgaaacgtcttgaagtgcgcgtcaagatccggcactgcttgcggctgaatggtcgaaacggtgtacgaccgcttcatagttgcggccacatcttccggcgctaattttttcagcaccagcagctgtgacacaatgttcccagtcacactggcttcgatcggcccggcgctgaccggcatttgggtcagatccgccgttagctgcactaacaactgattctggatcccgccgccaaacatatgaatcttcgtcagtggcatttccgcagcctgttccaagttgaaaatagtttgccgatacgtcatggccagactttccaaaaccgtacgcaccaactgaccgcgactttgcggcaacggctggccggtttgatgaaggaaggcttcaatcttttcttccatccgactcggaccggtgaacaacggatgattcgggtcaatgtaactgtgcagggattcagccgcctgcgcttctgcggtcattttgccaaaatcaaccatctcgccttgatacgaccattcccgttgcaactcctgtacgatccacaggccggtcacgttttgtaataggcgattgctgccgtcaaagcagccttcattggtcaagccggcatcggctgccgccagcgacacgatcggcttggcagttttgcggccgatgatggaccaggtgccgcaactgataaacgcggtttgttgccaatcttccgacgtcagcggcagcgccaacaccgccgcggcggtatcatgcccaacaccattgatgacctgcatatcatcattcaactgcaattccgcctgaatctccgggtgcaatggtcccagcacggcgccgccagtcaccagttggccaaaccagttgcgcggaatgcccagcttgtgcaaaaccgcttcatcccagtcacgattggcaacatcaagcaaaccactggtgctggcaatcgtaaaatcggtctgtttgaccccggtgaagaaatacccaatcagattcggcatcatcaacacatccgcgccttccgtcagcaaaaacggataacgggttacgtcggcaaaaagctgcacattggtgttgatcatagccgcctgattaccggtttccagaaacagcttgcacggactcatgcgctgataaaatgcctttttgacggcttcggttcgcgaatctcggtaactgtgcggggcaaataacagctcaccgcgttgactcaggatgccgtaatcaacgccccaggtatcgatgctcatgccgtcgatccgcccgagatcccgccgtgcaatggccaggccatacttgatttcctggaaaattttcagataatcccaatacagatggccattcaccgccactggctggttggaaaagcgaaactgctcttttaagtgaatttggtcaccatcaaactggccggaaatcaagcgaccggaactcgcgcccagatcaacggcaattaaatttgttattgccatggttatcactcatttccccagctatttgtataatggaccaaagttcttgcaggcattgaagtcggccgcttcgagattctccgtgcctagtgacgaccatgcccgcggccggaaaatgtcggcttcaggaacattgtgcatattcaccggaatccgcaaaatcgaagctaaggtaatcaaatcagcaccgatatgcccataactgatggccccgtggttggctccccagttgtccatcacgtcataaaccgacttaaaggcaccatgaccggttaaaatcggtacaaagaacgttgatggccaacccggatcggttcgcttgttgataatgtcgaaaacattttccggcaaatcaacggcatagccttctgccacttgtaattccggacccacacccttgaccagattcaggcgggccatggtgactggcatgcctttttcaccgccgcgggtgacatagttagatgaaaagccaccgccacggaagtagccaatgttcgccggaatccaacgggtgtggtcaagattggcctgagcttcttcttcgcttaagtcatagaacggcttgatcgccggctggccgtcaattgtctcctgcccggtcgcatcaagcgtttgggcaccggagttagagagatgcaggaatccattcttggctaacccttcaagtttggtgccagtgacacgctcaacggcttcagggctccagtacgtccgcacatcagcaaaaatctgcggggtgttggtcaacaggtagttgaacaacatggatgtcgcattcaacgaatcattttcggtcgcaaaaacatgcggctgatgaatgccattccagtcatactgggaattcatgaaggcttccatgtagtcgccattaggaaaatgatccgtccactgccgctgtccttggaacccagcggcaatcgcgttgtgcccttctgcttcttccttgaagcccatgtcggcaagtttcttattgccatccatgaggtcacgagcaatcatggtcattttcacacaggcaacgagttgctcatgtttttgctcgtcggtaaatttgttcggatcatcttcgttgtaaagatccgggccaatcggggtattcttttcggcccaggccaaggccttttcaaattcttccttatcatagatgccttcgtcccagcggcgaacaatttccgtcatgtccacatactcgttacgcatgcctaagtattcctggaagaaatcagggtcaacggtcgaaccggcaattcccatcgcaacactaccgatcgacaggtaactcttgttgcgcatgatgccggtcgccagcgcacctttggcaaaccgaatcagtttggttttgacatcgtcaggaatgctggtatcgtcggcgtcttgaacatcatggccgtaaataccgaacgccggaatccctttctgagcatgcgccgccaacacggctgccagataaacggcgcctggacgctcggtaccattaaagccccaaatcgcgtgcggcagatccggtgacatatccatcgtttcactgccatagcaccagcatggggtcaccgtaatcgtgccacaaacgccggcacgatcgaatttctctttcgacatcgcggcttctttaaccccgccgatggtcgtatcggaaatcaccgtctgcaccggcgagccatcaggatacttaagcgtcgccgccaaaagatccgccaccgaatgcgccatcttcatcgtctgatcttccaatgattcacgaatgccacgccgccgaccatcaatcgtaggacgaataccaatcttcgggaatgtcatgtttgtcatttctcttgcctccacatgtgctgcttgtctagttaccatctcgttaatttcatcagctgactacggcttttatgataagcgctttcattccacgcgccaagggttggcaaagtgattgaaacttcgtcaaaaaaagcgccaattttcgtcatagttcatcaagcttgtgaatatttcttcgctagggtgggtataccaaagggagcatttacggtaagaagctataagtccaccctttcctttatctttcaagagtgttaacttgatttaatcggtgttcatttccgaagaatcaattaaatatgaggaagggtgacaccctgtgactattaaaaaagattctttgcttagacgaatggtttatatggcaataatgtactttataggaccgctcccgttgttctttgtattaatcatgtcctatgaaaagagtgccgtgacattaattgcacttacagtaacctgggttttagcaaatgccgccattatatatattgcatatcgattcgtttatagatacacggagaagcccattatacaaaaggcaaacctcagcgaccttctatatgtcttcgggggctatgcaacgattctgataagtaatggcattttaacctttttgaatcatgtaatatataaccgggtacaatcaccaaacaatctggccattgagaaatctttactcaaccaccatcagctaatggttgctgttcttatcatccatctggttgttgtaactcccatcgtggaagagttaatctatcgaggaatggcctttaacttatttttcaattcgaatcaagtctggctaaagatactactgagtgccgtcttattttcctccgcgcatcaaagcaatacgattttcagtttcttactctacgcatttataggcatcatccttggatttgtctattggaaaagtggcaaactgcaaaattcgatagcgctgcatgcgctcactaatctggtcgcggtgttagccacacttgtttaactaccaactgctgcaaacaaatctaagaaactcagtggacatttaaattttacatttcacatactcgtcagcacaaaagcataggagtgcaaatgaaaaaagaacccttagcctcacaggtctttgttgtattggtcattgcattcggctggtcattcctagcacaaatcgtcccaacgcttatggtcatgttcggcatggacaacgatgctttgcttggcaatccctggtatcaagtattatttttgtatactgaagcgattggaatttctggcatgtacctttactatcacaaagacaacgccttaatcccgttacgtagtgcaaggcccttgaaaagctatctcttgggttggctgctcggtctgctcttcttttcagcgatctggggagtgattaccggtctgggtggatatcggcttcattttgttttcagtaacaatagcatcgttctggttcttttatttctttttggctatggcgtgcagtcaatgtttgaagaactgctgtgtcgtggctatgtcatgggctacttcctaaaagagaagcggccgttgttggcagttgtcatcaattcggctttttttgctttcttacatatcgccaacccccattttgactggcacgccgccacaggtcttttcctatttggagttttgatgtctgagctgcgcctccttagtcataatatttggctgagtggcgctgtgcatgctgcttggaattttgccgaaggaactatctttggaactgtcgtttcgggcttaccgaatgtggggctgatcatcaaatctgacaatacgacaactgcccagatgctgacagggggacttttcggaatcgagcgaagtagcgtttcaatcattgcgcatcttgttgcagttattatacttgcgttcgtcattctgcaaagaaaaggcagagaacggcctgaccaagcgtccgcatcagattgagaaccacatcagtgactctcaatcgcgtgacaagattcggattcatttatcagtttttcctcgctgatcgttgagccgaaaacaatgcaaaggcacatgtattcactcccattttgggattgtacatgtgtccttttttgtcgaacttaatcgattgattagcgttagcaaagctgcatgccgaaacagctaggtgcaagccgtttaacccactaatcaaaactcaaatgaacctcaatccccatctttcgcaaccaatggcgatcggccacacaatagttgtcggcgccgatggtatgtagaaaggtgagcatctccacgatatgttgatactcgtgcggttcgttgcggagtgagcaccgcaatgctgcctcaatcatcctgatgcggtatttgaggaaaatcgtgtcggcggtggcaaccagtccgcgcaagttacctaacaagacgtttgccgttggtacatcatgcttttcaatggctgcgactgccgcgtagaacaagccgctagtgaatggttcgagaaaaatatgggcatgggcgtgttcaatttcatgaatagctctgatcagacagtgcctgctgtcttcaggattggctaagtaaattgaggccgcaaacagttggaactccagcaggaaccaacggccattgccgagcaaatagtgaattaccggcgcaattgcgtgaccgcgatctaacttttcgtgtttgaatatgctgcgataagttttgagaacagtgacgatcattgcattgatagtgtctggcttcccttcaaacgcatcaatcgtcttgtctaattcacgcgtgtcttcagtaagcgcagcctcagctaatgtttgccacatctcgggaatttcggttgaaccatccacgagttcggcagtttccggcaatgaagcatgaacgcggcggaacaagtcgctggcaagcttaatcgaaatggtctgactgcctcgttcaaatcgcgaaatcgtgcttaaactagtgctgtcggcaatgtctgccatccgcagctgtcgccgtttgcgcatagctgccagcaacaacccaaaatttgcaaatgtatctgtcacggcattcacctcttcagattttcatatatgcaagtgaacatttaaaacaattgtcatcgtcattgccccatcgtaagcttttagcatcgcgggcgtgttgataaaaagtgaaaatttacccgtttcacaataaacgtacgcttcaatgaagaaatttgcgagcaaaaagaccgcgacaagtgaatctaaaacctaggcaagtggcactcggacaagatctcatcaaaatgttcggccgagcgttgtttgttcctaacgaggtgtttatacattggcatttttatggctgcgtttacccaagaaacgagtggttttagccggtgtcatcgctttatcgatctgtgcattacagatgattcaactactaaaaccgatcccagccggcaattctccttatacccgttggctgtcaattgaccctttcagttttttaccgatcatctttttcattttgttgcctttgatcgccagcatccccgccggaaccttgttgaaaaacgatgttgattccggcttatttgcaaaggttaaattgcaatccccattgcaaaaggtcatgtggtcctatatcggtattgccttcttaaccggttttgccatcatcgcattggcattgttgcttaatctcgcggtctactttaccgttttgcccaatataaaaccggacaacctgttgaacagtaatatcctgttaattaaccaaaacacgctgttggtcagtctttactatgcccacccattattacacgctgctatctctatcctttttgcaagcatttgggcgggtcttttttctgtctttgtgacggtgacggcgatttggatcaaaaatgcctttgttgccatgagcctaggactggttgcgcaaattgttgtgctgatgctcaatagcttcatcaaattacctaattctgtcagttattcaccagctgactttctccatgaaatgtcacccacggccaatgtcaatctcgcggtcactggcattgtcactttactgatgctgatctattgcattgtcttttcccaaatcggggtgaagcatcttgtaccgtaacgtcatccgtcaacagaatctactcacgcatgcatttctcaaaattcatgtcgtctgtgccgtgatcacgctcatcatcagtttgatcgatggcaacagcttaacccaagaactcatgtcaccggaaaatctgatcgtaattattttccctcgctacttaattttttgcggactgattccgacttacctgctcgcattacttgccaccactcagattcgttcgcaagatattctgatttatcaatcgcgaaaagtggtcgttcttcaagtactttatcggctttgcttaatcaccatcatcatggctggcgtttggactgttggcaccgttttgataatgactgtcagccaccatttttactttttggcagcaatctggctcacgattttggtacgcgccgtttatttgtggacagcgtgttttctactgggaatgattgcgatcacactaacgtttgccaccaaaagcaagctaatcgcatttcttattagcttttccatcagcgcgttatctttttaccttgccactgccacaatgccttctttattcttcgactttaccggtgcagatactaatttcgtcttgcttggcaaagaaaccatcatgttaggcgctactttgttcttcgttgcagtcatgacacagattatcgggaggagggatttatagtgtggcgactgtttcaaaatcagtttttcttttactggcacatcattcggattcgattgcttttctggttaatctttatgaacctcgccatcatcattctcactttccagatcgctggcaatccccacacatccgtcatcaacctgttttttgatggtaccagttacgccatggttgaaacccatcatgtcatcttgccggttttgtggttcgtttatttctttgccccgcttttaatttcgctcaacagcttcaagcagctgtggcaggcgcgcacgatgcacctgcgtggattaaaaatacccccgcggcagtttgccaatgtcaatttgctattgctgggtttcatcacaacgacctattgtgcgtcgacaatgacctcaacgttcctagcctcaatcgccacatcgcgagcggggctttccaccaccccagggaccttcagcgaacttctttgccttacttggctaggcgttttcacgctcctgttgattcaaaccattggcaatcgattcaatccgccacttgccttgatcgttcctgccaccatcttaatcgcgacagcctatacagaaaatcggtttaacccattcagtttcttgatgctcagccgactcccaaccacaggaacttggaacgctatcctaatttggctcggcatcgccatcgcaatgacgctcggttacgtcatcattgaccgcaacatcaagttagcttgaggaggacttcatgacatttatcgaattacatcaggtagctaaagtcatcaagcatcggcaactcttgcaccaagtcaatgccaaaattgaccgcggcaacattgcaacacttgaaggcatcaacggctctggaaaaacgttgattttaaaagcgttgctgggcctcatctccgttaccggcaatgtaacagtcgccggtaaaaccgtgcggactcaagatgcttacccgatcaaagccggcattttaatcgaaaatcccagcctgatcgatgacttcacggcggctaaaaatctggaactactggctagattagaccctaatatccaatcatcgcaaattcaggatttgctgacttattttgacctcacaagatttcccaagcaaaaagttcgcaagttttctctaggcatgaagcagaaactgggcattgcggaggcatttttaggcggctatcccctgatcgtcttggacgaacccaccaatgcgttagatcatgacgccatcggcaagttggtccaactcattcacgattatcatgtcaaaggcgccactttcatcattgcctcgcatgatcacgatttcgtggaggaggtggcgacgcaaaagctattggtaaaggaagggacgatcagtgatgcgcactaaacataagctttggctaacgacttttctggtcttaatcttggtgatgtcgatcggtattttccgttaccacgaagtcaatgcaaaccccaagtcactcggcgtcaccaaagaagtcttcattcaacaaaatcaactcattcatgccaagaatgtcgacttcatgattcgcagcgcccatgtctcaaaaagcaaaggccaaatcatagtgccggttgaactgacaatcaaacaacccggcccggccgattatgggtataagaaaaataaccccaattttttggaaaacatgtggctgaacatcccctatagcatcagcactgcaacggctgatgtcacggataaagacaaccagcgcattcacaaaaccgagcatcttttagctgccaaacaacccatcacgctgcatttcatgacaacgcaagaaaattatgcgttacgcaatcagaaaatgagattcagttttttagtgccggtgtcgaatcattatgtgaaatattcgctgttgctggaatagtttccccatcaaaatgggctctgaaattccgttagatccggagtttcagagcccttaaattcgctgatcaaactgctcatgcatgatgcatgaatccatgcaagtcacttatttcacggcatttttcgccttagttacatatcgtgtgatgtacgtaaacagcacgaaggtggcaacaaggacaatgtagaacagcaagttaggaaccttcatgactacctgtacaagcacactcagcgcaatgacaacaatataagcaaacacggcaataaaaagtttcttcaaggaccccatccctctccagtttattagatcgaaagctcagttcaaattccgacatcattcatggacattccaagtcgtcacccaagcatagaaacaacagcttccttagtagacaaggtctgcactgttagcttttacaaaaattgatcgagtgtcgctaaaatgaaggcaactgaaaaacattcgcagtctaattgtacatggatggcattgaaaaggcgataaaaaggtttttcattccaacgatgtttaagctagtttcaaaaatatcaaaaagtaggcatcataccaattcaagaattaacttgctggtatgatacctacctttattgcgtttttcagcagctcccaatcctcacttcttatttttcttagcattttcaatcagccaaaaaatccccgaaaaaatagcgggaacgacgatcaccggtaaaagaaaagcgctgttgccataataagaagccgcaaaaagcacaaaaccgtaaataacaaacgcgactacccaaatgatttttctaagcagcgtcatgccacatcctcctcgccttttactgggacgaaaccattggtcggcggatttttatgcactgacaatataacattttgaatgtaaagtaaagaaaactgaacgtagcaaaaagccccaatcgctcgggactttctttgtttattcaacctttgcgtgtcacctcagaccgccgctcccgtttctgccacggcaatcgattccgctgtggccgattacggatcgcggccaacatgtctgcctgacgctggcgatcatcttgagcgtcgcggttttccaacgtggcccattcttccgcagttaacagcgccacattttgcggcaggttttccttgaagaactggcggatctgggcctcggattgatcaaacatcaaggagtagctgccgccttttttagaccaaaaggtgaccatggtgccttgcttgatggtttcagtgataacccgatcatagcgccggtagtcactggcatgcgcgaccgagccatacgtgatcactttggttttgcctaacccttggcgatacagcccgacgctggccaccagaatcgccaagatcgcgagacggaggttgctgacggtgttcgccgaccagaacagcgcaacgattaatagtgctgcgacgatggcgaccacgactttaagccaagaggacttggttttgatttgcagctgtcgttgctgctgccactcgagataaagcaatccgcctaacaagagtgccgttgctgttacatctgtcatctcacatgccccctagctttcaatccgcgacttctaccattcggcaatcgtgccatcatagttcttccaagacgggttgttccataccaagccttcctgggcaacttctttgatcttgtcttcgtccatatcaatgccgagacccgggccttttggtagttgaacataactgtctttgtattggaaaatttctttgtttttcacaaagtcgagcaggtcaaagccttgattgtagtgaatgcccaggctttgttcctgaatgaacacatttggcgtgcaggcgtcaacttgcagggttgctgcgagtgacaccggtccatacggtgcatgtggcgcgacgcccatgtcaaaggcttcggccatcgcggcaattttgcgggtttccaaaataccgccacacagcgccacatctggctgcacgatatcaatagccccttgacggaataaattcttgaaatcccagcgtgtgtaaagccgttcgccggttgccagcggaatggaaacttcgcgggcaatgtcatcaaatgaatcccagttttccggtaacacgacttcttccagaaacatcggatgatacggttccagcgcatgcgccagcacttttgccattggccggtgaacccgcccgtggaagtcaatgccgatttccagtttgtcaccgacctgatcacggatggaagcaacgcgatcaacgacggcctgcaccttgttgtaggaatcaatatagtgcagttccgaagtggcattcattttaatcgctgtgaaccctttgtcgacccgcgcctgcgcttgttcggcaacatcggatggtcgatcgccgccgatccaggagtatacccgaatgcgatcgcgcgccgccccgccgagcagttcatacaccggcagattaagcgctttgcctttgatatcccaaagtgccatctccaagccggaaataatggtcccgttaatcggaccgcctcggaagaaggagcggtgcatctcctgccacagccgttcaatctcgaacggatcacggccgattaactttttgcccatttcataggcaccagcgacaacggtttccgttttggttccggaaatcatttcaccccagcccgtaatgccttcatcggttgacaatttaacaaaaatccatcgtggcttaactttgtaaactttaatatctgacagtttcaattcaaaaatgctcccttcaaaacagtttcaacgacgttaacgattaagcttgggcacttttctggttctgggcatccatcgccgcattgacatgtttgatcccgtcaaagaagtaccagacaccggcgaaaataattaacaatactggaatcgaaattagcggatgccaagtgaatgcgaagtaaaccgcaaaactttgaatcatcgaagtggccgcaaatgatgaaatatacagcgagttggcaccaagtttaatgccgactgatttggcaatttccgtcaaaaccggcgctgtcgaagtcccgcaccacaaaagcgaagcggtgacgaccaagccaatgatgatgttcttcagcaaattgccgtttgtcagtgccacaaccaaagccacccggaatggcacaaccgccaagtcagcaaatggcaagacttggttgcccggtaagaccaatgccatcaaaatcgtcaatggaatgatgatcaaagcggtcgtgataacatcggcattcccgacaaccacggcggcgtccaagccgataaacagcttgcggcctttgaaccgtttttctgaccatttttgcgcggagtcggaaattggcatcaatccttccatgaacagcgaggtcatttttggaatcaggaccaaaaccgccgccattgacacacctaattgcataatcttcatgaggttatacccggcgaaaaagccaatggccatcccgattaacagccccatgatcatcgaatcaccgaagaagcctaaatacttctgggcatcacgaatggaaaacttattgcgccgcataaatggaatgcgatccaacaaccaattcaacggccatgcaatcaccaatgacgacagcgccgacacggttggcaaggacacgccgggcataccgaagaacttttcggtcatcggctgtgaccagtcggccagcttgaaagtgaccagcgccatgacaattgatgaacccacgccaagcgcaatattcttcgtgacgaagtaaaccatgacgccgacaatggccatgtggtgatagttccaaatatcaacgtcaagcgtatgcgtgcgcttgatgatcaaaagcacaatgttgacggccaaaatagcaaaaatcagaatcgcgataatcggtgatgcccaagtcacggcggcaatggaaccccagccaacatcaagtgcggtcagatgggcaccggttcgctcaaccatggctttggcagccggtccgacattggtggtcatgaagtccagaatcaatttgatcccggcaaaaccaatgcccaacgtcagcccggatttaaacgctttgtcgatacgcaggccaaaaatcatgccgataatcgtgatgataactggcagtaacaccgttggaccggcggcaattaaccagttaaagacgtccattacgatattcataaaacgttatccctccaattcggtcggattgacccgaccttgttgacgcacctgcttacttgtctttaaccgtctcgtaaatcttgttgagagtctcttgcgccccaacgccggttaacaatggcagaccatgaatatacggaaccccgtgcgtttgcccttcaaactggccagtcgtcaccagtaagtcgtagttttcgactttgcccggcacttccattaacttcgtctgggtcgtttcaacatcgacccctttttctgccaaaaaactcttaatcttcgacgcaaccaccgttgacgttgcgataccattaccacatgcaactaaaatatgagcagccataatttctttacctccattttttattcaaacgttttcgccaataattgatacaaaccatccacatccgccgcgtctgcaatggcgtggcgtaactgatcgtcttgaatgacatcgacgattttctgcagcatctcaacctggccatgcggttcgccaatggccatcatgatgatgacatccacgtccaagacgttgttgacatcccccatatcgtgaaatttaaccggatgcgccaaggtggcgaccgaaatggtggtctttttcaccagctgataattcgcgtggggaatcgctacggtcggtcgcggcgaaggcagaccggtcgggtaagttgcttcccgatcaagaatcgcctgtttatacccttccttgacgtagccttgtgcaaacaagttgtcggcaatctggctcaacgcgtccagattgtcctttgcctccaagtgaggcagtaataattttttatcaatgactaaatcaaccgccacagatccaagcccctttctatagtgcgtatttgatatcgacaaaggcttgcatagaagccgccaacccgtccacattccggttagccaaatcttcagcgttgaacattttggaaccgatgcccaagtaactggtcccatgcgtcagcaggtctttggcatttgccagcgacacgccgccaactgccattaatggcaacttaccaagtggcgcctgaatcgctttgaagaagtctgacccgaccgtggtcgccgggaaaattttgacaatgtcggcgcctttttcaaacatgtcgtgcacttcagtcggcgtcatcgctgccggcaccgtgatgacgtcatgcgccttggcgtaagcgaaaatgtcatccgtgaattcgatcggactcaacatgaatttggcgcctttggcaatcgctgcctttgcttcatccagcgttgtgacggttcctgccccgatgtggatgcgatcgccgtattgcgcattgccgttttcaataatgtcgagcgcatgtggcgtattcatcgtgacttcaacaccaaattgattttcaaaaccggccatcgcctgcatgatcgcatcagcctgctccggcgtgtaaccgcgcataatcacggtaaaagttggatattcagataattccatggtgacctccttgtgtttcgtaacgtgttgcttaattttttatttcaggtttgcgcctgatttgctttcgtaatgttgcaagatttcgtaagcctgttggccacttttggcagcgaacaactgcttcaaagtggtggtgtcggcaatgatctccgatagttcctgaatcgcttgcagatgctgatcagtatctttaacggcaatcggcacgatcatgcgaatgtgaaacccgtttggataaatcaccggctgtttcagaatataaaaggcaaagccattattgagcaccccgttttccggaactgtgtggggaatggcaacctccgttccaatgaagctgtaattatccgcagctgctgtctcgtcgatcaacgtttgacgaaacggatcggtcacataatccaatcgttccaacggttcaattgcctgctgcaaggcgttttgccaatcgcggctttgaccgatctgaatcagattcggcgccgtcaacgctgacaagcgcggttggtggacttccgggagttcctcaaccccttgatcggctaaaaaccggcgcaaggcatgatctaaacccgcagaatccgtaatcttggcgtgtttacgcacaatcgcggtcaatgccgaaatgcctgtttggatattttttacgccgatatcattcaagacgcggtaccgcaattgaacttgctcatcttcgcttaacaacgggtggatgatatattgccgcgccgatgtttttaacggtaccgtggtgaaaaccagatcgtagtcaccggaaaagtgttcgaattcgcgcgccgaggtagcggataaaaagctgatttccggaaataaccggcgcagattctgaatcatcagtttggaaacgatcaggccgttggtacaaaccactgctgcgcgttccttactgacgtgtaagtcggcggacttttccagctcaccgtcgaaataaaaggcaatgaggttgcgctcatcttcggggatggttttacccgtcagcttctcgagcggttcgataatcgcatcaatggtgtcgaccagaaaccgatgacggggatcggcggccatcacctgcccgatgccgatgtcgcgcaaatgcaagccatagcggacgcgaaagatcgccggtcgtaagtgggcgaggagccttttcacaaagtcatcctgatccgccactttgatgaacgtctgctgttcaaacttggcaaccatcgtgcgaatcgccgcaaccaacgcttgatccgcgaccccgacatccccgcgaatcgtgttggccgataacaacagaatcaccagccactccgcatccgaatcactcgttagccacgactggggaatcagcggttttagctgtgcaaactcctgcgtatcgctgatctgatgctcaaagtatggtgtatctttggcgcggtgcgacagattgcgcgtcacgttcatcagcaccgccagcattaaaaagctaaacgattcatcggagtacgtgacattccggacattttcgattttgtgaataaaatgaatgatctgctctgtgggcaccttgcctaactgctcgattgagctgcggccatcgtcaaacgtcagcagctgggtgaccagataattcaacaggttacgcatcacctgttcggaaccggcgataaaatagcctgcctgccgcgtgtacttcagcgtcaattggcgctcttcgaggaatcgggcaactgcttttaaatcagctgacgtggttgtccgactcaccccgctgaaatcatagatgtgcaccagtgataacaactcgtcgctgaccagtagatacaggcaaatgagcaagatgcgctcatcttcttcgcgatacacataaggttgcggcgcttcagttgcctgaacgttgaaaaagtcagctacttcgcttggggtaacaaactcaccgcgcggggtccgagtaattttaggcagctgatgatccactagctcctgattaatttgggctaaggcgtaagaaagttggcgccgcgtaattttaaattgtttttccaaatcaccacttttcaaattaggatgccgaataatttctgaaaggatttgcagattgcgtttcttcactcaaccctcacctccaggtccaatatcaattgtacgggacaaaccgcccgtatgacggcgctttcattccggcttttgttcaccctattcggatccggaatgttcaaggtgaacttatgtctgcctcaagcgcgtggttatcggtttttgcttgggtggaaaaggcactgaagatctaacgtaatgagtttgttcccgtgccaaactccgcaatctccggcgggctgagggctggcgaccgcgcagctagagtggtgggcacgactttgagcctcagcaaacccggctgagtctcaaagctcggccttggtctaaaacgggaaaaccgcccgttcaagaccaatttcacagctgagccccatctggcctccgattgcttcgccttggcactcacttcttaaaaaaattgactaaccttcctctgagacaacaaaagacgagtgaattttccgatctacagaaaattcactcgtcttgttaagctaatgtgaaggttacgccaatccaagcgataactcgacaccgttaaaaatgtaatcttggatacaactgtctacgcattcacatatccatctgcatctccttaacagcatcaaaggttggatccaccgcaccgttaaagtcatctttcatgaagacgctgttgacttcaaaagcattggttgcttggttaatttgacggtaaagcaattgatattgtatcggtgatatccgtggcgctatttttttcaagtggcgatatgccgctgccttaatctcatttaacggataaccctttgtttctagaatcgcggttttcgtccagcgataggttgtcttgcgaatgtgactgaaatccggctcatcataagtccggccatcgcgatcaacggcatagacaaacatgccgcctaaattttcacgcgaaaacgttgcaaccgtatgcatgtttgagcgtaaaaaatgattgggatcggtgtcataccagcgattatgatcgccctcttccggaaaggttaagcctgccagcaaccgattttgtggaaagccagctgccgtatacgtttgacgcattttctcggtccgacttggcccactgccatattgttgataaccgagattggaaaagtaacccatgacattttcaaacggggcaaggtaactgccattggtgtcataaatcaataaggtgccattttccgcttttggccctaaatactgccccatcgtctgaataatgcggtctgacaacgcaacttttttggcatctgggtactgttccatatcaatatcgatgccgtccagtccccattgaccggacaattcatagatcaatgtctgcacataatcatcaatctcgcttgcggttggatgttggccatattgctgaattaagccatcgaccatgcgcccataatccaaagcgcgaaccagttttgcgccccggcgatgcatttccggtgcatagatggttcttaacctatcgaaaaacggttgcgccttggcctcttgaccggctggaacgtagctgaacacgttgataatatcaatcccatatggcaaatccagcatgctttgcggattcggatccaaaattgttgtattaaccccgtgcatggcttggtcccgccacgcgcgataataaaccatgaacgtcttttgcggctgcggcgtttccgctgacgcacacactgactgcggcttcatcatcagacttaaaaagatcccgctggcgatgatcagccagcttacccaccgtatcttaaaaccctttttcattgtcgtgcccctcccaatcaagcaaaatcagcttgctgacttctcacccaaccgttcgtacaacgccacgatttcctcagccaagtcgcgaaatgtaatggcagtcatgacgtgatcttggccgtggaccatcaaaagtgacacagcttgatgctggccgtttgcttccgcggtcagcatgccggtctgagcttgatgtgcatcggctaagaaatgatcggcttctttaagtttggcttttgcctgtttaaagtcgccaacttttgctgctcggatggcttcgaatgcggcattcttcgcattgccgccagccataatgagctgcatcacgaccaattgttgttgttcgttcatgagcctcgtcctccttaagccattaaatcaagcgcggtctgtaaaacccgatcgcctttcattaagccgtagtcagacatattgatgacagcgaccggtatcgacaaggctgctttaaagtcgccttccaaatagcgtacctgggggccgagcagtaaaacgtcaggatgctcggctgccagcttgtcttttgcatctgctgccgaggccgcaaagattttgacgttagccttggtttgttcagcagcatccatcatttttctaaccagcatactggtcgacattcctgccgcacaaaccagcatgattgttttcggattttcagccatgatgaagttcctcttttctattatgtcgcttcttcaacgcgcgcttgtcaggaatcggcgtccggcacataaccgctggccgcaacttgacggaaccagtagccggatttcttcagcgattttgtttgattgcgcaaattgttgcggatcaggccgtatcgatttttataggcattgagccacgaccagcaatcaatcccggtccagacaaaatagccatggcagttggcgccggcttctatcgcctgatgtaggaagcgcaggtgatcggtcataaattgaatccggtaatcatcctgcaccacctcgtcttgcaaaaagcgctcctcgtcagcaacgccaatgccattttccgccacaaaccagtcgatattgccataacgatttttgatggtcatcgcaatgtcatatagcgcgtcgggataaatttcccagcccttgtccagattcattttgcgtcccggcattttgtactcgtcaaaataaatgtccggcaaccacggctgtaggctgtcaggtgccacatccggcgcctgcacgcgataaggatggtaataattcacgccgagcacatcaatgcgattggccgcaatgaccgccaattcctcaggcgttgacgcccacaaaacgtgatcttgcctgagtcgttcgaccagcgcttccgggaaacgcccatgaatggctggttccaaatacaggtcattcgcccacagctccgcgaatcgggccgcatcccgatcaccagcggactgggaggccggataaaccggcgtcaagttgataatcgtgccgatggtcgcatccggatgctggttgacctcacgaaacgccgccaccgccttggcactggccaaattgaggttatacgcaacttgaactgccgccttaccgtcaaccagattgggatagtgaaattgatataaatactggccgtccacaatcaccttaggctcattaaacgtaaaccagtgcgtcacctgatcgccgtaaagttcaaaacaccgccgcgcaaatttcacatacagatcgacaacgtgtttggactgccacccgccatagcgctgctgcaaggcaataggcagatcgaaatgatgtaggttcacatatggcgtaatccccagcgcatgcatcgcgtcaaacacgagccgataataatccgcgcctgccggatccaccgtgcccgcttcaagatcatcaatcaaccgcgtccactgaatcgaaatccgcagcgcctgaatccctgcctgcttcaacagtttcagatcctgttcataatcgttgtaaaagtttgacgccacatccgggccaacattgtgataaaaatcctgcggccgcgtgtggtaatgataatcgaagatattttcatgctttttgtgaaacgtaccttctgcttggggaccgcttgtggccgcaccccaggtaaaatcagctgcaaattggatggccatcacttcctttctaagcggctcaaaccggcttgactttgttgaaaatgaaccgccgcgccatacagattggcatcggctttaaacttggcaatccgaataaccggccgcaccggtgccagttcggtttgcgccatgaccgcatccagcgccgcttccaaatcggccaataaatgtggattttgggaaatcccgccgccaatgacgaaacagtctggatcaaaactatattgcaaattgaaaatggtcgtggccagaacatggaacatgcgctgaacggcttttttggcttcctgaccacctttgtgtgcctgctcatatagcgttttgccatccaggtgagtgccatgacgccgattgtagcgcgccaccgtgttaaccagcgtgccaagacggctgacggaatcgtcatcaccgtgccacatataaccgaattcgccacccatcagatgacggccgcgatgcagctgaccattcagaattaccgccccgccaacgccggttccaagcaccagaaaaatcgcatcgcgcacatcggcagccgcacctgcctgcacttcagccaacgccgcgcagttcgcatcattttcgattgtgaccggcagctccaagcgattggttaactcggtcacgatcggaaaatgatgaatatacggcacggcactggcaccccgaatgatgcccgccgtttgatcaacaacgccgggactactgatcgccacgccagtcacttcggtcgtcagacgcaacgccgccacctgttgttgcaggcactgataaaaacctgccaacgttttcggcgttgcaactttggtttgctgaaaaagaccggtttcggcactgtagccaccaaatttgatcgtggtgccgccaatatcgatcaccgctaaactcatcgcaatccttcctgttcctgttgctgaatcacatcaagtgccaactggcaaaaggtcatattcgcccatgaaaaccacgtgcgggtatattgcagcggatcatccttttgaacgccttcgtgacattgaccggttccgccggttgtcgccaccagcaacaacaatttcgccattttatccgcggcggtcgttgcgaccaagccttccattgccaccgcaatcggccagacatattctggcggcgtgtgttcgctgccgatgccggccaacatttttcctttatagtaataaggattctggggactgaggacaaacgcctttgtggtcagataaagcggatcatctacggcaattgcgcctaaaaacggcagactcaacaagctcggaacattggcatcatctatcaggcgggcgtgcccaaggccatcgacttcataggccagtccttgttccccactcggcaacgtttgaatcgcgtatgtcatgacgccttgctcaatcgctgccaccaacgtctgtgtccgcttggccagtaaccgctcatcaaccggcattaacggcaataagtgggtcaaaaccgttttggctaacaggttggctggaatatgaaacccatattcacaccgattatcactgggccgaaaaccgtcccagatcaggccggtctcgccaattggattgcctaatccgttgttgggaagcgtatcgttttcatccgtgtccgaccgccgaaagaaatacggcgaccgctcatgatgctgctcctgttcaaaaatcgtcagaatcagcgtgaacgtagcccaaaagtcgatgtcaaaaatgctggcatctccggtttcggcgtaaagattcaccgccaacagcaacggcgcacataaagtatcgatttcaaattttcgttcccaaacttgcggcgacatcggccgatcgctttcgtcatcagcccgccaatgcgcgccactagccgtttcattaaaggcgttcgcataaggatcaagccgcacaaaagccagttcgcggcgcagtacccctgcaagtatcggcttcaggtcaggaatgtccttgatgagttgcacatacggcagcacctgaaacgtcgcatcccgcaaccacattgccggaatatcaccagtcgcgacaaaatacgtgccatcaggttgacggcgggtcgctttaaccagcgcgtcgggtaataatgtccgaaacattgtctgggtcgctgtatccggtagtggatgggcttcagcatattccgttaaggctgctgccaacgctgacttttctgccatattatgcgtgctccttttctgccactgatggcgattgacgcgggtagatgccataagtccgaatctcccccggtttaaatgcaggcagttcgaataccgtcacatccgttgcgactgtttgccgaacctcattattgagatttaacaggcgaacgctggcgggttgggaaaaatgaagcgtcgctgcttccgtgcaggtttgatcggtcggattataaagccggacgagatatcccgtaccatccgaagtagcgctaacactggaaacgaccaagtccgaaccgattaactcaatcgcagagtgatgtcgcagtggcgtttgatttgcgttaatcgggaagtattgcaacggcgtggtgaagcgatcaattgtctggttttggtaacccagactgccaatcgccagtgcctggacccggcgctgtaattcaaccggatcaaaggtggtatccaaacaaataccgccgcgcatgtgccgtgttcccaacagctgactgtcaggagttggcacataccgagtctgcaagccagacgcatcccccggccggcgcttcaaatccggccgtccgaggtaaccgacaccacgaaacatcgtcactgctaactgatcacactgctcgccgacaatttggcactctttttcacctaagccaaggaatgtccaactggtcttttggtcgtggctgttggcaaaatgaatcagtggtcgcagcgcagtgggctcctcatgataaccgatggcttgccagtccttcagatgtggatcgatgaccggacgcattgccacgccaaagggagtatcggcatagctatcttttgccttgatcggcgtcttcaacaccaaccgcagtcggtgatcgcttaccgtattctcgaccgtcaaatcaaatcggatcacgggatcatcagcggccagttgcaataccagcgtatacggcatcacaacgtcggccttttgcgccttgcgatcggccaacttgcccggtaactgccagcttccgcggaaaatcaggtcactcaccaactcgccttgatgaccggtcacctcggcgtgcgaaagtgataagtcaagcagccagtcttcatcaggtggcgagtaatcatacgtatccccggcatcgccgccatcttcaaagtgaagcggatcgacaaaggtttgctgcgtgcgatgatccgtcaacaagagcttgccatcctcaaaagtcagcgtgtaaacgccgtttctaatcgtggtacttttggttcgcaacggcatcgcctggtgcgccggctcaagcgtcaagcccacccagtccagcgcatcaatggtcactggcaccgcaatggtcgtgcgataatagatgtccggcgtctcttgagcgggatcgccgcgcaaaacggcattatcgacttgctcttgcttcagcacctcaaatgccaccggttcgccggcttcatttttcaggttaaaatgcggttcgcgcgttgccaccgtgatctggccggtctggtgaaccggttgaatcgtcgggttccaaaagaaaacattcaacgaatccggggcattgctggctaacttgcgtaataaatagtcacgaagcgattccgccaactgtaaggcatcaacgccgcgctgggcaatgtcgcgattcgtctcatccgaattgcaaccgccggaagaatcatgcgcctgaccgcgggcaatgcttttccagatggtttcgacgatgccggactgggcttcaatgccgtgatgcgtcgcaacggccatcagcggttcaacgacatcgatcatcagatgttccagccgatcatacagctctttcaaatcagcccgtgatgagtaaataccgcgatgaattttcgaggcggacggatccacaaactcgccttgataagttggtaagtccggcgttttcgccaagtccttgaaaaagtccggataattgtcttctaccaagtcaaattcatcttgttgcgcattggcgatttgcagccgatccttcaaattgaaatcaactgcgcgctggtcaccgcccaccggcaaggccaaatcatgcgcctgcgtatcggtggcaatgcggtgaagtaaactcgccacatcgtcattttcaatcagctcaacgccggcatagtagccgtttttaatattggcggccaacactttggagccgtcattggcggtccagtaaaagtaacgcgcgttcttttcatgcggcatcccccgccaaaagacggtcgagctgatgtcaaagccgtgataaatcttcggcatgtcctgcccctgtccgaatgaatccggcagatagccgactttcataacgccgcctaaatcagcagccagtttgtgcccaagttgcaggttccgcacaatcgattcgccactggtgaccatctcgtcaatttgcgtataccacggaccgacgaacagccgccgtgcctgaataaacttgcgcatctgatcgcgttgttcggggttggtctgcaaataatcatcgacaatcgccatctgaccatccagtaaatacgcatccagttgattcgtctctagggcttgcaacacttccgccatatggtacgcaaactgaacccgggcctgctgacgcgtgaagtaccattcaaaatcccaatgtgtgtgggcaatcacgtgaactttttgcattaatcaaattcttctttctgtcttcatgccgtatctatcaactatgcggtggccagtcgccgttcactgcgttgattcataatgacaaacggtgcgtaaaggaaaatatcgatgacaaccaaaacagccgtaagaatcaccggactcatatgcaacccaccaaggatccaggtgctgacaaaaatcggctcattgcccgaatttaagacgacaagcggtaccacccagccaatcgaagtcaccacatacgccacaatcgcgttaaacagcggcacgaaaatccacggaatgaacatgatcgggttcaagacaatcggtaacccaaagataaccggttcgttgatgccaaagcaccccggcaccaaggccagtttggccacttcccgttctttttcaccttttttggtaaaaatcagcatggcgatgatgaggccaaatgttgcccctgaaccgccgatcatcgcgtaaacgttggtcatcgtgttcggcgcaatcgagatgccggcaaaacttttggtttccgcaaacttcgccacattctgcaggaataaaggcagccaaaacgcggaaacaatcccccagacaatgttgaaaccgtgcaacccaaggaaccacagaatctgttctaataaaatgacaacaataatagctggtaatccggtaccgacagtcagtaacggcttaatgatgaccgttgaaatcagctgaattaaactggtgtagcccatggcctgaagaccgatccgcgccagtccgaacaacagcaacacttcggacattggaattaaggcaaaaaacgagtcaaacacattttgcgggacactccctggcatcctgatggtgaacttggaccggctgaaggaagcaaacagcgcaacggctaacatcccgacaatcaagccggtaaacatcccttcataactgaaaagcgacgccgcaaatccctcaatgacttttgccttagggtcggcaaagttaacattgttcggcaccatgacaaaataggcggaaaaggccaacaaggtggcaataatgacattcatgcctttgttctcgtcacgccgctttaactcaaccgcgtaggaataggcgctggagaccaccacaatcaagccgacaatcccaagcgtggcaacgccgagataaccaaaaagttgactcagactcgtcaaccaaccccaatttaaatgttgtgacttaatcaacgcatccagttgcatcttgatcaggttcgaaaacgatccaatcaccgtaaatggaatcgtccgaacaaaagcattcttaacagcttggagaatcgtgttgttctgcacccacatcgaagccttcaataacggctcctgaagcttatccacattgaacttcatcatgcatcacccctaagtagttttaaaaagaaaacgttttccaacatcgtcagtttaccggtttccctaatttttgtaaagtcttatttacattttgtatatacaaattatgcgatgctgtcagataacgctggctcaatcttgactagcttgaaaatatggcttatcaaatcattcgcttatgttataatcgcttaacaagtaagccattgaggtgacggtgttgtatctttattcggaaatttattcagacattaaaaaagacattttaacgaaccactatcgcgccggtaagccgctgcccacacaaaaaaagctggcggaaacttaccacaccagccggttaaccattaaaaaagcgctaaaactcttacaagatgaaggcctgatttacagtcagcaaggatcaggtagttttgtgcgtgctcgggcaactgaagacgacaaggaactgctaccgctcgatgcgccaattggagcgacctattcacaccgcgatcaaaacatctccagtaaactgctgtattttgatgcgcgcttgcccaacgaaaccgagcagaaaaaccttgccattaaaagtaatgagccagtctatgacatcaaacgggttcgcctcatcaacgaccgatactacagccttgaacacacgatcatgcccactagcatcgcgccgttagacaaggacattctgaaaggttccatttacgattatctcggcaaccgcggcatccagctaaccgacgcccgccgcattctatacgcaaccgaagccgacgccgaaaccgccgacgcccttgatatcaaaaaaggcagcccggttctcgtcattgaacaaacagcatacgaccaaaaaggccacgcattcgaatactcggtttcgcggttcattcacgatcactcccggtttgttttaaacattcaccgaaaattgccagattttttggggtgatactgttgtttgaggtcacaatttgccgaatcggtgtcccattatgacgccactacaaagacaccaaaaataggctgagtcataattcggtaagaacgttcatagattagcgaattccgaacaatcaaaaaagcttaggcaatcagttctatgccgtgccaaactccgcaatctccggccagctgggggctggcgaccgcgaagctagaggggtgggcacgactttgagcctcagcaaaaccggctgagtctcaaagctcggccttgtactacgctgggaagatcacccagctagtacaattttctaccagaagtcaagtctcattcattaggtttttcagtgttcttgcggttttcttgtggcgtatcgataacgccat

SEQ ID NO: 332 - DNA, 46388 bp, Lactobacillus casei
gcgttggcttcacgctcactctaacaaaaaaagtgatagatattgatctggcctgatcaatatctatcaactaagttagtctatttcacccctgagccccatctggcctgcgattgctccgctttggcactatcatctggatactcctagccaatttttctaggaaaactaaaaacggacgtactccagtttgttagagagtatgtccgcttttgtatcgtggccatgaattatgaccgcgttttttaatttatccaatttatttcaaagcgctatgcctttaacggctgcttcagcatcccatcagttgctttgccgcatgattggtagctgtccagcaagcccaacttcatgaagacggtttgttgatacgcaatcttcgcgttccattcgacggtctccaagatttcggtggcgtgatgcaagtcttcagaggtaatcaggacaccatggctatttagcaagaaaatatgctcttttgctgcatccccaacctctttgagtccattgtaaacggtatcggcaagttccttggagcaggccggcgcgtatggcagcacgcggatcggcccgacttctccggtgacctcggtaacgttcggcatgtccaatccagccgttgcccagaacatcgattcttcggcgtgtgaatgatacacgcagcggattttgtcattagcccgataagcttcttcatgcatattgatctcgcgggttaagcgaccgacgccgtcaatttgctgaccggtttcaagatccaccaccaaaatctgagtcggttgaagctttgcgtaccaagcttctgacatcatcgttggcgtcatgatcagataatccttgcctgctttaatatgaattgaaccatagtcaaaatccttgtcggcggtaatccggacactaatattaccgccagctacattggtgttcttgcggacaaacatctcccgcgcaactgctgctaaatccttccgttcttcttcaaaaacatattgttccgtcattttgtatttcctccgttatttgcacgttgcgccagcaaaactttgtgacgctgtgccaaccgtttttcccgttttcgatcataatcaccgaacaggattggattgacttttctgtacagaatcaaagtaatgaggcccatcaagagacataacccagtattaccgcctaacaaggcaattgagacgccaattgtatctaggaaaacaagtaatgatgcagaggttttactcatgcttatcacccttattcttctcgtgactggtttgactgaaatccaaaccgctaagatcatttaaatcaacattgtctgcttcattattttgcggggatgacgttttcttgctttcgttagaagctttggcatcactgaagtccaagccactcaagtcattcaaatccacgtcatcggcattgtcattcgtatctgacactgctggtgctgccgccgcagtagccggggccaaggtgccataacgttgactaggcaatttgattttattttgatcccggtacaaccagatgaacccgagtgtccacagaattgctaatgcgatcgcccaccatttgccattaaaggcttgggcaaagaagaggcggaaatcaggtccttcaaaagttgaccatgacaactgctgtccggcttgaaccttgaccgttccggttgtcttcgccaggttcgtgatcaccggggcaaaataggtggcgccatacaggaaaatcggtgttgtaatgatgcccagcgtaatcatgcgtaacagattcgcccctgtcagtaacagagccgcaataacaaaggacagattgatgatgccggcaaatggtaatactgtgttatgcggtaagatcatggcgaaaatcaacataatcggtaccaagataatcacggtaacccataactcattacgcccggcaagaatcggccaatcaagcccgatataaacttcacggcctttaaagtgtttttgcataaagccgctcatcgcatcggcaatgggttgcaacgccgtcatgaaaagtttggaaatcattggaaacagcgtcatggctgtcgccgctttaaccgctaagttgagtgagccggaaatggaatacccagcaccaaatccaagcagtaccccgatcaacgcacccatcacggtgttgtcgccccagacaccgattcttttctgcaaagcatcagcatcaaacggcttgttcatgatcggaataaaatcaagcaatttattcagcggttgtaagatcaccgcaaacaatgtgatgaaatgtggcaccgtgactcccggcatccctgtcagatcctcgatatgccgatgccacatgtcgccggctttcaattcaaatacgatctgaatcccggcaaccaagaaaccaaagaaggcattatgcgtaaagtacaatacaacaacgtaagtgaaaattttgttccagacattccacatatcaacgtttaacgttttggtccagttaaaggtcaacatgacaaaattaatggctaataataacgggaaaaacagaaaggctgatttatacgaccatgtgatcgccgctacgcctgtccaacctgcatcaatcgcattaagactcaggtggaatagcttagacatggatttggcagctggcgaaatggcatccatcatgtagttcacaaccaaggtcatcccggaaaaggcaacccctaaagtcaacgcagccacaatcgattttttgaacttcaacccagcaaccaatcccagaatcagcatgattaagggaacaaacaccggtcccccaagattcaggatataattaacgacgtcttttagaatcgtcacgatttttacctcctcacaacttaacccgcgatgcagttgatcgtttcacttaaaaggccaaaacctgctgcatcggtgcgcatgacataagacgtcacttgccggcattctgcatattcttcaaagcctgaatgatttgtttgtacgacttttccggattcatattcataaagatcggcatgccattaaccaccgcaatatggttttctttagctaagtcctctaattgctgattcggcttggcgatccaaacgtaaacgtcatagttgtgcaatacttcaggtaactgcttaaaatcggttgcatccaccgacacacctttgacattatgcgattcaaagaaatccttgattcgactggccgtagcctcacttgatgcaacgcctgatccacatgcaacaacaatctttgccataataattacgctccttttttaaattattttcctgcgacttgtgctttaaacgtgttaacaaaaaactcgtacattgcttccggatcattgatcgccttgaacttggcgacaaattttccgttctgtaacaaatccatgaagatctgtaaaagtccgacttgctggcttgaatccgtgatacctagaaagaacatcgccgtcgcatcttctggctcgttatagcccatttgtaaaactcgaatcggctgagcatttttgacaatcgccataaatggtcggttgacgttgacaggatcggcatgtggcaacatcacggatatttccggaaaaacaatgccggtcggaaaggcatcttctcgtcggttcaatgccgcctcatacgtgtccttgacgtaaccagcggcctgaatcttttttgccacatctctgaacaatcttttgcgatcagcagcatcctcattcaaaaaaatcaagtctttgtgaatcattgtgctataatccataactagctcccctcaatatgaaaagttgaatcaattgttttgaaccttcttgaatctttctcctcatcacattattaatgctaaagcgcttacagtcctatgtctacggtatttagcaaggttcatcgaggttgagaatcgttcacgaaactcagccaaactggtccaaaatgattcaacaaaaatcaattgagggaagcgtttactatgtcacaaagtccagctaaatttgagcggttaaacgaaattattcaaattttgcgtgatacgccgcaaattagcattgctgatctcagcaagcaaatgttcaccagcaaatcaacactgcgccgcgatctgatcgagcttgaaagaagcaacatcattcgccggcagtatgggatgattcagctgctgcaaggcaataaccttgaatttacgtatgaaaaaagacgcaacgaaaacgcgcgtcttaaacgattgattagtcggcaaattgctgccaggatccccagcaatgccgcttttttcattgatggcagttcaactttcttcagtctgcctgagttactccatgaacaggttggtcttcacgtcatcaccaataacgtcaacatgggtctccaattcaattcgctgaataatgttgagactatcattgctggcggaaagatggtgccacgaacggctacgacactcggctcgacaaccattcgcgaaattcaaagttttcaccctgattttgccctgctatcaaccggttcaattgatgctgacggcatttacgtcgccgatccggaacaggcagcagtcaaagaagccatgattgatgctgctaagtgtgtgatttttgggattgattcaactaaattcgaccaaagtgattacatccgcattaccaacatggatcaaatcaacgaaatcgtcaccgacaaacagccgtcttcagcctatcaacctttgtttgaaaactaccatattcagctcacgtatccacatcaaaatcattagaaaagcacaaaaagcacctcgttgcagcgaacgaggtgcttttcttaaattcatgggaggtatcgcaaacaaacttgttggctcagactttgagtgtcaccttgctgatcaaggtatcaccatggagaaattccggatttggtgttaggtcaaagcgtttggctaactgttccagattttcatccgtgatttcgttgatgatgcggccgccttgcgcctgaatggcggtgtaaatggttgccgctttttcaacggtttcgatcaggccataggtttcgtcgatggagtcgccagcaccgaagatgccgtgttgcggccacatcacgaggcggaatttggccattttatcagccgtggcctgcccgatttcattggttcccggggtcatgtatggcaagacgccaatgccttcagggaacacaacgatggattcagcttgcatcttccacagaatgcgggagaacagtttctcttctagcggcaaggtgaaggacatggccacaaggttggttgggtggcaatgcatcacgatgcgctggttaggatcaaccttgaggcgctgaatgtgggtcattaagtgtgccgggaactcactggttggttgcccgccgtcgttgaaaccccacaacagattaacgctgtgaccatcttgggcgatctgaacgagtccggtatcacgtgccgggaagtccttcacgttcttgaagtagcgtccggttccggtaaccagaaaatactggccggcaagtttgctggcatcaaacttgatcggaatgttgcgcttaacttcatgcacgtcgccatagggagcaatctcggcctcggttaggcgatagctgacgttaccgccattgcgttcgtcccaaccgtgttggtagagattccatgtcactttacgcatctgcgtcacataaggggattctgtaaaactttgggtatattccggattcagaaattgtttcttgttatccattagaggtattcctttcagaatctgctgaattagtgaaccaacttggtgtcgcgcttgaactgaacatccttttcatattgatggatgttgttcatccagtcgaagccaaccggggtgttgtgatcctggcagaacttgtcccaaacagcaccgaatgggaaggacttcaattcttcggtttcaatcaaacgagtagtgaagtcagcgttcaattcgctcttcttcaactgatcgatcggtgccaacattgcctgcagcaagctcttttgcgttgcgcgagcgccgacaacccaagcagcaacccggttgatcgttgcgtcaaagaagtcaaggccgatgtgggtgcgatcaagataaccgtcacgaaccaaggaacgggtgatccgaatcaaagcatcgtccatgatgacaacgtggtcagagtcccaacgaaccggacgagaaacgtgcatgaacaaacctttgccgaatgggaagaatgcgctgaacttgtcagacacatcttcagtaggatggaagtgtccggcatcgatggtccagagtttgttgcggctgatcgcgtagttttgatagaactcgtgtgagccggtggtgtaggattcaatcccggtaccaaacagcttaccttcgaaggattcaatcgtattcttttccggaagtggatccttgatgatttcgtccaaagccttcaacaagcgcaaacggggggtcttcttgtcaattgggttgtctttgaagccatctgggaaccagaagttgttgacaacctggctgcctaatttttcaccgatgtagttggaaatttcccggctgatcttgccgtgacggatccagaaatcccgaacctttggatctggtgacgaaaccgtcatgttgtctttaaccattgggtgggagaagaaggtgccgttaaagtcaaggccgatgccttcttgctttgcccaatcaatccaataatcgaagtcttcaggctccaaagtatccaagtcacgcttcttgtcggtaacggcatagatagcgtgcaattgaacccgatgcttgcctgggatcaggctcagggcttcgtgtaagtcgccggacaattcatccggtgtacgagcgatgccaggatagttaccggaaaccccgatgccacctgtcaatgcctggttcgggaacaggaagccatgaatatcatcgccttgccagcaatggactgacagaggcaccttttccaattccttcatagcggcgtctgtgtcaacaccgatttctgcgtaacgttgcttggcaacttcatatgccttatcgacttcttctggtttaaccatgtgataaacgctccttttttgaaaatgatttgaaactacttgttaccaaaatgaaaaaccgagttaatccaagtggaaaacttcatgcagatcaactgctaccggactgttatccggattggtcttcatgagtggctccatgtaagcccaccactttttgcaaatatcggtgttggcaatctggttgtacttatcgacatccggtacttccagataggcaaataattcaccgtttgctttgttcaagtagatggaatagttggtggcaccgtattccttgagtgccgccttcatttccggccacaactcatggtgccgcttttcgtattcatcgtacttgtcaggatagacatacatgacttggccaatgcgtgccatgatcaaaccgcctccttagattttgcagctgccttggtcggctttgctgtcttcataaatgctttgtacttcgtcaacacatcaggataggctgtcgcattcggttgataagtcttcaagtcaaaggattccctgattaacttgcgacctgccaccacgtctttaaccgcaccggtcgtaatcatttgaaccagcaaattaccgatcgcagttgcctcactagggccggcaatcactttgatgccggcaagatcagcggtcagttgattcatcaaggcgacattggagccaccgccgacaatgttgagagtgtcaatcggatcggcaatgatggtgctgagtttctgaatctcgttggcatagtacagagccaagttttcataaactgcccgggtgagttcgcccggagtttcaagtttggcctgaccggtttccgcaacgtattgttgcagctccttgatcatgctcttcggattctcaaaacgcttgtcgttgacatcgatgaaaactcggaatggtgcgactttatcagccatttctgccaattcattgaaactgtattgatccttgagttcgcgcttgatgcactgcacgatccacaagcccatgatgttcttcaagaaccggtacgtcccataggcgccccattcgttggtgtaattttctttgaaggcatcctgaccattttccggcgtgtttagttctgctccgagtaaggaccaagtgccggaactcaagaatgcccagtgatcaccaagacctggcgtaccaacaacggcactggcggtgtcatgagtggcgaccgtaataacatccgtgtctggaatgtcatacttcatgtgccatttgtggctgatcttgcccagcggggtgccggattcgaccaactcagggaattgatcttgcgcgacgttgacttcttttagcaaatctttgtcgaacaggccttggcgcaagttgagcatctgcgtggttgacgcattcgtgacttcagtgaccgcattaccggttaacacgtacccgatataatccggaatcatcaaaatcttatcggctttagccagatcgtcacgttcttcggtgtacaactgataaagcgtgttgaagttctgaaactgaataccggttttttcgtagatatacgacttaggcagctctgatgtgagcttactgatggcgctgttggtacgcgaatcccggtaactcaccggatcgtgcattttcttaccatcagccccgaccaagacgtaatcaacggcccaggtatcaatgcccatatcaatcagcgtataacccatctttttgactttctccaagccagcgaagatttcgttgataatgtgatcaatttgccaccgatcatgcccgttttcctttttaaaaccgttcttgaagcggtggacttctttaatttttaattgtccgtcaacgacagcaccgagcatcaggcgtccgcttgaagcaccgatgtcaactgcgacgtatgctttcataaaattgcacctctcttaccaacaacattggataccgcgcttcttaggtagtcacgcgttcatttttcaaaactatttgtctggattcatcatttgctgagcgaccgagttgccggcagctttatctttggccgcggtatcgcgatcagctttcgccttttcatcatcagtgaggaatttatccccacattgttcacgggtgatttcttcaaggctcttgccacgcgtcttgggggtccaaatcgtcccaatgaccaaggaaacgagcaacaggccgatcatgaatgtaccagcgacggtgaaacctaagctgctgagaatggccgggaaaataatggaccaaacaccggcactcgcccgaacaacgaagaacatcacaccttgtgaacctgcccggaactgggtcgggaagagttcggttgcccatagtgcgtaccatgcctgagcaccaatgccggcactgataccccacaacgcaacgaacgcccataagctccatgactgtgccatgccggcataagtcaggatgatccatgaagcggcagccattgccgcaccaacgaagaagaagatccggtggttagcgcggtcgccgtacttagcaaagccgaagtaggttgctaccgcggtcaggatccatagaacggcctgtagcatgttggcttcctggttagacaagccgcccgccgtttcgtaaacatacggcatgaagaagcccatcgcgccggcaaccaagttccagaacatgtaaacgccgattaagaagaacaaccacttaagcgaagttttattggagaacagggtccgatatggatgggatttttgaccggaagacttttcaaacgccttgcgatcctgccatgccttggattcgccaagaccacgttgtaataaccaagcaacaaaggcaatcaccgttagcaagccaaacaatatccggttacctaaaagacccattggtgcaagaatggttccaagaatgaaaataacggctggtcctaacgaccaagcaaactgtgataccccgatgttcttagcccgattatcattttgcgatgtttcggaaatatacgtccaactagcaggaacaccggcaccaactgctaaaccagtaatcagaaatccagtgagcaacattggaaaactaactgcaaacatcactaaaatcgttccaagcatgtaaaccaacatgtcataggtgtaaattaatttacgcccaaacttatctgacagcggaccgccgatcagcgcgcctagtgccgccccgaacgcattcgccgagagtgcaccgagcaagccgacttgaaaactgcttagcccaaaatgttgggtccacagtgtcaagccactggcgccggccacgatgctgccagaatccaggaagttcgtaatcgaaacacgaaccgtggattttaacgagcttttctctgaagccattgtgttacctcctgaacatttataattttgtcatcgcttacagttaacatttaaccgcttacatggtatggtcacaatgtcagataaatatcatgagtggaacataaccacaggaggccatcatggaactatcagtcttaaagcaactggaaagcctaacgacaatcgaaaagcagcaaaaaaaccggcagatcttcagtgacgatatcccgccgactgccatcgacctgcaggagtcaaaagagtttaatgttccggttttaaacgattatttttttcgcaaccacgccatttacgtcagcaagcacaatcgctttgcaccgtatccgatgcacacccatcaattttttgaaatgaattatatgttgcaaggtaacgccaacgaaaccgtgaacggcgatcgggtgcacttgtcacaaggtgatttgctcctattggatatcggtagcgagcactcgattgatgcgcttggggaaaatgacatcctcatcaacgtccttttccgtgaccgcaacatctcgctcgactttctcaaccaaatccaaagtcagcaaagtgtcctttacgacttcatgattaaccatttacgaaaagagaaaaccgagaaacgctacatggttttccgcagcggcatgcatgatattcgcacgtcactggaacgcatcatcgaggaatacttccggccgcgacctttttccgacaccattattcaagcagaattaaccgtgctgattgccgaattgattcgcggcaatgaaccgaccatcgatgacccatcgccggcccaaaagctagcggttaagctgcttaatgacatccacaagcattatcgcgacttgtcgttagaagatcttgccaataaatatgcctataacaaaaactatttaggcaacctattctccaaagaagtcggtaaaactttttccgaagccttgactcaagaacggctgatcaatgctcggcggctcattcaaaacaccaagaaaccgatcagtgaaatctgtctcgaagtcggcattagcaacaagagcttcttttatcacaagtatcatgatcttttcgggaatacgcctaaagatgatcggcagcacaccaacggctacatctcacctagccacactaacccgccgttaaccattctgtaaatatgttccgaaatgtttcacatttcggtaccgaaaagccctctataaaccgctttcaatgtgaaacgggaaaagtcaactaaattctggaacatattctcatatgtttagatgttgctcttgataaaaatatgaattgtgaaagaatgaacgtgtaatcaatttatagcgattgaaggagcgatttttatgaagatcacagcagctgttgttgataaaaaaggtgccgattttgaaattcgggatgatgttgaattagcgccgatgggtcccgacgatttgcaggtgcacatggttgcgaccggcatttgccattctgacgaagcgttgcggattggtgacgcggttatcggttatccgattgtcctaggtcatgaaggttctggcattgtcgaaaaggtcggcccggaagtcacccagttcaagccgggcgatcacgttgtcctgagtttctatgcttgcggtaactgcaagaactgtttacgcggcattccaacgcagtgcttgaattatgcgcataacaacctttccggtacccgtccggacggttcggcgcacttcacggaaaacggcaaaccggtggctgacatgttcgaccaaagctccttcaccaccacgaccgttgttcgcgagcggaacgctgttaaagttgacaaggatcttgatttacgtaagcttggaccgttgggctgcggctatgtgactggttccggtaccgttttgaacacgttgaagccaaagccaggcgatacgattgcggttaccggtactggcgcggttggcctagctgccatgatggccggcaagatttctggctgcaccaaggtcattgcgatcgatattgttgattcgcggttgcagctggctaaagagctgggtgcaacggatgttgttaacagcaaggaagaggatccggttgaagccgttaagaagctgactggcggcctcggggttgactgggctgttgatacgactggtgttaaggcggttatggaagatacgatccagatgctggctcaaggcggtaccacagcaacgattgcggttacgccgcatcatattgatgtggatacctggaatgatctgtgcgtcaatgacaagaagattgtcggggttaacatgggcgattcgattccgcagattgatgtgccgcggttgattgaattttacaagcaaggcatgtttgactttgacaagactgagaagttctattcatttgatcagatcaacgaagctaacgcggattctcgttctggtaagacaatcaagccggtgctgattattgataaggattatgtacctgggaaataacagtgtaggctgattgttctgtcaccgcgccaaactccgcaatctccggcgggtctgggctggaacgtggtgggcacgacttagagcctctgcaaaaccggcagagtctctaagctcggccttgtactacgccgggaaaatcgcccggctagtacaatctcaccactgagtccgccccgcctccgattgctccgctttggcactcaggctcgatgctaagtttcttagctttctgcgaaaacacttgatgtttgtatttttacccctcattcaactaaaaagcctgtcatattcgcaaactttgtttgcgagatgacaggtttttttctaattcttgtagcttggtgcctaatccggttcgtcccagaattctagtggaatgatgttgccggagttcattgtgttttttgggtcgaagctcttaaggagcgttttgaggacccagtaggagctgccgtattcttctttgatgaatggggcgcgggctttgccgacgccgtggtggtgggacatggtgccgccgcgtttgagggtttcttccacgatgattttgttgatcggatcgtggtagcgggccatttcgccggcggggtcgtcttctgcatcgatgaaggcatagacaaagtacaggttcgtgccgttgacgtagctgtgcgaagagtggccgccgatgccgtataggttcgggatttcttttttcacgcgtgttgtcacggcttcaaaaatgttggcaatttcatgccagttagcagcaacttcggtcgtgaagccgacgaatggtgttttctcgagttggttgacttctgcgtcgacctctttttgcgtccacgttagatgtttgaaccaatcaatgatttcatctagcggctcgtatggctgcgtctggtcggatgcttcgaccatggccttgatggcgccagctgtggcgtcgctgagtggttgtgggccctctgttcggaaaatcagtaccggtttttcggcgtgttttggataaaactgactccagtcctgtgcatcgtaaaggcgaatgaccgatggccgatagccggctgctacaatgtcgcgcaacaggtgaaacccttcgcgcatggtgtcgacggtataggccagataatgatacgtatccggtaaatatgggaacagcttgacggtgacttcagtgatgaacgcaatgctgccttcgttgccgataaacacatgacgaatatcgggaccgactgagcgccgcggcacatttttaatccgcacgatgcggccatctggcatgacggcttccaaaccgaccaccatgtcttcgatcccgccatacaaggtcgatagttgcccaatgctacgggtggccaccaaaccgccaaaatcggctaacggctgcgactgcggcaagtggccggtggtgtaacctttttcattcagccaatcctcggcctgcttcaagggtaccccggcctgaacggttagttgcatatcttccgggtcaaacttcaagatttgatttaggcgtgatccgtcaacgatgatatggggctcgcgggcactttccaatccccgctcaatctctgacccgcccgttcgcggaatgacgttgacgcctgtgtcattggcatatttcagcaccgccgccacctgttcaacattttccggataaacaatcgcgaccgggatcggtgcttggtatattttccgcgctcgtggatatttccggtaaaagtcaaggctggcatagtttagctggtctggatccacattaacctgatcatggctggttaactggatcaattgttgtacgattgcatcttttgtaacggtatccattagattcacctcatctactttcaatcccaactggcaatcaacggttcgccgaccttgccgcgctcggcaacgccgttaatggtttgaaggtctttaaacactggatcggttaattgatgcaggttcttgtacttttcgtatactttggcatattgcgccaccgcatctgcttgcggtacaaagctatcggccggcttcaccatcgccgcaatagcctcgtcatacgtgcgatattcgccaatgccgactgccgcattaatcgccgcacctaacccagccgcgtcggtgatcacgttgcgctgcgccggcaagttgaaaatgtcggcaattagctgcatgaaaatgtcattctgcgcgccgccgcctgtgaccactagccgatcaaccttgcgatccaattccttcagcatcgccgttgagtaatccagcaagttaaaggcaagtccttcaagaatcgaacggaacatgtgcccgcggttatgacgctcgtccaagccgataaacgcgccttttctaaacgggcgatccgcagccggttgccagtccaaaatggtcaacaacccgtcactgccaggcggaaccgtggccgcctcgcgcgtcagcacatccaaggtggattcgtgggtcgcatccccaatcccctgaaactgcttggcgaaccagctaaccgtccacatgccgcgataaacgccgttgctttcatacaaatattcatttggcacatccgcaaaattggtccagtagtagcgggttgtcccgaacggatgattctcattgccttgcaacatggaagtggtataggtgcctagcgacagcagaagatccggaccggttttcagccctgcgcccagtgcttccactgccttgtcattggcagtggcgatcaccggcaagcccttcggcaaacccgttaccgcggctgcttcttccgtcacattgcctaaaatgccgccgggcttaaccagtttgaacaaagaagtccgcggtagattaaggaaatcaaacatcatgtcctcatcggtccagtcccacttgtccatatcaatcggccacgtgccaatataactggccgccgtgtcaatgcgattcccggtcagtcggtaagccagatagccggtgcttgcggtcacatacaccgcatcgtcggtcgtcttttcatagatctggtgcgcccggtcgtccatccagctaatggccggttgggctaagtcgccatctgcctttaaaaccaatcgattgaagcgaatgctgcctaagccaatcgccagaatttcattcacgtcaccgtcaaacttcgccatcaacgctttgctggcggtttgcagcgacgtccataaatcatcatcaggatgctcaaccaccccgccagctgcggtatgcaacggttttagcggctgatgctcctgccacaatgcgttaccctgcaaatcaaaaatcgtcaatttgttactttgcgttccttgatcaatggccagtatataacgatccattcaactcgcccctttcggatacaaccgaaacatgtgtggtcggcggcaaacgcctcgtaaaaatcaccaaatcggccagtccgtttcggccttttaatcgcaaaaaagagcgcgcctccctattttcaaggattgcgcgctctttttgctctgcgctaattttgccataaggtggtattcgtggtggaaatgcccgttgccccagcggccaagtcggccataatcgcttcttttgtgctgatcaagccactactgataagcggaacatcggtttcatgggtaatccaggaaaccgcttgaggcataatgcccggcatcacgtcaatcatatcggcatgcccgacatcgtactgccgctgcatcgtatacagcgtccgcgaatcgatcaaaaagaaacggtgaacggtcaacattttcttctgccgggccacggccagcaagtgtcccttggagctcaaaatgccatctgcatcggttgttttggcaatgaattcaacggcactggggcggctcgccagcccttcaaccagatccacgtcgacaaacacgatcttcttggctgcttttagctgtgccacgatatccccaatgttaagaattgacccatacaaggtaaagacaactttgacatctgcggtcaaggcagcatttaagcctttatcatcctgaatcccggcaatcaccggattagccgcgacaacatcttgcagttgcatctcttactcctctttcaagccaccaaatggcatacaccacattgttaaacttttccccgtgactaactgcggttactctgctaatgcatgggcctgataatctttcgaatattgatccaccgcacgcatggccgcaacgattgcttccggtgatgtatcaaaccgtaattgatcaatgccagtccaagctgccgcggcatcattggccactaacatcaactcatcatcggtggtatcttcccaaccaagatcttccagtgtggttggcagcccaacctgcaagaagaagtgcagataatgattaatcacttctgtctcggcattttccatcaacagttgcgtcagtagtgaatacgccactttctccccgtgcatcaaatgcttacccttcttcaacgccgggaatgaattttgcaaagcatgtgctaggctggtgccgccgctttcaaagcctaagccgctcattaaaatgttggcctcaatgacggcttccagcgccggcgtaaccaccttggctttgttggcttcaaacgcctgggcgccaaactcaaaaatcgtatccgttgacgcctgggcaattttcatcgccgtgatcgtgccgatgccttgcgcattggtaaagccgtggatgtcgccaacggccttggcttcaacataagtcgacagtgcatcgccaaagccggaagccaagaaccgcggaggcgcctgactgatgacggccggatcaaccagcaccaaatcgggactcttggtatgaaactggtaggcattaaacgtaccatcttcgttgtacaatactgacagccgggaaatcggcgcatccgttgacgccagtgtcgggatgatcacggtgtaaatgttcaaatgctggccaatttctttggcagtatcgagcgttttaccaccgccaataccgatcacaaagtccggcgtgtccttgatttcatcaattgccttttggatctcttccggtgaagcctcaccgccgaacatcagcttggtgacggtatagtcattgtctttcagatagtcaatgaaccgatcgccaaccaaaccgtacacattctcatcaccgacaatcaccgctttggaaccgtaccggcttaaatacggatccgcgttaaacaaaatgttcttagcctgaatataattcgatggactgataaaaatcttcggcaaatcgatttgcatcactcgcgcctcctgaatcagccaaatgtctcgttgagttcatcaatcaatttgttcatgcttgcttcgtcactgtgcacttgcggaatggcaatcagttgctccagcgacagattcttgaccattacaacaccagggttggttgatgcgccggcaacatacttatcgacaaccttcatgtaccgcttatcagccaacagttccgacaacttggtatccttactgaacttagccatggttatgatcctcctctttcttaaacctttggcattaacgcgctcacagtcgcagaaatctccgtgtaaggacctcgagcctaaatggccaaagcccagccatttaggctcgaggccacttacactccgatttctaagcgctcctgttcgcgctcattaaaaaagagagataacctaaactggtatacacgaaataccagcggttatctctcttcttctctctaaccaactgaagcttataacagcgctttcattttgtcaatttaagcgactcgatttccctgtttatttagtgaccgcggttgacttttataatttttgtttgttagtatcggttcaatattttaattttgtttattaacggaggcaatgatttatgttagctaatacaagactcaaagttcatcagttgcttgctgtgaagaccagttttggcacctcacacaaaactggtataggtgcttaaccatgtttcaatacatatatcgattactggtgatttcaggactggctttcgtcgcttactttgcttatgatgcgcacgtctttacaccagggaaaaagattaatctgaagcgggatttagtgctgggtttgatttttttggttttgttgtttgtgacggcttatgtgagcaagtttgttaataagtagccgcaatatcttgccagtatctcacaacagactactgccacgaacacacagggcgaagacaaaaaatgtcttcgccttttctcgttcctctagcttccttagatatttttaaccttttcaaaccgaagccgaattgacaagcttcaccggctttttcagctattcatgaataatttccttattgacatcataatatgacacggtatatttaattgtgtacaatgttaatggcgtaaacgttgtgcatgatgtggcggggaaattttcgctttcttttgaacgcaactgtcatcttggcagtgaaaaatcgcatgcgcgtaatgtcgtgcaaaacatttttcacacttgccttggtctttcaagaaagagggtatttcatgtttaagcacactcgaaagttgcaatacaacgcgaaaccagatcgtccggatccattaatggctcgccggctgcaggaatcactcggcggccagtggggcgaagtgacaggaatgatgtcgtacctgtcgcagggttggtcgtccaccggcagtgaaaagtataaagatctgctgctggatactggtaccgaagaaatcgcccacgtcgaaatgatttcgacaatgatcgcgcggctgctggaaggcgccccgatttatgcggaagccgatgcgtacaagtctgatcccgcattggctgcggtcatgggtggcatggatcctgagcacgccattgtgcatgggttgaccgctagtttgaacaaccccaatggtgctgcgtggaatgcgggttacgccacctccagcggtaacttggtggcggatatgcgattcaacgttgtccgtgaatccgaagcccgcctgcaagtcagccgcctgtattacatgacccgcgatgaaggaatccgcgacatgcttaagttccttttggcacgcgaaacccaacatcagctgcagtttatgaaggcacaggaagagctggaggacaagtacggtgtcgtggtaccaggtgacatgaaagacatcgaacacaccaaattctcgcatgtgctgatgaacttctcggacggtgacggctcgcgggcctttgaaggtcaagtcgccaaagacggcgaaaagttcacctatcaggaagatcctgaagccatgggcggtgtgccgacattcaaaccggccgatccgcatcttcataacgatcaaggataatctgatcaagcgctccttaaactaagatcggtggctgaaacaaaaaacctactagtatgcaaactgcgcagacctgtgattaaaacggtgccgactgttttatctgtttgtttcagcccggtcaagtcacgccccgccacatgctccctcaattagcaaagtaacgttccggcaaggactggttttaaccagttgcttgccggattttttttgaaaagatttcgattatgcaccgcaactacccagagcaaaccggttttacaccatttttacctgcgttggtggatgaaacccttatactgaaattgacgatatatttacgtgatagctggctcacgctcaggaggtacgcttacatgcataaaagttggtggcaggaagcagtggtttatcaggtttatccgcgtagttttcaggatagcaatggcgatggcgtcggcgatttaccgggaatcattcaacatctggattacatcaagcagctcggtgccaatgtgatctggcttaacccgatttacaaatcgcccaatgccgacaacggttatgacattgcggattaccagcagatcatgccggagtttggaacgatggcggactttaagcggttgctgaaagaagcccatgcgcgcggcttgaagattatgatggacttggttgtcaaccacacttccgacgaacacccctggtttcaggcggccaagcaaagccgcacggatccccaccacgattggtatatctggcgtgatccggttgatgggcatgccccgaccaattggcgcgcggattttggcggctcagcatggacttatgtgccggaagtcggccagtattacctccatcttttcgccgtcaaacaacccgacctcaactggcaaaatccggctgtacgcgacgccgtgttcaatatgatgacatggtggtgccaacaaggcatcgacggttttcggatggacgtcattaatctgatctccaaacccgatgtgttcgaagatgatccgcacctctttgaacagcccaacggcaactcattaggcttaattgccaacggtccgcacgtgcacgattatttgcgggccatgaatcaaaaggtgctgagcaagtatgacctcatgacggttggcgaagcgcccggtgtcacgccggcactggcgctcaagtacaccgggtttgaccgccacgaactggagatggtcttccaattcaaacatgtcggcctcgataatgatccgcaattcggcaagtggtcattgcatcggcctaaactgactgatctcaagcgggtcttgtctgattggcaaaccgccttgcatgggaaagcctggaatagcctctactgggacaatcacgatcaagcccgcgccgtctcccgctttggcgatgatcgcccggcttttcgggtacgctccgccaaaatgctcgccaccacattgcattttctcgaaggcaccccgtacatttatcaaggcgaagagctcggcatgaccaacgtcgcttttccatccattcacgattatcgcgatcttgacacattgaatgcctggcacgagctcgttgaacagcaacatgccctagcaccggacgatatgctgaaaagaatccaccgccgttcacgggataatgcccgtacgccaatgcaatggacggcggaaattcaggccggtttcacccgcggcaccccatggctggcagtcaatccgaattacaccacgatcaatgccgcttccgccttggctaatccagactcggttttcttcttttatcaaaagctcaatcgcctgcgcaaacagtatccagatttgatcgtttatggcgactacaccttactcgatccggatgacgccgaggtctatatgtatcaacgtcacgccgctgatcaggaattgttggttgtcagcaacttcactgaccagacactcacgcggaacatcgccgaacgccagccgcaagctgcccagttgttgattagcaattatgctgatgacgccggtgatacgttacggccttatgaagttaaggcatatctgggcgagcaacgatcttgaaggtagaagcataagcgcgccaagttgcttcgtatgcggtcacgctttcaccccacatgaataacataaacaacataacaacgtcacaatttcgtcacaactgctcggtagtattaacaacatagaaatgagccacccactcattcctacaaaccccaacccaactttttcatttttactcctccaaagtagaaatcgccgaccggtttcccagccggtcggccaatacataacaaaacccgctgtttgctgagacagcgggtttttgtgtgagcgtgagcaggagcgcttacacgtagatttctgcgaatgcgaatacgttatggagagcggaagtgtcaaaggtgtagtcaagaataattgcgcctagccaaattttcatgctacaataaaacacgaagaggagcactggttaggcccagcactcctcctctggcagagtcagttgtttcagacagctggcattaaagtaaaaacaatcaaaagaccgttagacttcgggccagaaatctattgacggtctttttgattgtctaaaatcgctttcacaacatcaatgatgaatgcagccagtgctagcgtgaacatagcaaaggtcagcatcagcattaatgcgtcagcaacggacaacgagacacctccttccgtatagattttgatcatcgcgcataggcgaccacctcacaatacgttggatttgccaaaccgtcatattaacttctctgttacagccatcatatcatatgaacagcaaaaacgcctacagccataaaggttacaggcgttttttattcaccgcaattttgcggttttacttttctctaacatacttaaaatacaggccgccgatcacgacgctcatgaggatcacgccaccaatgatcggtaggctcttaaagatcaagtcgccagcttgcggtaacgactggtcttcatgatcctgcttcgactttttatcgtcgcccgttttctgcccagaagacacttcctgagaggctgacgaggcttctgcatcttggtgaccgtcaagctgatccaatgcggtttgcaatgcttttactgcctgatcaacagctgactggtcggcctgcgaatcggctaaaatccgctgagcttcctgtaacgcctgatcgaacgcctgctttttgaccacgcttgccaacgaataacgatcggtcttcttagcatcaagcgcctgatcgattaacttttttaaattatctttttgcaccaccggaactgcctctgctgcttcaaaggcgccgatcgtcggatgttgcaaattgatcggcttgccggcaaagtcttgactgatcgggaacttctccctcactgccgctggcgtcagttcatcgacattgatgccggcgttggcggccggcgattgggcttgcggaataaaggctgccaatccagtgcgatcaaaagtgccatccgcctgctgaatcacgccacttggcttagctccagcatccaccaactgcggatccgcaaaaatattcccactcacatcaacggttcctgcatggctctcgtccatcagcgcctgtgggtaaaacaggttgtgatccaagcgtccttcggtaaagaccggtcgtttggtgccattttggttcaccacaaagcgcggcacattgccacccggtgcgtaaaccagattattaacgaatcgaattccggtctggccattgttggaaatcatcaggttcttcacggctttcccgacaataaacgtgttgttgttgaacagtgggaagccatcgatgccatcagcctttcctgaaacaacgaaaatcagatgattcaatgctggtgatggcacgtcctttacgtcattgacactgaggttatagcggaaaacattgtccgtttggtgatcgcccataaatagcgtgaatccgccagaattgtcgtgggagtaattgtactgatagacccctttggatgcaaacccgtcaaaatcaaacgccgcaccatcgaggtaatggttgggaatgtcaaacacttcattatattgggctaaattgtattccccgcccatgaaccacaatccggcaaagtttttgctggcaccggctgcgtttttggagttcggcatgctattggcagcctgcaccgtattatactcggcagtgccattttcactggaactaatgacaattccgtcaccggcactgttgcggatgtaattatgtctaaaaatggttttggcgctggcctgaaaagaatattgatcccaaccgccgggcaaaaccgaggcgttggcatcgttgcgcaggccttcatttgcaacgtcagtgatcacgttatgggttgcagtcacatccgtattgccgacaatgataatgcccccggaattcttaccggccgccaccattttcccggtttgatcgggaatcaggtcactttgataagcgccatcgacgttgtgcacgttgttattggtaatcgtaatgcccgttcggtgtgatgctttaaaaatcgccagcttctgctgaactgcggccgcatcgttcccactcggatatgcggtctgaatgtctgacgcgaccaaaatgccaatccgcatcccttgccgattgccatcacccgcagtattcgtcacttccaagtcagaaattgtccagtgattcgcattccacagctcaacggtcccggtcattaaattgagattactcaacttgcgctcgtgatagggatttttgttagccgtcgtccctaaaccattgataatcgcctttttgcctgtgctgccttggttgtaactgccaatggtaatcggcgcggtgctagtgccttcgccgtttttagcgccgtctagcagcaactggccattccaaacactattggcatcgaaaagaatgcgatcacctggttgaaatttcgtcgccgcaaccttctccagcgattgccacggctgatcgacagatagcccgtcatgattgtcatcgccgttgttggccacataaaatgttcgcggcccggcagctaacgaacgttgcggcgcctgcccgttgatcatcaccgccaaccccagcaacgccaccaaaaatacccaaacttttccttgtgtcacccgccatcgtttcatgatgtccctccatttcaggcaaaggtttccttagcaagctgcgccggatcaccttgcaccccggcttgtttagctcgcttttctaacgtcttcgccagttgcgcttgcaaaatcttagccgtcacatcttctttcacatcagaaaaaggagtaaatccaccctttgctgctgatgtgactcgcaccaaactcattttttgatccgacaaccacgccgcaaaaatctgcccgacatgaccggtctgatcgttggttgcccgtaagtaggcaccatagtattggtcagcatcatgcaacgagtcattttgcccaagctggccgtgaaaacctgcggcaacaaacgctttttgcacactagccagatcggtttgctgcccattaaaccgctgaaccaattccgtgaactcactaaggttaccgattttcccgcgttcaaaggtcagcgtctcataatgaatcaaatcaggccgcgcccagtacttacttttattctgccgataaaaagcaatttgccgctgacccgttaccgacttgcggttcgccttgacgtattgtgcctgcagcttgagcatcaactcgcgatgctgtttctgcgccgcggccatccccgccaaatcggcaccagttccttgcgttttcttcagggaatcaaattccgccagcggtttcgtcagcagtttggctttcaccaacgcacgatcctcaatcacaaactgcttcaatttattcatcgcttggatttgagcggcctgctgcggcgtctggcgcccgtacttggtctgccaaaagcgggcgtcatacttggcgtgatacttcgtcacataacgattgaccgtcagcgctttttcattctgcaaaaagaggcgataaacttttgccgacatcggtgtacccgcaacggatagcgcgtcggctggtttaagcacatcgcagccaccgattaaattggcaaggatgccgagtagaaaaagcggcacccacttccatcgcttcgctttcatctttttcatcgctaaaacacctgaaaatgttgtgctacctgctgcccttgccgttcgaaaatgttcaaactaccataagcttcggtcccgtcgaaccagtaaagcttgcggccgacgatcgtgttttccggttgcaacgtcaacaaaaagttacgcctgttatccaaatctacccgaaaaccactcgccaaccgctccggtaccacggcatcgcgatcaccggactgctgtgccgcgatcggcatgatggtcacaggctgttgccgtggcgacaacaccgctgcttgcaccgtgaagtcggtaaacatcatttcactttccagccgggtcaaatgttcgagcgtgttataacgcggtgaaaataattgctgactggcccaaacctgatcatcactcatcgcaaaattcgctatgtcgcctaattgatacccagtgtcgtgctgtgtcacgattaactgcggggctacttgccaaaaacgcttgagggaatgctgaccgggatgatgaatcatatcaacaatcagccacagccgctcatgacttaagctaatcagcaggcgtgtgatcaccgccggaaccgcctgcgattgatcaagaaacgttaacttaaccacctgaccaccggcaaaatccactagcgaatgattcagtggtgtcgcaacatagcgatacttccacgaatcgttaggcaaactaaacgggctatgatcaagcgtcacggtattatgcgcggccaccgacttgagctgccgccgctccgtgccatcaacgtaggtgtagcgacccggatcaacgagcacatcatgacctccgatcgtcaaatccacatgtcccagcgcagcatgcccgtgaccgctgcctaaatcgccattaaagacatgccagtagtccgcatgttggccccaatcggagcgccagaagtaattaccactagtatgcgcggcgaactccttcggcagcggtgttttagtttcagttttggctgacagctgccactgctgatgggcgagttccaaaagtccgaaatcaacaatcggcgctaaccgttgctgcaacggcgacgcctgctgcaaaatagccgctgacgcattgtacagactatcaatccgaatcgcgtcagtatcgccttgttgcaacagcaacaaatccggcttcacatactgcgtgatcattcgctgcatggcacgggcttttgtcagcacaatcggcgccactgccaccccggcctgctgttgtgcagcaatgaccgccaaagtgctccgccatacttcaagtagataaagcggcgactgttcccattgcatcccttgcgcatcaacctgcaagtccagttcggtctcaaatttttgctgcgcccactggacaatcgttggcggcaaaaccttgggaaagcgcgccgcgtataccaagatacccgtggtaatcaacacaccccagttactgatatcaaacttttccgtatagttctgctgcaggtacgccgcctgaacattgaccgcctcttcaatgcgggcttgctcttccttacttaactggtgatcttccagcaagttcgcgacaacagccgtccaattcagcaaacgaatgccagtgtcaatcgtccgccatgtcgccggcgccgccagattttcatcaatccaactgaacagtaaagctttcattttagcttgatagtcaatacgaccggtttcgtaataagcttccaaaagatccagcaaatactcttggcgttttaacatataaagccattccggatccccattaggcgtttgctgccaagtgatcggattcatggtgtaactcacttgcgtcggctccatcgcgtaggggctatcaaataaaaattggttttctaataaccggtcagcatttttgcgggcatcatccgtgagatgctgttgctgactcaactgctgaatgtacgtggtccaactcgtgtccgtcacctgtcgccgcctccttcacaacaccagcaatccccatccgtttaaccgtgatcacggtattcaccgcaatttcaacttgaacgtcttcctgattcaaatgtttgattttgccgacaatcccatcaatcaaaacaatctgatcgccgggtttcaggttcgcgtgcatctgatcaaccatcttggcctgtttgcgcatcgctgaccgcttagctaacggaatcgcgaccaagtaaagtgcacacacgatgactaacagaacaatcaatgcaatttgccatattgtcatcagatgccatctccttcatcttcgtgcttgatgtccggcaccggcacttcgtcagagttggtcttcatcctgtctggtaaaatttcaatcaattcttttgacaaggtaacggtatgccggagtgtttcatcaacgttagcatcgtcaaaaccacccatgtttttggcatacagatccagaatcaagttcaatggcgcactggaaataatgtactgatgcggacgattttgttccagcatcagccgcgcaacgatttgatgtggcgcaccaccggtcatgtcagcaaagaccaaagcgtgatcattttcatcgagaaagttttttaatcgctgctcgaattgctcgtgggtcgtggtttcgtccagattaaacgcggtcatgccgtctgtggtaccgattaacaacttcaaagcggacaataccccttctggatagcgcccgtgaccgacaactgccattgcataattcatgtgttcaaatcctccattttttcgtcgtgccaatttctaaaacagccgtcgacaaaagtttgcgacggccgaattcatcatctgattactttaagatccccagcactgataacagtaccccggcgacaaaaagcaaaataacaatcttgtaaatggtccattttttcttggtgatcagccaataaacaaaatacgtgagtgcaatcggcagcatgtatggcatgatcttgtccagaatcgtctgaatcgcgacgacttgggttttgcctttaatgacctgcgtgtactgccatgccaggttgactttcacaaaggaaaccgacagcccggcgatcacagtcaagcccaacatactggcaacatcggcaatggctgccattcggtccgacaacgtatcgataatgctcgtgccgactttccagcctaagtaccccatcagcatccggacgccaaacgtgatcccgaacaagcagagaatgaatggaatcggtgcccaagtcatcccttgaagtgctaaggaggcaaaaatcgaactgaacaacggtgctaacccgaattgcgaaagggcatcgccaatcccggctaaaggtcccatcaacgcaaacttgatcgcccggacatcgtcttcatccttaccgctgtcatacatggcaagcatgatgctggttacaaacggataaggttgcggattcgtattgtagaattccaggttagaggttgtgacccgtttaaattccgcgtcatcgtctttataaattttccgcaactgcggcatgatactgttagccatcccggttccctgcatggtgccgtagttttgggcattttgcagaacatacgaacggagaatggagtttaaataatcttttttggttaaaaccggtttgcgactagatgccatcttcaatacccccttcatcctggttactgccgtcatcgttgccgttggtcccatgatccttcttatcggcacggcgaccgttgtagtaattgttgaacgccagtacggcaccggcgaaggctaacccgatgaccggcatctttagataggcaacgcagacgtaacccagaatcagcgccgggatgtattccttcttgaccatcgtgctcatgatcaacgcgaacccgactgctggcagcaacccgccggcaacggtcaagccactgatcagccattgcggaatcgcctgaacgaacactttcaacgctgaagtgctcaaggtcgcggcgaaaccgaagcaaaaggcgaataagatgaaccctaacaaggttgtattcgccaggaaatggaaccgccgatacttgccttcttcaatcgcttttcgtgaccacgccaggttattggcgttcacagagaaaatgaaggtaatgacgaatggaatcaaaattgcaaacggataagacagggacaatgctgcagctggtttcaacccttgaatcgaaatggccataatcgtaccgacgacgcctggccccaacggattaggcggtgttgagccaccaggaccaacaccaaagcccatgaaggccagttccgccgttgcgccaaagacaaccgccgtttgtaaatcacccaaaatcaaaccgataccaaatgaaataaataatgcccgattggtataaatgccccattgttgaccggcaaaacaaaatgccgcccagagacccaccaagagcgcttgaactatagaataggtcatgcttttctcccctttgagcgtgaaccggcacgcttagaaaccggagtgtaagtggccttggacgtgatggcccgggtttaggccattgcaaccaagatccttacacgcagttttctgcgccggtgaacgcgttatcgttagtgtcagttagtgcttagcaacataatcattcagatcaaaatccgacccaacatcgttacccagtggcgtcgtgcgcgtgttcaaatccacgtgatacttttcatgcaacgtcttcaaagcgtgcagatcatcagcatccaccgcaataaaattcgtcagccgcgttttgccttccttcatatgaatgttacccacattcagttccttgatcggcacgccgccttccgccaacgtcaacgcgtcctgcgccgttttcacaatgatgaaaatcgtctgccgcggtgacgccttgaaaatcttatcgatcgtctcttgcagtgaaaagaaacgaatacccaccgactccggcattaacgaggacatcaactgttgctgaatatggcttttcgcaacctcgtcgttggcaacaatcaccaagttgacgccaaggttggaaatccacaatcgcccttgtccatgaatcaaccgctcatccagacgtactgccttaatatttggttccgtcattttaaaagccccctaccaatatagttgccaatctttataaaacctgatcaacgcttccatgtagaaatagtcgccccagagattgccttcatccacgccatgaccggaatgccaggaatagaccccgtgaagcagtaacggttctgcggtctgaccatccaccggtgtcgcataatgttgaatcagcgacttcaactgggcatgcatggccgcgcgataaaccggcttatccggatccgcttccggcaaatatttcagcatctcgtgcaacccgcacaccgcgatcaccgctgaagacgaatcacgactctgatcactgccttcttggaagatcagatcccagtacggcacatcatcttgcggcaaccgattcaggaaaaagttggtcacggctttgaaactgtcaaaagcggccgcatcatgcgtgtcatagtaatgcaaggccgtcccgtagatcgcccatgcctgcccgcgcgcccagtcggaatcgtcggcgtacccttgctttgtcgccccgcgcaatggtttgccggcgtcgtcaaagaaataagtatgaaaagtggagccatccggacgaaacactgtcttcaatgctgtttgataatgctgatcggcaacctgccgatacttagcatccccagtcacagacgtcgcccaatacaacaacggaatattcagcaacgcatcaatgatgagccgattttcatctttagcgccttttgtaccccaggcttggataaagccgcctttttgatggaagcgggttaacaattgatccgctgctttaatcccggtgtcttttgccagttgactgttcgttagtcgatacgcgctgacaactgacggcgaatacagaaagcctaaatcgtgatgatcaacggaaatcttgcggtcaatccgatcagcaaaactggcaacattcttttcggccagtgcgcgatacttttgctcgccagtgtattcataagctaaccacaacatcccggtccaaaagccattggtccattccgtgtttttcatcggtgcatagcggttgttgaccgttgacggctcgggaaaattctcaccgaataccttgatgtttaaatcaagatgcgcaacgacattatccaacgccgtggtcaccatgcgcctgtcgacaatcccggcgttgaaaaatcgctgggcattcgttaaattttcaattttcaatgtttgcctccttggtgctttgttacgaatcgtttggaatcgataggtatgtatactttttggaaataatgtttccatcttgtgacattctaggcaaaaaggctttctaaaaaatccaattgttgtactcgtgccccgtcatatagggaaacttaactattttcataaagccgttaaaaacaaaggacattgttgaactactcatttatttctttataataaacgtcctttctttttatttccaaaaagactataacatgcaagcgctttaatgtaaatcatttacgaacaattttccccaaattaacggcttcaaaaaccaataagcgcttgtaaacgctatttttatagggatttacaagcgacaaatataaacattcataatcacttttaagtcagttatcgatgttcgccctttagacagctgatgagatcagcaaaaaacgccaacctaaaaccctcaaagtcaggttgcaactttgagggttttgcgttgacgctattcagattattcaacttgttagctttttactttggctaacgattagccgcggtgcgcgtccagaatttccggaccatgtgtcgtgccaactaccaccgttttgacgagatcaaggaacaggccgtgttcaaccacgcccacctgtttgttaagccattccgccagcaaatgcggatgctcgatccggccaaggtgcaggtcgataatgtagttctttgaatccgtcagcgccttggtgccatcgtcgtttaggcgatacgccggcttcaagccttcatcctttagccgttgcaacaacttgccgctgccgaacggaatgacttcaagcggtaacgggaatttgcctagcgtatccaccagcttggtctcgtccacaatccaaatattccgcgcagaattaatcgccacgatcttctcaatcaaatgtgcgcgtccgccgcctttgatgccttgaaaatgcttatccacttcatcggcgccgtcaatcgttaaatcgatttgcgcaacttcatccagatccttcataggaatgccgagcgactcagcttgcttgcgcgtccgcacgctggtcgcaacaccggtcagattcaggtgctcttccttgacccgctgcgcaatcgcttcaaccaagtaatacaccgttgaaccggtgcccaagccaatcgtcatgccatcttcaacaaactcagctgccttttgagcggcttcctgcttcaacttgttctgatccatggccaaccatccttttcgcttaataactctattatatctgattccccggaagatgagcgggttgtcacaagacttatcggcaaattgacaagttgttttctgattatcacaggacctttttcctataacagtctatcaatttccaaaaatgaaacaaaatattttaaaaagtctcgtggttttgttaacttatcatgtaagcgccagcatatcagcgattactgatcacagctttacacaatttcacctgagctaacccaaaccaaaactggacaaaccatttttaccattgtatatttctatataataaacttcgcaaaatttcgtttggaggcattccattggaacaagtaaaaccaaaacagcaaaaaccttatggcacagtgcttatcaaagctaaagatattttagactatctcatgaaagctgacgatccgccgtcactggcagacatgagtgcggcgttaagttcgtcgaaacccacgattttgaaaattctcaacacgcttgacatgatcggcttcgttcggcgcgacgaaagcaccaaacgctattatctcggcactgagctgattccctatgcgcaaaaagcactcgacagttttgatattgccaaagtcgcgcgcccgtttctcgagaatctgcgcgacgaaaccaacgagaccattaatctcggcattgtccgcaatgacaaaatcgtcttggttgaaaaactcgagagtcctaacagcatcaaactggaatccatcatcggtggcaccatgaacatgtactcatccgcgatgggcaaggcgctgctggccaactattcgcgcaagcatttagacgattaccttgagacacataaactcaagccgctaacgcctaatacaatcaccagcttgccgaaactccgccagaatctgaagactattcaggaaatgggcgtgtccatcgacaacgaggaaaatcagccggaagtcctttgcctaggcgcctcgatcatgaaagccggccgcatttacggtgctttcagtatcagttcacctaaataccgggttaacaaagaacgtcaatccaatttcatccgcttgttgctgaatacgcagcatgctattgaacaaacgctgtaaatttaagctaagacctttaaagatgcaaaaatggcagccgccttgcttatcaccataagcaaagtggctgccatttttcatgctgaatattgtgatcgtcactattttgcgaacgcctctttaccccacgcctccagctcagtaagcgccggaaaagtcgagctatcctgatcctttaccagctgcgtaagtttcagccacgtcactttccgcggcgtgatgtcaaactgctgcggtgctgccgtcttcttaagttcaagcttttcgctgctgccatcggaaaatacgacggtgacttcctgccaataactatcatgcggataatcagcccgcaaaatcagcacaaggcgattcaacaaaacttcccggccaaagtccaatgtcaattcagcgtcagggcgctcggcaattccccacgactgaaatgggtaactgccatgcttttcgttagcaatcaccccatcaatgacattcttggcataaaacacaagttcatcccgcgtctccgcattggctgacgcatggggataggcaccggttgcttcatgctggtcataggtgttcagcgccaaattgcgtgaaacagttagctcaccttcatgtgccacccgcacccaggcatagtggttcgttcctaaaaatgccccatccggatacggccattccttctgcaagttaaacggaatccgaaaatcccacgtggtttgtttcagatacaccagcgatggtgccacactcgcatccaattgcacccacacataagcgggtgcgtcactgactcgaacctgatagtaatcgcccaaagcatactgtttgtgataggccaaataggttctagtctcactcgtcgcggttttaagcgtttgatcttcatgtcttaattgcaaggttatttcagtcatcatgtgcctcctcaaagtcattaactgctaactcggtagccaaacgttaggctcagcaaaccatgtccttttgccagctcgaaatttccgattaagaaagaccgtttttaacaaaaggcaactgtatcgtatggcaagcgaatgtgtgctgtcaaacggtggccgaaatttcataatagcgcttgcatttttgactagtcatgctatattggacttgtgcaaaataataaacattgtttctttaaaagaaatgtaggctttttcattgtcattcaatatggtcacgcgttacgcgcatagccctgaagacattaaacattacgataccgataagctgcgtgaggaattcttgatgccaaagatctttgcgcctggcgatattttactcacctatacttacaacgatcggatgatttttggcggggtaaccccaactgatcagccactggaaattgcgctatcaaaagaattaggcgttgatttcttcttacaacgccgcgaattagggctcatcaacattggcggcgaaggtagtatcaccatcgacggaaccgaagagccaatgacgactcacgacggttactatgtgggcatgggcaccaagcatgttattttcaaatcaaacgatccggctaacccagctaagttctatgtcgtttcgacgccggcacacaaaacctatccgaataaaaagttgccatttgccgatgcgttggcaaagccaatgggcgatcaggcgcatatgaataagcgcacgatctacaaatacattgacgcttcacaaatggacacctgccagttgcagatgggctacactgtcctcgaacccggctcttcctggaatacgatgccggcccatacccacgcacggcggatggaaacttatatgtattttgaattcgctgaacctgatacccgcgtcttccacttcctgggcgaaccgaacgaaactcggcacattgcactgtttaacgaacaagcggtggtcaacccaagctggtctattcattgcggtgtcggcaccaccaactatgccttcatctgggcaatgtgcggtgaaaaccaaacctacgatgatatggatcaggtaccaatgtctgaattacgttaacatttaaactcattaaaggagcgtttaaaaaatggcagaaattcatcaaaccgaagaagaaatcaaacgacacgaagccgaactcgatcattttaaaatgaagcaattcgacctgaccggcaaagttgccattgtcaccggcggcaataccggcctcggccagggttacgccgttgcgatggccgaagccggcgccgatattttcatcccgacttttggcaccgccgaatgggacaacacccgtcgcttaatcgaaaaacgcggccacaaagttgaattcatgcaagtcaacttaaccgaaccgggcatcgccgataaagtcgttgccgaagccgtcgacaaaatgggccacatcgacatcttggtcaacaacgccgggatgattcgccgtaatcccctgctcgaatccaaagataaagactgggatcaggtcatcgcgatcaacctcagcgctgtttatcacatgtccctagctgtttcaaaagtctttgccaagcaaaaatccggcaaaatcatcaacatcggctccatgctgtccttccaaggcggcaagtatattccgtcctacacagcaagtaagcacggtgtggccggcttaaccaaggccttcgcttccgaaatgggcgcctacaacgttcaggtcaacgccattgcgccaggctacatcaagaccgaaaacaccgccccaatccgcgcagataaagctcgcgaccaagaaatcctcgaccgcatcccggctggacactgggctgagccttatgaattaatgggggtttccgtcttcttggctagtgatgctgctaattatatcaacggtgcgatcattccggttgatggtggttatctgacgcgttaactttcgagctttcaaattaagcacacaacttgattgttccttattacaatgatttctaaaccaaacaggcatcggagacgcttgaacgtttccggtgcctctttaaattaacaagcattaagtgtcgcatcaaaaaactccctgtcaaaaggactagtcttcttaacagggagctaagtttaaaatacacacacctgatcttgttaaaaactaattttgtctcactaattttccttagcagcctcttgagcctgtcttgccacaacattgtcattaactttgacgaacgggatatatagcaagatgccgatcaagacaacgacagcctgaaccacaacagaacgccaatcaccagatgtagctaaaaatgcgttcatgaagaccggtgtcgtccaaggaacctgaatcaccatcggactcatccatcccagtgttgttgccaaccaagcaatgaagataccaattgatggcaagagaatgaatggaataatcagcgaaacgttataaacaattggatagccaaagataaccggttcgttgatgttgaagacgcctggtaatgccgcaaatttaccaacgttgcgcgcagctttattccgactgaccaggaacgttgcgatcaacaaacatagggtgccacccgaaccaccaattagcccaaaggattgaacaagcgacaagttaatgatgttaggaatcgcatgtcccgcactataggcagccgtattttgaacaatgttgatgatcaacagcggttccaaaatagaactgtaaatgaccgaaaaatggatgccgaaaagccatagcaggttggccaacgtgtaaataataattgttccgacaacgccagtaccaatatgtcgtaatggctcctggatgaacgttgtgatcaagctgatcaagttcattgacgtcgtatcaaacagaaccgtggaaacaaaagcaaaaaacgaaagaacaagaataattggaatcaaaacattaaacgagttgcccacagcaggcggtacttgatcgcccaaatgaacctgcaagtgcttgatatgagatacccagataaacaattccgttgcaagtaagccaataataatgccggcaaacatgcctgttgtccccatattgctaaatgacaaggcgccagtgacatcgattgccttttttgctccggttggaattaacgaaaccgtgtttggcatcatggtgattaaagccgccattgaaaccatagctgaagcaatcggattatcgaagccgcggttcttagccagaaaataaccgatcattgtggcaatcagcaaacttgaaacattcagtgtggcattggatagcattgtgccccaatactgaacctgaagtaacgttttccctttgaaaatccacgtaaacacagtgttgttgaagagcgttgccagtccagccaagatatatagcggcatgatcgttgcaaaagcatcgcgcaacgaccgcaaatgaatttcgtcgcctaattttacagcgaacttaacaaacgcctgtccaaactttgaatcttctaaacccatgcaattcatctcccattattgatgaaacaaattgaaaaccctaatcatccaaatcggcaccattagtttctatgacgtgtttaaaccagccatagctttttttagggatccgttttaagtctttcaagtcgtgatttgtccgattaacataaaccatgccatagcgcttatccatatttcctgaagaactgggaatgtcgatcaatccccatcccaagtagccaataacttccacgccatcatcaaagacagccttctttaaggcttgaatatgccgacgatgataatcaatccgatagtcatcttggatcatcgagccattgaacttttcacgcatcccaatgccgttttcgattggaaacattggtaaatgatactgattatatgtcttcgtcagaatgtcgcggaaccctgttggatcaacattccatccccattcattaactggtaatcccggaacttcttcagcgccaaagtcaagatagtgattgggaataacattaatcggaacgtgatcactattaatctgcaatgaacgataatagctaaacgcaataaagtcgctgtgtaacttgctaaaggctttttggtcttcttcagttaaatctaggtcaatatttttccgctttagaaaagtcaaaacttccgaagaatacctgccataagcgaaaacatctaacaaatttcggttgagaaattcatcaattcttcgcgcataaaaaatatcgcgcggccgagatgttgcgggataaacttcctgatatgccaacatgccgccaatttttgactgggtgtgtgcatgtagataatttgcaattctagcgtgcgcaaccatcacatggtgactaatccgatacatatcagcatctgactgtggcccttttagatagcctgaaatttgaaagacttcaggcattgaataaagattctgttcgttaaaagtaatccaatatggcacgcggtcagcgaaccgcttgatcatttctttcccatagcgaacaaatgcatctacaacatgtcgatcaataaatccgttatacttttcagctaaagctagtggcatgtcaaagtgataaagacaaatcatcggtgtgatatttcgactcaaaagcttattaatcaaatcgtcatagaattgaatgccttcttcgttgaaatcaccgtcgcctgtcgggcaaacccggctccacgaaatttggaatcgataacaattcataccttgatttgccattaaatccagatcttcgtcgtaacggtggtactcgtcgatcgcgacatgccagtcactactgttgttcgtggccgttcgaatgtcataaacggatcgtccttttcctccttcgttccatcccccttccgtttgcatacttgatgtcgaatttccccacaaaaacccgcggggtagtggctgtgacatttataaccctcctgtgagcgtgagcaggagcgcttagaaatcggagtgtaagtggcctcaaacctaaatggctgggctttgcccatttaggtttgaggtccttacacggagatttctgcgactgcgaacgcgttaatgtaactgagcatccactgagtccgagatatttcgcctcaaaatgagttcacagaccttggcaaaacaactcacaaaaaatttttacattggcgcagtgacgcttgctttatgaattcccaatgaattcggttacattatggcacgagtcgtttcacctgtaaacacatttataaaaataagtatatacatattacaaattcggactcgaatttgccggccatttgccgtaaaatgacagttaaaactacattaattgcagcgaaaaaaggaggtgtcaacacaccaatgtataaatatcaaacaattgcccaaaaactccgaaaaaaattcaccgatggctcttatcagcctggtgatttattgcctgatcaggagagtttggctaatgaatttaatacgactcggttaaccattcgcaaggctatcgagcaactcattcacgatgaagtcgtctatgttaaacgtggtgcgggcacctttttacgtaaggatgtccatcaaaacaaattggaggcatccatcgataagccggtcggtgcgaccaaaacctatgccggacgaaatgtaaccagtaaggtacttgagttaagcgcccgtttgccgactaaagaggaacagcaggccttactcatcgatgcaaatgaacctgtctacgttatccgtcgagtgcgctatatcgatggtgaagtctttgcctacgaacacaccattatgcctactaagctcacaacactaacgcaaaaagtgcttgagggatccatctacaaacatcttgcccaagttgaccatttacgaatctcaagatcacatcgcattatctccgcagctaaagccaccgcagacgatgtcaaagctatgtgtgttcaactgaacgatccggttttggtgattaagcaaatcagctacacggaagagggcgagcccttcgagtactccgaaacgcactttccttatcaaacaagtaacatggttgccgacgttaatattaatccgccagatacttggtgacatgatccttacgtccaagcgaccagcgcaattaaagtcaaaaaaatagcctatcgaagactcggttttacgagtccttgataggctatttttgtagaacaacgatagtcttcttcaaaaaatcccaactcgactttatccggccgtgaccggaaatgatcgcgaataaaaacccaagtcgggatacacgtaatagcttgtcgaataattaaacggaacgcctttgccataatagttagtttgatccaaagcgagcaccggtctgcccactggttgtttcataactgctgcctgctctgctgtcagcatggcaagtcgaaccagattctccgactctgagatccgaatctgataagcctcatgcaaaaattcgaaaatggaatggttaacagcctcagttgacaaaaacggaactgcttggagggtaaagtaagcctcttctaagcaatacagagcagcatgcaaataacgcagtcgaacgacgcgatatagttcactattttgcgaaacgtccaatgatttcgctaaatccgaaccggctttgattttgtcaaaggtaataacgtgagaagtcagatgctgatgcttattatgcatcgctacatcagcacgtgtcactaaattaataatggcgtttgacgttgccggcatgtgattgacgtaaaagcctgaaccttgcacgcgcctaagaagtccgctgcgataaacaacatcaatcgctcggcgtatcgtgtttcgtccagcctgatatcgactgattaaatctgcttcagttggtaacttatctggatattctccattacgaattgattgtgcgatattatccgcaatttcttgatatttcgtcatcaaaaaatcccttccctagaaacgaatgcaagttaactctatattgccacaatacaagcaataaaagaacatcagcactggtcaaatagattgtcatgatttcaaaccccaaaagaaaaattcatgggcacttgcaaaattgatacccatgaattatattaaagctgccgattgaaaacggttgctttttaatagctcgattttaacaagggagattgtacacaatggctaaaaagaaaattctactcgtatgcaatgctggtatgtcaacaagcctgttggtaaccaagatgcaaaaggctgcagaaaaggacaatattgatgttgatattgccgccaccgcttcagctgatatcagtaacaaaatcaatggcgaaaacccaaatgtgatgatgctgggtcctcaagtccggtatatgcaaaaagacctcgccgccaaatacgattttcctgttgaagtcattaatatgcaggactatggcatgatgaacggcgaaaatgttttgaaggccgcactcaaaattattgaccaagaagacaaataacgggagcgtagcaatgtcagaaaaggcaaagaccaataccaacgaaaatgaagacaacctagaaactgttatgggattgattgtcaatggcggtaatgctaaaagttctgcttttgaagctatttctgcagcaaaagaaggcaactttcaaaaagcagatagcaagctgaaagaagctgatgacttcttggcaaaagcccacaactcgcaatcaggtatgttgaccaacgaggcccagggcaaacatgttccggtgaccttgttaatggttcattcacaggatcatttgatgaacgctatcacttttcgcgatcttgctggcgaaattgtggccttatacaaaagattggctgactctaacgtaacggagtagctgagtcacgcacgaaaagcattaatccagttgcttaacatgtcgatagcaagagactcacgtaagctggccctttttaacaaaagcgtccggaaacatgctatccaaatccgtcaaaggaagtttaaatcaatatgacaaagaacactgcaatgcctcccaacttcttgtggggcggtgctatggccgcccatcaggtggaaggtaactggcaggccggtggtaaaggcgtctcaattgcagatgtcatgaccgcagccagccgcactcaacctgttcgtcaagtaacagagcacatcgacccgcaaaaaaattatcccaaccattggggaattgacttctacaaaacttatcctaaagatatcgacttatttgcagacttaggccttaaagtcttacgcacctcaattgcgtggaccagaatcttccctaatggtgacgaaacaacgcctaacgaggaaggtctcaagtattatgatgacctgtttgacgcccttctttcaaaaggcatccaaccggtcatcaccttatcacattttgagatgccgtatcatttagtgaaggcttatggcggctggcgcaaccgcaagttaattgagttctttgtgcgctttgccaccaccgtctttaagcgatataaagacaaaggcaaatattggcttactttcaatgaaatcgacaaccaatcagattggcgactaccccaccatcttcttcaggattcgggattacagttaagtaccgacgataactgggaagaagccatgttccaagcggcgcacaatgaaatggttgcaagcgcaaaagtggttaaagcggcgcatgaaattaaccccgattttcaagtcggcgccatgctggccatggttccaatctacccgctgacagccaaaccgagtgaccaactttttgctttacgtgctatgcaataccgctattacttcggggatgtccaattaaccggaagttaccctgcttggcttttaaattatttcaagagcaaacagtacaacattgagataaccgaaagtgacagaaaggatctgcaggaaggaactgctaactttttgggtatgtcgtattacttctcgtttgcaaccgaagcccgtcaagacgggaaagtggcattcgatgaacataacgatttagtgtcaaatccctacttgtcaaagtcagagtggggatggcagattgacccaatcggactacgctacattcttaattgggcgaatgatcgctggcacaaaccgattatgattgtcgagaacggtattggcgcttacgacaagctgactcctgatggaaaagtgcatgatgactatcgcattaagtatttacatgatcacattgaacaaatgaagcttgcaacgattgtagatggcgttaacgtcattggttataccatgtggagtcccatcgatcttgtttccgctagcacgggagaaatggccaaaagatacggcttgatctatgttgatcgcgacgataacggtcaaggctccgatcgcaggtttaaaaaagattctttctattggtatcaacacgtcattgcaacaaatggatctgacttagaaccagttcgtaacgagagccattctaagcaaccagaataatcgtatagaaaaagaccatttctggatgccacggcgcacattttaacaactatatatcaattaaaagcggcgaatcattcctgcaaggccttgccgacctttggaatagttcgccgctattttgatgcactttgattcagttaattcagaatttcggaaacaaaaaaaagagtcgcgcatttcgcacaactccgctaggtaattcgttaattttcgtcatgtaaatctttaaaaagatcccgcaagttgtcaaagtcctgatatctgccaacctttaaatcctgaattgactgttcagtcgcctgatcaagtgagtcttccattgtcggcgtgaaaggcaaagcctgatcgtgaacaacttgctttaagaaaatattgatgcccgtgttcaagtccattcctaacgcttcaaacacctgttcagctgcgtctctcgttgtcgcgtcaagtcggatggtcatggtggtctgtttcgcagtcgccataaagttcacctcaatgcaactatttaagtacttaattctaaattggatccagctagcagtgtatgtaaccatgcataactgctgcttttcctcgtctagagtacacaacgcactcaatgcaggttactttgattccgtcgtaaggtcatcaagaatacggttgaccttctgttcccgcagctgataaaggccacattgttcccgacaaaatacggttcggtcctttttaacttcgtctacaactctctcgataaccgcattagtgcgttgatttgcttgacgcaatgcttccagtttcgcgttgggttcagacaccgtggcagtcgctgttaatgccttaagaatcatctgtgccttatattcacgaatcgggtgactttcttccagttgatgcctgatcaataagtccttcatttttaacaccctcgctttgttatccgctttttacgccagatacaactattagagctggacacttccaaatcgttcaactctgagcaaattaaatagtaaccattactctctacaataggtagaatacgctggttcttctgcttctgtcaatgatatggtgcaataacgagctatctttctctttaattttatcagaacttttcggtttacagtacatgtcaaccaccactgactaaagtcagtggcttgtgagcaaacacccccgttacgagcacttgaatcacaatttgcacagatacaccactgcaggcagttctacgaactgcttgtcttacacggcaattaccagtgcctttagcgtccc

SEQ ID NO: 333 - DNA, 2052 bp, Lactobacillus casei
cgagttagaagcattgttagctgcataaccttcaacataggatcaatagctggttagatggtcatctctcagactgtttgcaccagatccgttcaacttaaattttacaatctatctttagtattcgccccaatatttagacattgtttgtttaccaacgccagggttgaaactattagttggatcatttttcttatagtgcttgattaaggccggtgctgccaaatatagatgcccaacattgtgttcggctggataaacagcgtgacgctcatccaaaattttaagcatttcttttttaagttcatgcgcatcgacgccaggttttagaatataatcctggtgcataacgtgatcaagtaagtgaccataataaattttgtgttctattttgtcttcaatctctttaggcaaatgctcgaaccacttataatcattacttgccaacgcgatatctagtggcaaaatgtcaatactatcctgttttaattcttgatatcgaatcgcaaccccagctgttacatagcggtgagttgccgctttactggtctcattggcatcggcttcaaagtagtcgccactggctttgtcaaaataagatttgagatactctcgcgcttcttcaataccattaccagccattttcaattgtaggtaatggtcgtacttttcgtaataatcatctaaccgctttggcatttgattaggaaataaattacttaatgtttgaagcaaacgatctgggaaataaggtttgaaaaacggaatgtgcttcaaaaagcgttcgccccatgcttttagcgcaaacatttggggcaaatgacccgtaccaattttttcaatcacaattagtgagtctttaccatatttcttggccaatttataagcatttttatgcatatattcaccagaaacaggcaattctttgaatgtcgtcataatatggcgacgaatatcttccaactcatcgggattattcgttccaatgtaaaacatttgtgtttttttatccattgggaatgtatctaagcggacagccaatgccgcaacgtgaccggacgatccagatacttcatacaattctttaggatttgcattgtatcgaataggcttatcagattcaacgtcacgcacaacctgttcatgatggaacattgaagcatgatgttcagtagctggtacttgattcaaatcaaaattgcggttctgcaaattagtaataatctcttcgggcgttttgcccaaatcaatgcctaaatggttaactaagtgcatttcgtcatgttcatcaatccaaacatacaatgatagctctgtataagctggacctcttctgatcaaagcaccaccagaattgttgttaataccaccaatgaccgatgcacccaaattagatgagccaatgactgaatgtggttcacgtttaagtggtcgcaattcattttctaagtgaaacagtgtcgtaccggggaatgctagtacttgttccccattattgattaactgtaaatctttaattttcatgccgttcacaacaactgcagaacggtcataacctggggctggtacggatccctcagtcaaactagtgttggctgcttgcataataatgataatattgttaacatgcaaaacattaagcacacgccacattgccattaaagtggttggaaatacgactgcaactgcatcgcccttacctgagcggtaccctttcctaaaacgtaaagattttgctttgttagtaataacattttttttaccaacaacattgactagttcttcgactaagtccatattaacttctcccctctataacgtttgtaaaaaacgttttaatcattacgctttcaatgatacgcttttttgatgcgtatctggattgaagtcaatatttgagacagattttaagagacattcagaaccgcgtttaccttccacagctcaaataaatcattaattgcgattaataacttatttgaaccctggaaagcattaaatcaggcggccatttggctcgtaagtgttgcaatttcaacttgtaagggggtc

SEQ ID NO: 334 - DNA, 5392 bp, Lactobacillus casei
tttgtcgtaacgagttggcatgtaaaaattccttccttttgagagatgatttattcattataccctctcttaaaagttgtctcaggaatctgctcctatcctagtatttggtacataaatttctgaacagtaaagtaggcgacctttctacaggtcagcaaaaaaaaatatccattcttatttgtttactaaaaacacccgatcttttagtactcgatgaaccaacagtcggattagatgtaaccagtaagagctgtcttactcaatttttagaagctgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcggggattaagcgccatctggcagttgatatcaatggctttccgcaggccattcacatgacgcgagcgaacgtctctgatcgagacggggccagtgccatgatcgctttacatgccatgcatttacgccaggttcaaaatgtcttagttgatggtggttattcaggcgttaattttcagctcgatgtagccagtaatttaaacgcaaccgtgcaggttgcgaagcgcaatgagttgcatcgattcgaagtcatgccccaacgttgggtagtcgaacgatcttttaattggctagagaattgtcggcgactttggaaaaattgtgagcgtcaattaaccaccagtctgcaaatggtcgttttagcgtttttagcactattacttaagagattttagacagcttctaagaagagttcgatcgctgaaaatttaacgatccatatgctctctggaaacgccattatcgcgaaccacccaaaaatccaagaaaatattcgccattaattacccaaacaaaaatttcaaacttgatccacgtcaattctttatcggtcgaaccaccatatactaaagacatcaattaagaaatggatcggggattatgaaatttcaaagatatattaatcaacacacaaatcaaattacattgataacggcaatactgattggcgtaggcttgctggggaaagttgttgacagcgatatggtctacacggtttcattcatcgccgcttcaattatctcagctgtgccgatcgttcttcgggcagtttccgcactccgatttaaaacgatcagcatcgaattacttgtcagtattgctgtgattggcgctttcatcattggtgagtacaatgaatcagcaatcgtcactttcttgttcttatttggaacgtttttggaagacaaaacgttggctaaaacccgccactcaattaaaaacttgacggaaatggcaccgacaacggcgatggttgtggacgatgacggcaatactgaggagactgatgttgactttgtcgacgttgacgacgtcgtcttggtcaaagccggcggtcagattccggttgacggtgaaattgtggatggattcggtcatatcaacgaagccagtattactggtgaatcaaaattagtcactaagggcactggcgatcaggtattctctggcaccatcctagacaacggaacacttaaagttcgggcaaccaaggttggcgacgacaccacgtttggcaaaattgttgaactggttgaggatgctcaagacaccaagtcgccagcagaaaagtttattgacaaatttgcgacttattacactccggcagttttgatcattgcactgattgtgggtttgattaccaaagatttccgattagcgattaccgtcttggttctgggttgccctggggccttggtcatcggcgccccggtttcaaacgtggctggaatcggtaatggtgcgaaaaacggtgtcttgatcaagggcggtgaagtgatgaacacctttgccaatgtcgacacgttggtattcgataagaccgggaccctgactgaagggaaaacggcggttactcagttcaaagattactcaagagaccagttggccttgcaaattgccacagccgttgaaaagcagtcggatcatccattggcacaagcagttgttaaattctcaggtgatcatcatattccgtttgaggacgttcaagttgccgatgctgacacagtcaaaggccgtggcgttaaggcaactgccaacggtaaaaatgttttaattggtaatttgagaatgatgaacgatgaaaatgttgatttgacgtctgaacaacgtcaagacttggaaaacatccaaggcgaaggcagttcaacagttatcgttgccttcgacgggcaaattcaagccattcttggtatctcggatgtgattcgtcaaggcgttaagcaaagcctggcgacactcaagtcactcggcatcaagaagacggttatgctgaccggtgataacctgcagacagccaatgccgttgcagaacaaatcggcattgacgaagtccacgcagaacttttgccggaacaaaaagtcgaatacgttaaacaattccagcaggaaggccacaaggttgcctttgtcggcgacggcatcaacgacagtccgtcattagtgacggctgacatcgggattgccatgggaagtggaaccgacgtggcggttgaaacctctgatgtcgtcttgatgtcatcaggattcaatgaattgatccatgcatatggactttccaaaaaaacggtcatcaacaccaaggagaacattttcatcgccattgcgacggttgtcgccctcctgattggcttgattctcggctttatttacatggccagcggaatgtttgtccatgaagccagtatcctggttgtcatcttcaacgcaatgcgattaattaattatcagccaaaagctgccaaacttgatccagatcaattatcggttggcgaataggatttatcattaaaacagtaaatgagatggaggttatcaatatgagtaaagcaattttacaattagacgcgctgtcatgcccgtcatgcatgcaaaagatcaagggcgcacttgaaaagcaggatggtgtggaaaacgtcaaagtcttgttcaatgcggccaaagtcaaaactgattttgacggcgataaaatttccgcagacaaattgtcagacacggtaactgatttaggctatgaagttcaatcaatgaaagtgaaataggtgaagaatatgacaacagcaacccccgaaaaattatttgaagcagaagttaagcaagcagatatcgaccaccataccccaacggctggtgcgatgaccggccacatcgttgccaatttggaagttttatccaacaaactccagatggcaaaatggtatgtgaagggaatgtcggcccaacagctgaaagtcctattcggcgacttacttaagcaggcgtacgaccaaaaggatgccttgggcacggtcttaatcgatgaggccttaattacgccaagtacccaaaaggaattcacagagtacaccatgctggaagaaaacggccagaacaaatatgaatctgtagagtggctggtcaacgacttcgtccacgactatgacactgagaacatgtttgtcacccgggcaattaagctggctgaaaaagaagaccgtccagtcttggcacaacatttggttggcctgctgcaagataacaaccacaacatcgctactctgcaggccttgcttggtaagacaccacgagaaggcttggatgaggaagacgacgaagattaatcctcaatagatacacgaaaaaagttccgaagcaattttgcttcggaacttttttaatatcattttttcgaattcaaagattcaaacaaatcagcacaataacacaggcaatcgtacttgccaggatccaccagccaacccgataagctgtccgctgataggttgaaatttgttcctgacttaatttgtcaaaatcaggcatcctaagtgagacgttttgaaatatgctagtctgcagcagcgtatagtcttttttgatcagcagctgatagcttgtccacgacaataccagggtcaagccgatgagtgcaacattgattgagacaaatattaacaggacgcagatgatgatcgcactagtcagcattatccgccgagttctcatttttaccactcctcgtattattaaaaatgtattcaagtattgaccagcttcgctgtttggatgctgtgtgatattctctaattgttcattggattcggatccaactggtataggctttcgcctcctgtagtttatctacattttaagaatgccgcccagatgaattgtttaagttcaaaccacaagctgtagtgttagctgatgattttgatagctcgcgttctatcaagcagctagtcattggatgacttgtctactcataaattgcgaggatgttctgaagattcataattagggagtatcacacagcacccaagcctatccaaaataagaacggaaaggaggtctgaatcaatgaacttgaatgttggtattgatgtttcaaaattgaagcttgattattgtggaatggattcaaataagcaagtgtgtttccaaggtgaagtaacaaacaccccgaagggggccggtcatattcgtgatgagattttagacagcttctaagcaagtttcaacgggagctggtagttatccaattgcaatttctgatccaactaaattcttagcaactaaaaaagaacttgcaactattcctgatgttaatgcttcagttcaaaatgttgattttaaaactcaaacttatgctggtcctagattgcaataataaagttaccagctagaaagagacttgctcgctgcttgccagggtgtttgccaatgaagacattttctgggtttgttattgataagcgctgtggctcgttgaatattggcctctgaaacctgatcaaactgtgttcccttcgggaaatagtagcgaagttctcgattgaaccgttcatttgtgccccgttcattcgggtgataggcgtggcaaaagtaaaccggtatccgatagcgctttgtaagcgcctgatcgcaggaaaactctttaccgtgatcaaccgtcactgatcgaaccgg

SEQ ID NO: 335 - DNA, 123506 bp, Lactobacillus casei
ccgccaatgtatgccctttcatttttgcttgtcattcaagaagcggccggttataatcagtatgtactaactagtatatactaaaatattcatatttttacaggcgcctcggttgataagtcgccgcaaaccgtgtcataccacacattgccggcgcatttttactggttgggtaacgaaacgcgacaaaacttaacgaaggaagtggcatcatgttaacatctaccaacgtccccgaagacaagcgctcaccgtttttagcgcttggcattttatcgatttcgtttctgatatcggtcagcaatgccgtgtctggcacgatcccgttaatggaaaaatatttttccgatgtctcccgcgccaacgtggaattgctggtggtgattccaaccgctggcgtcctgctgggaaccgttatcagcggcttggtctccaacttgctgggtaaaaagtatacggtgatcgctggcttgacgatttcgctgattttcggcattattccggcgttcttcttcagctatccggcgatcttgatttcccgcgcgatgtttggcgtcggcatgggcgttttcacgccactgagtgtgtcttacattaccgacctattccctgaagaaacccggaatcgcctgttgggttggcgtaattcggtgggctcgattggtgatgcgatcatgcttttcattgccgggttcttgatcaacatcagctggcacacgacttacttagtcttcctcttcttgctggtgccgattattttagtcatgatgctggtgcctaagcaatatgacaatatcgtggttgaagaaggtggcgaagtcgttgaagaagtggccaaagccaagccaacaaccaacggcggggtcattcaactggcgattattttcctcttcgtttgccttttctactcggcgatcggactgaagctggccagctacatggtcaacaaccacgtcggtacggccgccgacgcaacccgcatcttcggctttttggtcctgtgctcgattgtctccggcgtggcgtttgagaaaattgccaagtggtttggcaagtataccgtggccatcgccgaactgatcgtggccaccaccatgatcgtcatggccttcaccgaatcgattccactgttactggtgctggtactggtgtcaggcttctgcaacggcatcgtccatcctgcattaaccgccagaatggtgcactattcgccaaaagattcgatgaacttcacgacctccattatcatcatcggcatcaacatcggcgggctggtagccccgtacttcttccaattcttcggcggcatggtcggcaacgctggcccaggcaatatgattttatggagcggctttttcttcgtcctcctcgccgcttacgacctgattattgttaaaaaggatgagctaaccatttaaaaaggagggcattttagtgaacgatcaagtgaaatggttcaaagacgccaagtatggcatgatgatccactgggggctgtactcgttgctggctggggaataccgcggcgaatcatcgagtgtctacgccgaatggattcaatccaagttccaaattcctaacgccgaatacgagcaactggccacggcgttcaatcccatctacttcgatgcggataagattgtttcgttagcaaaaaagtgcggcatgcaatacctggtggtcaccaccaaacatcacgatggttttgccatgtatcactcccaagtcgatgcgtacaacgtctatgacgccaccccgttccaccgcgacgtcatcggcgagctagcagaagcctgccgcaacgctgggctgaagttcggcctctactactcgcaggacctcgactggcacgaaccagacggcggcggctacaaatccaaccatgttgaaacagctggaacgacttgggataacagctgggacttcccggatgaaaagcagaaaaattttgatcgctgttttgaccgcaaaattctgccgcaaattaaagaaattatgaccaactacggcgacatcgccacagcttggttcgatgtgccgatgacgctgtcggaagcgcaaagccaaatgatttacgacacggttcgcgacctgcagccaaactgcctcatcaactcgcgcctaggcaacggcaaatacgactatgtctcgctcggtgacaacgaaattcctaaacacaaggaagacatgaccaaaaccgatgtggacttcaatgacctatccgggttcaagccatcaccactgggcttgtacgaaactgccggcaccatcaatgattcgtggggattttcatatcacgatcaaaattggaaaacaccgcgcacgctcttccgctataagcagcacctcaacgacttcggcatcaactacctgctcaatatcggcctcgatccgctgggccgggtgccgatgatggccgaggagaatttactggcggctaaagcgttggaagatgtggctgacgttcaggaggccagggtggcatcggtggtttgatgttgcaaagttaaatctaggtaaagtcggcttttgaaatgtaaagttaagcccccattcgtcatggttattggcggatgggggttttggtttgcggggttgtaaggctccaggcaggtggtacaaagggcatcgggtcggctgttgcgtaatctatgattaagcaagttggaacaactagattttcctagccaacgcttaccttccagttgtcttactgctcactcgcacttttaagtttcaaacgtgatccgcgtttgaaactatggtaaaatcaccctaagaggtgaaaatcgatgacaaatccgcacttaagcttcctgagaatcgacattttggaccacccactgtttgcacagaagacgtctttttccttaaccgccagccaacgcgttccgaatgatgcccacgacgatatgacacatttatttggatcaatctggattaacaatctgacaacattgatcggtcgcaatgcctcagggaaaaccttgaccatgaaacttgtcatgggaatcctggatcttttgctacaccaaaagtcgatcggccaaacccacctaaatgaaacgttaatgggtagccaaccgatttcttttagcgtctatttttacggtagtgaccatttcctttatcgggacgacctcacaattgcgcctgttccagaccaagcgaagcaatggcaagttaaagacgaaagaatctgggccaagaaggtacaaaaatcaatgacgcgaaaatcgattttcgacttttcaaatgcagagctattaatggatcgactgcaattagacacttttcagcaaagcctgctggcagctgatgattctttcatgcggtcgttaattgcccagcatcattatcagacacaaaaggtttttgatactttcatgttcacaaacgccaatctgccattcttccctagcagcaatggccaagttcctgacgcgatcctggcttaccttgatccgaccatcgactatctcttcatcgaaaccaacaaacatggcaaagctttttaccgcttaaagttcaagcaagacgatcaagaaattaccgacaacaatttcgccacgattgagtactatctttcttcaggtactgtcaaaggcatcacgctttaccgttatgtcgttcaggcattgcaaagcgggggactcatctttgtcgatgaactcgaaaatcattttaatttggcgattgtccatacatttatggaatattttgccaaccccaagattaatcagcatcacgccacgctcgtcttcagcacccacaatgctgatttgctgaacgacttgtctcgcggcgaccaaatcttcattactagacgtcgacaaggcaagataacccttggccgctattcaaagatcgcggatcgtcaggacatcaaccgcgctgaagtcttcatgtcagactatctcggcgggactgccccggactacgcgacttatctcaagttacgcagtcagacgattgatttgaatcagcaacccgcctcaggcaagcttcttcagtaaaaactgatccatcaattgatgttgcgccgtcaccagcggaccgggcagcgaagcgaacccgaactcctggtaaacatgaaccgcagttttaagtgtgtgataggtctccagataaaccgactggtagccgacctgctgcgcgtaatccaaggcgtggcgcaatagccttttgccgatgccatgtccttgcaaatcaccatgcacatagaacttctgcaattcggcaacgccatgggtcggatcatattcggcgatgccgacaccacccagaactcgtccatcttgggtcgcaacaaaataattccggtttggtgctgcaccatagaattggctcaagtgatccagtcccgcgtcaaaataaaccgttcccggtcgatccaagtcagcggctttcaaacattcacgaatcagtgctgcaaccggtgcatcatctgctgcagtcatgggccgaataacttcttcatgggttggtgttgacatgcgcatccctgctttcaaaagagtttaaccaaaatcatagtattttttcagctaattgcaagggtagcgttgaatgtttcacgggaaacaattattagttgctactatacgctgtcattttccatttaggtttgtccttttacctgttaaagccgcctattttttcctcagcctttttggttatctttcgaatatttacagtacgactttttcttttgtaaatatttacatttgttgttataatgagcctaaacttaaagtttgtctcatccgtgttaacccagaaaggaagttgctaatgaacaaccccagcactttaaaactcattcaaaaatggctgaccgataaccaaaagacccaggcttggttagctggccaacttaacatgtccgctgcccttttaagccaagttatgaatggtaatcgaaagttgcagacaaaatatatcattgctatttccgatatcactcagatccctttggaacaactagttggcaccaaagcaaatgataatcatcaaccgcagattgccttaaggggtaggttgtcgaccgatactgccaaaaaacaaattgatcaactgcttttggatatacagcattgcgtcgacttagaggaaacaattcatgcaaagtaattcattgacttccactttcttgtcagaatcggtagcagaagatttagctgagacttttttgattaattactttggctctgatttttttattagcgcggatatcgaacgtgttctcgctgaacaagtgaatatcgtctatcaagatgtcgacgattctaactattccggggctgccatttcgtataagggcgttcattttattgctttaaatacccatcagacattacgcaaccgctattacagcgccgcccatgaactctggcatttagttgtgggcagtgacttatttagcattgaccacaccaagtatcagaaactgattagcttgcctgaatttaacacggaacgtgcagccgatcattttgccgccgcaatcatgatgccgcgggacgttatgattagaacttggaacaggtatattcaaaaccaaacttcgccaaatattgatatggtaacagatgctatcatccgaattgccaatgtgtccgcgatgccctacgcagctgtcacgcggcggttatcagagcttgatttattggctaacaaaaaagtggcaaggctaaccgacaaagaatggcaagacttagtcactaaatccacttttccgcctagcccattagataaaattgagccttttaaaaaattttctcgcctgacgaatatcgttgatcagctcgtgcagcagaagcagttatccttattagaggctgctcagctaaccacctatgcagacccccacactgcagctcaatatttaaataaacggcaggaactggtcaaccatcttgaggcgggtgaataaatctgaaccgatacaaagaacgtgtctttattgatacaaacatgttgctctttgctgctcagtataacaaagaaaatattttctcgtggttcaacaaattatatggcaacatttggatccatatagacgtgcttgacgaaatgttgcttaagcgacaacgcgtcgaggccgaaattcaggctggtcgctggcgcctttttgaccctctgactaatttttcgagcgcagaacgtttcatttacaatgcgcaagtagaagaaaccaaagaagcttttgcgcgcctcaacagcaatcgtgccgcctctggtaaacgcgtgaaaagcacagccaataccggagaaatctcaacattggctatgtgtctgattgaagatgcacatttaatatgcagtaatgactttgatattcgcgatgttgtttacagcgaaaactacacttatattgacgacgatggtgagcatttaatcgttcaagacaccgccgaggacttttgttttctgtgtgtcgctgaaagcgatatcacgaaagcccaagtgcggcacttttacaagacgctttttgaatgccctgacatcagaaatgcgaaattagcctctctagataaacgtctggttctcttgtaggagcgttgaaaaaggaacaacctgtttatctaatatcacagataaatagccgcgcttaaacagatatcttttttgtcagttccttcttaagcgcagcaaggtgttcgtcgataggcgcggttccaccaatataattcgatttgaacacttcgctcttttttagatccccgcgaatatcaagatcactgtatctataaacacgggttcgttgtttttttgccaaaatatagttttcatctttgcgcacggaatcatcaatcaattcaagatattgcgttgaatagactaacgacgcttcggcaatattaatcctcgaattctggaagaatgcgataaagtcctcgataatgcgcttgttaatgtgtagttcaacctcatctatgagcaaagtcgcaccagctctgagcgccttgaacatctgataaaacaacgtgattcctcgaatcgttcctgaagaaagataatgcatgatgtcctgaaaggtagatgcaacgtaagaatccttctgacccttgaactttaaccgaacatcaatcaatttatgcgtttctttgtcggttcgacaatccaagtattcaattgattcatctaaatactgaatcaggctcgtcggcgccatatcaataaatgttatgatccgacttgcatccacttcgtcgactattgagaaaacccttgaaacactttcgtctcctttgtacgcgcgaaacgaggagtctttggagctcagcattttcttaacttccacacgtaaatcagaacgtctttgtaccaattgcgaaggtttaaagttaaattgatctttttttcgcgccaaagtacccagctgttttctgtatatctcctcattggcgacgacccacttgccatccttatcttgcctaaaaatggtctgcacttgatagcgaacgccatgggtattagcaatattagcgaccacttttatgtcgcctttgccgcgtagactatcctgcaacaccgtttggtcgatcgactggtcctccaaatagaaagcattcaatccatcaaacaaattgaagagtgtggtcttcccagaagcattcaacccaacaacaccgatcgtcctgttgagatacaaagcgtaaccataatcgataacccgcttagcagtcgcttcattgttttgtccggttgcttggatcgaaaacttcgtaccgtcttcaaacaacgcatgtcccgatatttcaaaatcaatgagcttgatcatagcatccctccttattggcagttgttacgttgataacaaaactataaaggagtttttagattgtgtacagtaacagcaagcatgttgaaaacggaacgatcgctattgctgatggttccaaattgaatggtggcatcatctaggagcgctaatcctgcttatgtacagattctcctctctttttggacgtggacgcctcttgtccagattcctcaaccggaatgccagcttttctagctatctttgcccgccgcgcttgtgccttaacttcctctcgctgggccttaagtcgtgccttttgcactcgccgatccatccgcagttggtgtttttgcagatccaaggcctgttctgcagctttggcagccattttttgttcatgttctttagcttcttgggctaacttttgtcgtcttgccaaatcgtgtctggctgcttcttgggtatcttcatcaatttcttgttgccgttcacgctcttttgccgcttgtttggccgcatcggcctggcgttcttgttgccgctcttgctctttgtccgcctgcttctgcgccttcttcttcaactcaagctgttgcgctgccgctttgtcagcatcttcttgttcgtgatgctcggcatggtggttgtcttttcccttggcgtgttgcgctttttgctgcatcaaaaatgttgcccactgttccctgcgtaatgcccgtaattgctcgacatcaatgcgcccaccaggcgtgcgcggtgctgcagtttcgacaccgtttcctactacccgatcgagccaaggcagaaccgggcgggatccattattggctgggcgcgtggtggtgttacctgtttccggcgcagcttgatcggcaatcattttccgaaaagcggccatcttttcacgcggcagtttcaaatagtccgcccgctgtgacggggtcaactgcgcgacatcgtacatttgttggcgatcacggctgctaagtaacagataaacaagcggatacggcaagtaaaaccacatcacaaaatgtgggaagaaataagccaacccgatcaagataaaattaaacagcgtataaatgcgattatgatccccaaaaattttgccataaacttgccgcatatccgaggccgcggtgtattggaagtggatgatggcgcgcgccaaaagccgaaaagagaacgacacaactgccagcaagaccccgtatgccatcactgtcacctgcgtcgtgttgctcgccatcatgttggttgccagcggcgtcagcgataacagaattaggaaaagaaaatcgtacaacatgatgcggtaactcatgtcgtcgatttcgttaaacagggtgctgtgctggtaccacatattcgccacaaaagcataactaatcaaatacaccccaagctccttgcacaacaccaaatagttcgcccagttatccttcatcaccggcgtcagatccagcaccataatggtcagaataatggcaatcactgcgtcactgaatgcatcaagacggaccttcaactttttcatttcgaaccgtgctccttagtttctgccgggacgataacgtttactgctgttgtcagatacgccattaacttcagcattcttgtcctgttagcttcccaacttgctattaatttgtttattaagcatttcaccgttatttatatgcttatcgggagcagactgcaaactttgttgtgaatatgggttttatgctgctggttaggttgacattttggcatctctcgggcaccgagaatcagtatctatctattgttttcagcgattatctgccttaagctcgatttatgctaataaacgcagctgaaggaaggctggcaagtatgggtgtagcgcctttaacaactaagggtaagtggcttcagggtggtttattcgcagtggctaaccttatttcattgttgccactgcttgtttttgcaacgctatatcacggccaatcgcccacagcttacttgccttatattttcttctacaccggaacgaaaaccggtctattgctggtaaacggcttaggtgatgtccagaatgcttatcgtttggcccgcaattgtttatggctgtgtactgcagcattgattttgctcagtgtattctcacaggcagtcattcaagatacggcagctttcgtcctcggctgtggtgccagtgcctttttgccagcatatcaggctgtttattaccatgagcggcgtgtctggcattggaattttgccgcgattgaaatgctaggattcgttctttatggcatcgtaacgttgggcctaatcctgtggagcggacagttaacaatgcgcgtaggcttctgggtattattggcatttgtggttggtggcttgttgttcttgatacgcttgccccaattcgcaaagtccccgcagacaccaacctttgttgcaaagacatcctcaagaactgacttagaacttttcttttggctgaccgcgattgtcttttgtctgcgttttacccgtttctttgctaattcgctcggcatcgtcttgatggtcgtgttcacgttggggtttttcctctttattttgcgcattgcccttcaccatcaaattcgaatcgactttccatggtggctcattcaaagttcgttcatcaacggtgtctatgaaacctttgccatgttatacattctatttgccatccataaccaaaaattgatggtgggtgcttatatcgcctatgggcttggactcatattggcacaaattgtgcggcaagctattcaaaacaaattccgccatattgcaaatttacagttacaattaattggcttcatgctaggtggttggctcatgatcatccccagtatctccgcagccggctttttcctgatcggatttattggcagcgccaacagtattttgcttaaccaccaagtttacagattcaacatatcgaccccggctaaccgtttggctgttaagtatcgaaatgcttatttagggagcattctgctgcaagcgatgctggttttcgggggcctaattgccgctcttttatcccacactgacttgactcgcctttttgaccaagccaatgcgcattcatcaatcgtgatcagtgactcgttagttcagcttgttagtcttggtatcgtggtgattttgaccatcgtgacgtttgtgttgggaaggaggctgccgcggattaatgagcgaaaacttttgtaatttgcatttgtccttcccaaatgataggtatgtttctagcccattatcggatcatgtcatggcttataattaagtttcctcgtcgacacctttctagtgttttatcaattccttagtgtgaaataaacctgccaaaacgctgcaaaacatcgtccaagattgcgctattggctcgattatttaccttctcatttttccaaacaagtcggttcacggaaagctgtttgcgggctctatcaaatcgaagatcaaccgtgccgacaatatcaccataaatcaggatgggtagtgcaaaatagccgagcttccgatcaacagctggcgtataactttctaacttatagttgatgccaaataatcgcaacgttctagctctgtcacgaatgagattgtcgaaaggcgtcaacaaaatggcgatgttcggcaagatatcgttgtgatgaaaggcatctagatcagataccaagatgtaatggtcttgtccttcaaccgtgatgttcgttatctgcttttctttgagcaactcgtcaaaaacactatcgaataaacgctttcgaaaatgcgctccgttaaatacgtcggttttagtggctaccccaagattattgaatgttaacagaagtaagtccgcatatacctgtttttccagttcgttaacatcagcgggcgaatcgtcgaagtcatccttagcggcgatcaatattttccgaaacgagcggtcccgctggatatcgatgagtcccgcgcgccaaagtttgtcgattgcgttgtcttctttagacatttcccactgcggtaaattgtgattggtgacaaagtcctttttataaaccctgccgacttgaattagctggcgatatatctttatgtaatcggggtaattgacatcgttctgaagcttagctaagttcattcggtgcagatttctcactaattgcgaatctttcgtcatcaatgaaagagcatttaaataaatctcgaccacatcacccttggtatatgcatcgacatagcttgtattccgataattcgtaaaccgggaccacaaaaagatgtcctggcttctggcgttggtgacattgatgctgtcaagttgaatgtagccgattttccctagcaacgtgaaaagtgctggctgcgaaaaaggcttcacctcagtaaccgccaactgctgcttgaatagttgaaatcgtttgacgcgttcattcgtatacatatagatcccctaacaacttgcgtagcgactgccacagaccgcctctagtgaagtgaaaaaaggcccggctaccatcaagatgaccacaaatagcttggcactgcttcatcggcctcagttaaagttaagtgtactaaaaaagcccgagcatcacatcacttttgctccagtggtatgtggtgtcggggcaggtgtactgttgatctacgggtggtgcttaactgacgtagcttttactaagcagaaaacgcattacagcggttttttccaatgaggtgtagcgttcgccaagtttatggtaaatgttgccgaagccctaatcctatacgcaacgcgatattcggacttttgatacgttcaatatcagagaccgattcgtttctccaactttttacgagaaagagccagcgtatcatcatcgtcagctaaactacctagtgattccgaaatggcgcgtttttgacgatcaaactcactaactaattcgctgccagttaagccttgggcaactaggaatttaagaatatctgtcgaaaaatcaagaaagtcgtctccaccgtcaacaaaccggtagaaaattccgttagcttttaactccggcataaccttttgtccaggtacaatattgaattctttcggaactgttaatatgagggagttcccctgtttacgcgttttagtttgcattgcttttctcctgtaattactatgctattagcacggtgaatatgactcagtataggggtgttccaatgcagtccgcgctgtgttcgctcatcttttttcgctagcaactgatcaatcaaactgcgtctcccagtattcagccacgtgcgccgcaaacgccatagcaatatcagcaggaaggttgcgttgcaacgatagcggcagtgccagcgcttcttcacgactgaaagttttgacattttcagtttcaattcctgtctttaatgcgttcgttacgggttcgcaagcaatgaaaaacttgtacacgtcacgggtgctctgcggcgcatagtcgcgtttgcggactgaatagaccgccagaagctgagtgggtttaaccgtcaagcctgcctcttcgcgtgtttctttaaccgcaatttcactggcactatagcccaaatcagcccagccaccgggaatggaccacgtttctccggcccgctcctgaaccattaaaaggcgatcatcgataaacgtgacggcccgcacatcgactttaggcgttacgtagccaatatcctgatccacaaacaatcgtgcttgttcgggagttgcatcccctaacaacatcaccagctgcttggtgatcgctgccaactgatcgtagcgttcgcgatcaaaaacatcttttgtataatagcatccagactgtgcgatcgcttgcagctgcgcgattaacagattcagatccttcgttgccatccctatcacctcacttaccattgtaattgatgatatttcatgactaacgtatttagtgatgaatttaagcaaagttgaaggcgttgcttttcgatgacaagcacggtatccgaatcgttaaaaacgggttccactatgaatttgaacctgttataataaatgtgtaagcaaagagcgccttgctctaacaagacgccccttgtggtacagcagaaccgttaaaagtacggtgactataacgcaactaaaagccgcgactcgtcaaagttaacgcggcttttagtctgcctacttttctcggaattttccgagcgcttgcttcagctcgtaaactgcatgacacagtttcttcaaagccttgatcaaacgtgtgaacacgttgaccatgacaatggccgagccgaggccagccgtgattgccgcaaaggcgtcaatcacagacgacaaactggcacctcctttcgttggaatgtggttcgatagtcctaaaaccatcggcatcaccttctttcgattgcgaagcgccaccgcttatttaactttctgcttagtcatagcttatcagatgctacgcccgcgaccaatcatatcgtgggttttttaatttccatagagtgccattgttctacagacagacactccgcaaacaaatctcaatattaatcaatcgtcgttcatgaatggcgattagaaataaacaagtaaattccttccacaagggcgattactaatatcacaacccctataactgccagtgacgctaaacgtgactgcaacgtctccacatgacctgtcccatcaacttgacgcaccaggactgtgatggttagaccgactatcgcaatcgccaagataccgtttactagccaaagtactttacgtttcaatttgcctacctccgtttgaattttgttacgagaaggtgtcctgctgatgacaaagcttttctcacaactggaaataacaaagtgaccgctgtcgccatgtaaacaacttgcagactgaaggccatgtcaaaaatatttacccatgcaacacccaccaacccaagcgccaacatgccacagaatcccttcaggtaataaaagtttagccaatcacgccagcgtcccactaacaaacaggccagtataactagaacaaaatctgtaaaaattaacattcccggcagtgctgctaagctaagccgaccaacaaccataatggcgaacgctgaccacagaaatgtcatggtatgtttctgtgtttttgggggttctgaaggttgtccaattagttcatcaaccgttatctgataccacgttgctagctgacaaattgtctgcaagtctggttgatgccgcccagtctcccaagttgatacagttttacgagaaacgaaaagttgctcagcgacctgtgcttgtgttagctttcgttccattcgtaattgttttaaatgttcgcctaaagacaaagcagccattgctatttcctcctccaacttatacctgtccacttgaattaatctagctactcttactagcatgcctggtatttcaaggccttaaattttaaaagatacatttttgattgaacgatgatgtctatgtgaccatagtatataggtttcaaccaatttatcatatggtaactctgacataccctgacattatgtttgagcctctaaacaagcaacggaccgccacctcatttgagatgccggcccgttgatctaacgtcactaatgttacaacctattattcatgcttatgcttccgcaacttaacgtaccccagcaacccaattaacgcagctcccaaaacagccaagactgactgcgtttgctcgcccgttttaggaatggtgtttgtatcgttcgtttctttccgggattccggtgttttgccggattgcgttggctgccccccttggaatccgccgcctggggttggtttcggtgtaggcgttgccggatcctttttgcctggattcggtgcaggcgctggcggcgttgtcggatcttttttgtctggctctggcgccgctttcacaaggtgatcgatcgcggttttaaggtcagcgactgccttggcaacttgtgcttccgttgcttcagggtctttttgaacggtgcgcgcttgcgctaaagcagcttgcacgtcgttaaagcttgcctctgtgtaggcgtcttttttgagtccagctgcttgggtgatcagcttgaccagttcggttttatccggcagtttgacgagctgttgaagtgccgtcaaaacagcattggtttgttccgcgactgctgcctgcgtggcgttcaggtcggttaaaagtgggcgcgccgttttcaatgcagcttgcagtttcgcgtaagaactggcggtgtacgcgctcgcgcttaacttgtcagctgttgcaatgaccgcctccagcgactgcttgttggcgcgtggcaccagcgcgtcaatcgcggcctttaactgatccacggctgcctgttgtgcagcggtggatgcgtttggatctgccgcgacctttttgccagcggtgatggcatcggttagtttggcatagctggcaggtgtatagtcgtctgctttaagcgctgccgcaacctgaagccactgcgtcaaatcggtgactggtgttggctgcggtttgagttcaagtgccacccaagcggcggtgatcgcctgaatggccgactgaatttgcacttgggtcgcgtgttcgtcagcgttgactggcttagccgcagcaaccgcagccagcaatttagcgaaactgtcctccgtataggcgtctggtttcaaagcttccgctgcgttgatgagaccctttaactgtgcctgggtcacgccgcgatcagcttccagttgttgcaaggccttttgcagatcggtatatgccttcgtgagagcttcgatggaagcagtgtcatctttcactaactgtgcagccgagtcactggcggttgcgactgcctgccagctggtagcggtgaacagcttaggatccaaggcatgaaccgcgtccaacagcgccattagcttagtcttagcctgcgcctgttcgcttgcagactgttgcacggtcacaggtgaagggtcttgcggcaatgcttccggcccccactgattggtcaacatcaggtcacgtagcgcaaactgcaagtcagctttggtcatctgggttttggttttcagcgtgatcgttgccagtttctgatcaccgtacaagcgtggttgttggccttcattggcaaaaatcagataaatatcccggctgttatcgccgtgggtccggattttgctgaagttgaccatgttggcggtcgctttagtcggttcgactttgaccaagtccacattcggattggtcaacggcaggcgggcaaataggctgttcaccttgtctagatgattgccgactaaggataacgtgatggtatcgcctggtacataagtcggtttgtcagtctgcaaggccaatgtgccagcaggcgtcgtttcgtccggtttggtcaccggctgcttacccagcttggtcataacatagttgatatcgaacgcatcgatcaccccattgcggttcaggtcgccattttggacatagccgttaaaatcgctgtcgatattggcagttaatccggcgtagttcatcaatgacgttttatcatcatcattcacctgaccgtcattggtaatatcgccaagcgtggccttgttggtgccatcgcgtttgaaaagcagaagttcccgaccggagacaaaatcgccgactgttgacttttccggaataacaaaacggacatacttggctttttctttctcgctaaaattaatggttttgtcggtactatcccatttccagcccttgccttcaccggcctgatgccaatgaatgccgtccaaactggtttcaacggttaacgctgacagattgccgttaccgccgttttcgcgggggacataggtcacgtgatccaaatcatacacgccatccaattcggtggtgatcgtcatcggtgtcggcgactgttttggcgtgtccgagaaccaattgctgtgcgccatggtgtctagatcctggtcaaaaagattatcaacggtatcgtcaccctgccaaaccggggcgtccttgatcggcgaggtcactttcggattgtgcattttcacggctaggcgcatcggattttctttggaactaaaggtctgctcgatgctccactttgaaacggccttggtcgtgacggtccgtacctggaacgtgtgcttcgagttgtctttgacctgatccagcacaaacgccggcttattcagattgcgataaatgacgccgtccgctttcacatcgtagcttgccgcgtctttaactggactccagttaataccgatagctgtttccgtggtggttttatcgtcttgtttcacgtcggtcggtacaggaacctggtcactttccggcaggtcgccagtcgttggatcgtcagtggcgtcgatacctgacacggttaacttgatcgcattggttttcacattggttttgtccagcttaacctgcaggaaattttgatcaatctgcttgtcggccaacttctccaagtaggtattcgtgtgatactgcttgttgacaaaatacacattgctgccggcttcatagtcttgaagattatcaactgcctttagcgtgaccgccttgccgccaaccattgcggttacttttttcggctggccgctggtgcgaatggcaaactcgctggtgcgttccggatccagcccgctgtaatcaccagtcaacggatcaacggtcacttccagctgatctttttgcagctcgcttgtgattttggtttgggcgtgggcaccttttaggtatttttgcgaaatcccgtcgtcttcgtaaacggtaaaatcattcttgccagctgccgggaaaatctgaaattgccgcttggtttgatcaaacgcttttggcgtattgtgcgccggtgttgtcgggatcacggccccttttttgacgaagaccggcaacttccagatcggggcgtcaaaattgtttaacacttgcccgccgcggtattccttgccggtgtaataatcgacccaaacctgatttttatccggcagataaatgccattgcggacatcgtttcctttatcgtcggcggccgtattttggtaaatcggcgccaccaagaagttgtcgccccacaggtattcatacttcaccaaatccgtgtaggcctcaggaatttccggatagtccaggaataagccgcggaccattggcttgccgtcgaaaacgctttgcgccgaagccgtgtaattgtacggcatcaacatcgttttctgcttgttataagcccgattgatggcggttgtctggtcatcaaacgaaaatggcgtcttgggattactgccccagccgtccatgttcagctgaatcggggtgaacgccttccactgaaaatcgcgggcgttgacaatcggattgccgccgccaaaaatgccgtccatatccgatccgacatacggctggccggataagctggtgccgatgtacgttggaatgtggaagcgaatatattcccactggcccccagtttgatcaccggtccaaatgccggcgtagcgctgggtgccggcccaaccgtccaaggtaatggcaaacggtcgcaaatcgtcgcctttgactttggtcagcatctggttagccttttccaagccatccaacccaaacgaatagccggagccgacccaggcaacatccgttttcaacgctttgacgccattcgccacttctttggcaaagtcgcggtcatccggttttggatgtgcgggatccaccggtgacagattttgctgggtccataagccggttgcgacgccatgtttgtcggcataatcggcaaattccttgaggttggccagattacccgccaatgaatcggtttgcccatagccggccccgtagccatcattcggcaaaagccagcccaatggcatgtcattcttggcatatcggtcaatcacggcccgggcgctgaattggtaattgttcaactcgccattcagtgattccttgatgccactttggccagccggtactttccctggctgatactctttataatacttgccatcttcaaacttaatcgcacccggcgtatcggcactgaccggcacccaggtatcgcgattgtaggcattcagatgcgcctcataaaagccataccgcggcatcatcgctggcgcacccgtgagatcataatagtctttcaacaaatcagccggcttggcatcaaagaagtacacggcatcgaagcgctcttcttgatgcgtggtcttaacctggccatccccagccgcatcaaaatcataagtccccggcgtaaaggtgttgcgcaccaccccataaccggctgtggaccagtaaaacggattaggcgacgccaccccgccgtccacccagttgttggtgttttggattttgatctttttgccggtcaaggtgaaattgccgttttgcgtaccgccgccaaagaaatgatcctggccgctacgcttcaagacctgcgtcgtgtgatcggccgtcatttccagtggctgctgttcggccagcaccactttattgccttgcaaaacctgtaacgtcgcggcggccttatcaaaggcaatcgtgatcgccttggtttgaacctgccagcccttcgctgcattcgctaactgagcagcgtcaaacggcttggtggccgaggtatcgacagttttggtgaaaatttttgcattcagcccatcgccagattgcgccggcgcatcaaacttgccagacggatcagcataaaagcgaaattgattgtccgccaaaatgaataaccgcgccttgagattgttcgagtaagtaatttcaaaatagtgtgcttgtttcgtgacactgacaatttgcaggttgctcgtagctgccttggcagtcgccttgctagtgccaggatccgccttaaccgccgacactggaatggtgctggtgtagtaaatggccgtggctgtaagtgataaaaccgcgctgctgtaaagtaatgaacgtggaacccgacattgccgcttctttaacccttggtgcatcgagaaactccccctcaacgtttgcataaccctcgcgcaacattttatttaggtggttggtaccacctgagcgaattgtaaccgcattcatgagttactttcaactggaaagttctttcgatgagaaggaaaaatcggtttcctaaagtatttttctgaaaatataaatgtatttatcgggagtttgtcgcaacactcgttatatatcaagcgacttcagctaggagcggcgtccaagaaaatgtccctgaacttttttgattataatttttatattcatgagagccagactcatttcattcacggaagttaagctttggcatctgaacgcacaaaaagaacgcgcagattaaatgtctacgcgttcttctttgatgcacatatcaacacggttacaaaagctacttttggaaccatatcttaactaccgcattattttgcttgatgtgccaagtgccgtgctgcgaggccaacaatgcctgtcagtacgatcatagcgccgacaatgccaaccaatgcgttgaccgcttcgctggtttgtggcaaacgatggttgttgttgccgccattgtcattacctgtcacattaggtagttgtgggccgttgccgccgttaccaccattaccaccgttgccgttgttgttgtcattgataccggtgcctggggtgacggcgccggaagcactggaactgccattgccgctagcacttggggcaactgagctgctttcgctggaacttgcttttgagcttggttcgttcgagctgctgcttgagcttgcgctggaacttggtacgttcgagttgctgctctcactggcacttgagctagagcttggtacgttggagctgctgctttcactggaagttgagctggaacttggtacattcgagctgctgctctcgctggaagctgagctggaacttggtacatttgaaccgctgctctcgctagaagctgagctggaacttggtacgttcgagctgctgctttcactggaagctgagctggaacttggtacattcgaactgctgctttcactggaagctgagctggaacttggtacattcgaactgctggagttactgccactgccaccggtgcttggcagaacaccttccttttcataaacgaaggtgactgtttgtggatcgctagtgaacttacctgtaggctgcccggttactgacttaaacttgtagccttcaaactgcttctgcgttgcggtataagtttcaccaacattaccactcaaggtaacatccgatgccaacttggtcccgtcagttgtttcataagaaaccgtgacatttccgcctttaacaggagctggctcggcaaccgtcacatgcgcggtcttggaaatggtaacaccgccgagcgtgtaactatatttaacggcataagtacctggtttgctagtatcaactttgccatcagtcttgatctgagatgagatgtcgctgttgtccttcggtgaaactgctgatacaagattatctttaggattccaagtgctgccttctttaatcgttgtatctttggtatcaatcacttgatggatttcaacgtagcaatcagtcttaggaatactgatcggcttaccattttcatcaacaatctgaaccttggtgtcagacacggtatcatacagatagctcttcacgaactgaccatccgcaccaacgtcaacggaaagtccctgatccttgatcgcgttcatgatccgcgtcaaatcaagtttgataaggccacccttgtaaacagtgccggttttatccggttgatcaagcagattcgaaaagttatacgcggtgaaatctgcattaggggttgtcgttggcatcaatttctgaattgagtcaggtaaagcggtatattgtgtagccgaatctctcttggctgcaaagtatccggtaaagttcatatcgtaaggttcagagaagcgagtcgttgttgttgaaccccatcccttgtcgccaaacgccaaggtctgaacgaacaaagtcgaacgattgtagtcgcctgcgccaatcgttttatctgtggtattgctcaacgtaagcggcatggtcatggtaattttgctattagctggcaaatcacccatgacttgaacggcgatcaattggctccacttatactgactcagaaaatcgctttgtgaatcatacacgccaggcttgccactatagagaaccttcaagcccgctttagccatgtcctgactaaaggtcggtgcggctgcaacgttggcttcaatattgtttgggtcgacacccttaaaatcaggtgtttcgaaaataacattgatattctcagctgttgaattgctgttcttcaacgtgctgatttcatccactttgctcaaatccgtaaagtttgtgattgagtttgagttagtggatacaggtgttatcacactcgtaccattcttataagttgtctggaactgagtgctaaacgccacaccatttcgctcattcgaagaattatcattggtaggattcggtattagattggtaacactgttgtcctgcgttgtcttcaattgagtggcaacatgatcagagccggaaccagtactgctattgcttgccgcattcgacacgctggttccaggcacacataacaacgcaatggttgtcatgcataaaacagctgcgctataaacatatagcttggcctgtttccacatttgtatcccctccatatggtaacaactgatcgtttcctgacaaaactggttggccacttatcaacacaacccatttggcaggaagcgcataaatcttgaatccacatttagtatacatctaaataattatattacaatatcatttaatttattttacataaaaaggacgttggtctctaaaatatggcgtaaaaacaggcctttttatttttgacgcatctacttacaaattgttaagagaacaacaagagacaactttttcgccactttttgtcgtccgatttggttcaccatgttcacggaatcgtcgtgctagcataattgtccaggcctccataaagcgctaataaaataacacatagccaatctaagacttcatggttttacaattcattaacgccaacaacgttatcttaaaccgacgaaaaaaaacgtcatccaacttagagcggatgacgttcaaagaatcagtttatactaattatttttgactattttgatgatgctcatcaatgagttgttgttgcaaagttgccagcttaggtgtcaggtagactgggtaaagatcaggattgacgagccgctgtgtggcttcaggcagctgagctaattcttgacgagcgtatttttgaatcgcaaagacatcagttgttactgacaattcttttccaggattaaaagctggtttcagaagtggacgggcggagaagtcgctcagagtaacctgcggatgggttgccagtggattggcattgactgccgcaatggtttctggcagggtttcatcggctaaggcaatgacatcggcaaaggcttgcttgctgttgtgatgatacaaccgataaacctgcttgtggctcggtaaggtcgttttttcgcgactggcgctgactttgatcttcggcaaccattggccatttgcttgcaaagcagccattttataaacgccgctcagaaccggtgacgaggcactcgtgatgagattctcaccaattccgaagttgtcgataggcgcgccttcttttagcaaggactgcaccaccgtttcgtctagggcattagaggctgtgattttggcatccgggaagccggcagcgtctaacatctggcgcgcttgcttggcgagctgggtgatatcgccggagtcaatgcgaatgcccaccggatgatgaccggccgcttttagctccttgaagaccgtaatggcgttgggcacgccggactttaggacatcatacgtatcgaccagtaaggcgctgttgtctggatagacttttgcccaggcgcgaaacgcactcagttcatctgggaaagcctcgacccagctgtgggccatcgttccggcagccggaatgttgaattgctgggcagacaacacattggaggtactgctgcacccgccgataacggccgcgcgcgcgccgtagaccgatgcatcagggccttgcgcccgccgcgcaccgaattccatgactggccggccttctgcggcagccgtgatccgccgcgctttggtggcgatcaacgactgatgattgacaatgttcagcagtaatgtttccagtagttgaacctgcatcagcggtccctgaacggttaatagcggctcacgcggaaagaccggtgtgccttcaggtaaagccagaaccttgcagtctaggcgcatatttttcaagtagtctaaaaaggtctcggaataaagtttcagcgaccgcaagtagctgatatctgcatcctcgaagtgaaagttgtgcaacgcctcaacgacctgttgcaagccggccgcgataacgaagctgccatgatccggaacggtgcggaagaaaagatcaaaaaccgcttgatcctcgtgcggcaaggcagcacaatacccgttcgccatcgaaaattcgtaaagatctgtcaacattgccggattcatattcataatttaataagccttcttttgattcgtgagcgattttaatcagtaacagtagcaccaagcacatgagcaaaatgatccaatgcccattcctgcccagctggcgttaacgccgccacaccatttttatgcactaccatttggtaattgaggttgtaggcatcaactgccgtgtgcaggacacaaatatcggtgcagacgccaactaaatggaccgtgtcgattttacgttcgcgcaagcgcagatccagcggggtgccggcaaaagcagaatagcgggttttgtcaaacatattgacgcgctcctcatcccgatgcgcggcataccaaggcgccagtggtccgtaaaattcccgtccccaagtaccgcgaacattatgcggtggaaacagcttgctttccggatgatacggatcatgcggcgtgtgcacgtcagtcggtaaataaacccagccgtcctgttgcaagaattcatctgcgagtgcaacaatcgtaggcgccagcacctgcccggcttttccgcaagtcaaggcgcctttatctgccacaaaatcattcgtgtagtcgatgatcagcagtgcttcatttgaatgtgccatcaaaaacgttcctttctaattaaagtactttttacttaaaatagggttgcataaaagtacagaagacttttatttggtgacaacgatacgcggtctggttggctttttcaactatgccagcttaaaaagtttcggcggtcggccgctgcgactacggtcatgggcaaccccgacttcgataaacagccgctggtgggtttttttgaagttcgagttatcgatcgcggcggcagtggtatggagaaacggcgcataaacttcgcgcgcttcttttaaggtaaacgtcggcccgagaacttgcaaaatagtcggctggtaatcaagcttgttgcggatccgaccaatggcgacgctgagaatacgcgcgtgatcaaaagctaaatcagctgcttccggtttcatgtgaaacgtgagccgaccgttttgcagctgctcatcccctgccacagcatcgaaggcgaaccaacgcgcatcggtggcgccataaccgggccgcaatttcggcatcgttggcagatacgtcatgtaggtcaacgccagcgcccgttcccctggtgtgcgggccggatcggtgaacgtggcgagttgctcggttgagccgcgattgacatggatgccaattttatcgcgaatcaggcgaatcgcagccgcatcggcactttctttcactcgcagcgtggtctccggcaacgcccagtatccggcaaacggctcatcagcccggtgaatcagcaaaatctgcaactgatgcgtggtgcgggaaaaactccaaatcacattggttatggtaatgagtgggtgcgcgacaaattcatcggccatggtttcaactccttgttttgaaagtggcagttccgaaagcaacggttaaatgatgccagtatatttgacttccgtttcactcattgaaaaaacgcggcttcaaatacaaaaataccccattgaatttggcattaccaattcttaggggaagttttgggtaagaaggtttattcggcaatgaacttttcattagcaagaaagtcccaaaagttcattgtggcaacgcctaattgattagcaacgtatggaatcttgggctctgccttactggccagaccattaggaccagtcatattttcatttgtaataatggtcatctttttgttcaatgcacacgcgattaaccacggatcagccttttgataatcaccagtccactgttcgtatccagcagcagtccatttttgcgatgtcattaggtactgtgtaacaacttggtattcggtaacaaataaatctgacacgatggttttacccttaaagtgctctttgacccaaacactcaattcatcatccttagttgttatctcttcatacactcgatcaagcatgtacaggtgctccgtgtttaagaagaaatgccagacgattggaaagaatcgctggcgataatgcctattggaaataatccagatgtctgaatccagcaaatagccattcatgtcagaacctcacgctcaataaatttttcaatagtacgatccatcatcttataactgatacccatcaagctagcggcctcagttggctgcactgcaccacgttcttgagcggcgaccaaggtattcatgtaccgattgtcgtttaagctcagtgcgttattatatgggttacccccagtcgaatccatactggctacgggttgttccgtaaaatcttcgggcacaacatgatcaataagacctaagccttgcgcacgaattgcgcctgctaaaggactcacattgaagaactgagcggccttacgaatatcatattctttaacgcgacgaatgaagtcttgttcaggcatcaaaaacgcagcagttgccttgttaatgagttgttcttcttgtttttcactgtcaagattctttagcagctcgtcggtgccatgtaaaatatgcccaaactcatgaataagtgaaaaaatacgggcggtgtaactgtctttttggttaatgaatatcaagggggcatagtcatcaagaaggacaaaggcacgggcttcagaaacgtttaacggcctattagtgccaaaaccagcaccacccttttgcatgtttaaaacacccagttgggatagctgagcacgcaggtccttgtaaagatgtcttggtgattcagcatgatgcaatacaatgaaacgagccatcatccgttgtgtctctgatgccgatgcaccacgagcagcgcccacaaaggttagctgctgattagctacgccgctctcgtgtttgaaccagtcttgtttacgttgcatttcgtatataatgtcacgcaacgtgagactgacttgcgctggcacattttcctgggttcgaaaagccaaacgaatgtcttcctctttgggcggttcatccatcagcagattgccaaatggcacatgaagacgcctcgcaaataaacccagttgcttaacggttggctgtaaataatgtttgaagtcgacttgtaaccacttattacgctgctggatgtccgccaaaacgtcattgggcaggtcagtggtcgccaatgcccagtcaattagccgcttatttacttgaactcgggtgtctgccactttcctcgcctccttaatcgccattatacgcatgtgtctaacgctacgcattaatcacggttgttataatgaattcgttttctggatcacaacatgagtgtaacctttgtaacatctgttttcggattcatcatctatcctttaaataatccattgcaacgtgatacttatccaacagtacttcaacggcattgtccaacgcctctttgtcatgtgtctgatcatctttgaccacacgcaattcaagaacgccatccttgtccaagtcaaagcggattctagcacctttagtgatgcccattcggcgtctgaattaagccagaatggttactcgtcctttactgataacgtttccttctaaatatttgttctcgccagttggcatcgtgaggcctcctcgtatatgctgttttctgtttgtttaacataacatagcggcaaaaacaaaagctaatataaaagaggcgtttcgagtaaattctcgaaacgtctcttttttctagccactcacaccggcgatttactctctttcgccaccaactcgcgcatgtccatggcttcctcaaaacggttggtgatgagcccgacaacgtacttttcgcgcatcaattgtttcatttgcagcgggtcgtcaaccgtccagacgcgctgggctttgtcgaggtgggcattatagtgctcgatgtgcacggcttctaagtaagatggtaaggtagcacccatgagcacccggctggttagccaagcggttttcatctttggcgccagcgtgtggaccacgttgatgctgtcgtgattaaacgaggagtaaatcacgcgatcctgcatgtcgaactgctcgacataatcctgcgtcagtgcctcgattcccgggtaccggattttaccggtcttaaattcaatattgaccatcacgtcataacggctcaaaaccgtgagggcttcccgcagtgacggaatgtgttcgccattggccagccgcattcccttcaactgggttcgcgtcaaatcggcgatccagccagtcccgtctgtagtgcgatcgacgcgttcatcatgcatgatgaccaagtggccgtcagcactcatctgcacgtcggtttcgatgccgtcaatcccatgctcacaggcatattcgaatccttgcaggctattttccggaaaacgggcagggtacccgcgatgtccataaattgctactgtcatgcttaccctccgttcattgataaaagactatccaatgcctgatcatacgcgtctgccattcattcagcaaaatgaaccattttagcgtttgtaatccagcagattgccgctgacagagttggttttggaaattgcggtattggtgtctgactcagcctcatctaaagctttcttgacatcttctccgccgtaaatctgctgcatggccaactcgacgttttgccgttcttcctggatgttgctgaagaaggcgccagctgttgcggcattgattttaccttgattgagctgctcaattggcactgccaaggcaggattcttcttgatcgcagtagctaacgtcttaaccttgttggctttctggttgaccgcaaagtagccggtgccgagttgccaagctgcctgggcctttggcgtcatgaggtacttcatgaactgccatgcaccttcttgaacggctgtcggcttgttcttggtgatccacaagctggcaccaccgatcgcaaccccattggccttagtatcatctggatgcggcgtgaatgtgacgccgtagtcaaatttggcgtttttctgcagctgccctagcatcgcggaactttgcatgaaaataccgaccttctgcgccaagaatgctgcactttggttgttggcggcggctgaaccggtcccgaagttttggaaagcgccttgcttgataacatcctgcagccagttcatacttttgaccatttctggcgaattcaatgtggcttgagtggccattgcctggcgtccgttatcatgattgaccactagcgaattctggttggcgaccaattcttccggcaaccagccatagatctgcatggtcatccctttaacggcgcctttacttttcttggtcaaagcaacggcagccttggtgatgtcgctataggttggcgacaacggcaaatccgcaatgccatatttcttgaacagtgccttgttatagtacatgaccgaactggacgagttaaacggcatggaagctagcttgccattgatcttataggctgccgtcacgccgggatacagttgactcagatcataatgatcgcggtcaatgaacttttgcaccggcacggttgaattgaggccgatcatcatcgactggttagcctggtcactctgaatcaaatcaggtgagacattgctgccgaccgtattggcatatttcataatcgacaattcataactgccagcgtaaatcggcttgaccgtgtacttcgtctggcttttgttgaattgatcgaccagcttttccagcaccttttcattcgggccgttcatcgaatgccaaaacgtgatggtggtccggccattgtccgacgccgcagcggttttatgttgatcagtcaggaaaaaggcaagacctaatataaccgcaagcgccgcgatcaacgcgataattttcttgtatgtggttttcaccccttcgtcccccctgcattcagattacgcttgaagaacttctggccaatcagcaacagcgccaaggtcggcaacagcacgataatcgccgtggccatgaccatgccccagttggcaaaagtatcttcagcctgtaactgtttcaacccaacctgtactggccggaaatcgtccgagaatgtggtaatcaacggccacaggtattggttccagtgcgtcaggaacgtatacagcgaaaaggtaatcaacatgctgcggctgtatggaatcgcaattttccagagaaactgcaggcgaccaaggccgagatacttcccaaagtccacgagatcggtgggaatctgtaaaaaggcctgccgcaacatgaagaccccgaaggcagatgtgaagaatggaatcgtcaagccggcgtaattgttcaaccagccaaacgccttcaccgtctggaaattaggaatgatctgcgcttcaaacggcagcatcatcgtgatcaaaaaggcaaagaacaactgttttttataccggaaattcatgaacgcaaacgcgtaagccgcaagcgtacataagactagctgaccgatcgtgatcaatccagcggtgacaaacgagttgatcatgtagcggataatcggcgtggtcacgaatgcctgccagtagttgtttaacgaaatattggtggataagaagttacctgccgcgatatcttttgtcggcagcagtgaagcccaaattcccagcaagatcgggaacaggagtactaccgccacaacagtcaacaacagataccgtgttccatttttgacatgtgtcatgcgtaatacaccttccgttctgtgaagtggaattgaacccaggttgccaacgcaataatcaccgtcaagacaatcgactctgcgcttgcggttccgaaattatggaaagcaaacgcatcttgataaatcttataggccaaaaagttcgtcgcgttgttaggcccgccgccggtaatcaggtcaatctgggcaaacattttgaacccatcgataatttcgacaacaaataggaagaataaggttggcgaaatcatcggcaccgtaatttttaatgtttgcttaaactgggaccagccggcaatatcggctacttcatagtactcaggcggtacactctgaaaggcactgagcagaatcagaaaggcaaaacccaaagccatccagacactggccagcacaatgacaatcatggcgccggtcggatcaaccaacaagttggcattcgtgacgcccatcgccttcaaggcaaagctggcgaggccaacagacgggttgaacaggaacagccagagaatggaagccgcagcagcactggtgcccatcgtgccggcaaaggcggtctggaaccagctaatccgccgcagtttcatcgttgccaaccgcgccaaggtcaccccgagaatgatggtcaccaacgcaaacgcaacgacatacactaaggtgccggccaggcttttcaggaataacggatctttgaaaatatcgagatagttgcctagtccgacaaacttagccgattcaccgcgaatgttggtcgcaaagaaactgttgtaaaccgtcatgatcatcggataaaacgtaaataaggtcagaatcaacagcgatggcattaggaaccaaaaggccggcttgttgttttcgcgaagcgtcgcaaccactttgccttttgattcggttgtggttttattgagttctttattaagctccataacctgccgcctcctttaccggcgccgcaacaatccgctcgccgtcgtcaacgttgaagaggtgccattcatcggcactggccggaagcagtaaattgagttcggcaccaaccgcgactgtgaactgctccggtacccggctcacgagtggctggccgtcataatcgcagaaaatcaaggtatcgttgccaagctgttgcaaacttttgactttcacggtgatggtatccggattggcaatggaaaccggcaccaatttctctggccgaatgccaagatgataagaaccagctggcaaatcgaatggcagaacaaaggcgttatcggtccaaaaggcattgccgatactgaagcggtcgccttcgtcattgaccgtaatcggtagcaggttcatttccggactgccgataaatttggccacaaactcgttggcgggatgattatataaatcaagcggggtaccgagctgctggattttttcatcatccaacactaaaatccgatcgcccatcgtcatggcttcgacttggtcatgcgtgacatagatcagcgtcatgccgatttcacggtgcaatcgggcaatttcttcgcgcatttcggttcttaattgcgcatcgagattcgatagcggttcatccatcaacaccacgggcgctttggtggccaaggcacgtgccaagctgacccgctgttgttggccaccggagagttcttttggcttccggtcgcgtaaatccgtcatgtgaaccagatccagtgcccagtccacccgcttagtcttttcatcatcggacaggtcttgattttccaggccgaaccgaacgttttgcgccacgctcatgaatggcagcaatgcatagttttgaaagaccatcgccagtttgcgatccttgggcggcaaatccgtgacatcgcgctcgttaaaatagatacgcccatctgtcacgctggttaagccggcaatcatccgcaagagcgtacttttaccggaaccagacggcccgaccatcacaaaaaactcaccgggttcgatctcgacggaaatattggaaagtactttggtgttaccaaaagcctttgacacattcgctaatcgaatactcattcctcatcaactccttacacaaagcctaacaagcctttgtaaagatcgatgtcaacccggtgtattaattatgtaagtattatgtaaaaacaggtgtttcgaaatgaaacatagcattttttgcgccgagtaactggacgaatcccattaccagaaccattaaaaaacgagatcaaccttagccgcatctcgtgtttttgcaaagctattttcacttcatgcttggaattcctagccgccagtcgcaactaatcacaacagccgatcccgccgatgctgaaagtcatccacgattaactgaccgacctgctgattaaagcgcatggcatcctctcgccggtgattgtacgtggtgagcaccacggcatacagctgctcgccttctgccgcaaaacatgccgcgtcgtgttcgcaatttgacaattcaccgcttttaccggccgtccagcccacaaaagcctgcatcgttggtgccagcaacagtttcgtacgattctgctggtgccgtaacgcctgcgcgcaccaatccccgtcggctgactggtgggtcggcgttaacaagtcatgcaacagccgccaagctgcttccgccgtaatccgattatcgttgtctgcatgggactgcatcaatgcgcggttcaattgggtaccaggaaaatgttcagccaaccatcgtgaaattgtcggcaatccatataatttcaatagcgcattcgtcgccaaattatcagacaccattaacatcaacgtcaccaaatcccgcacacaccatgacggcgccgtcatgaagcgcagcacccctgcgccaccaacagttgctggtaattcaaccattcgattccattgaaaaggatccgcttcggcgcgttttttcacgtaagcagcaatgccgagcttgatcaggctcgccgcgggaaacaaggtatcggtctttgcgccgaaaagcaagcggcgattatcagccagcaagagcgcatgcggctcggcaaagtggcggtgcaactggttaagttgttcaactaaatgggcatgcttcatctagacctatctccgatcgcaaaccaagcgccagacagccagtagctagcactcagctcaagttactttcgatcatacacccattcgccgtgtcaatgaccctcgttgagaaaacataacacgaccaacgcttctcattcatcaggccatgaagtggcgaccccgaaaaatcgggcaagcaattgcaggcgaatcctcacccacgcgcggttagtccgattgggatagatccgattcgtcaggcaaacaaatccgcgccgattatcgcgatcaaaagcaatcgaggtgccggtaaagccggtgtgccaatactggtggcgattggccgaccagcaacgccatcccaacgtgcgtccgccgacacaaaaacgctccagcaaggaaaaggctgcaggtggcaacaccgcttcaccgtttggcacaggcaaccccgcaaacaaccgcgtgaacgttgtcaagtcacccaaggtcgcaaacaacccggcgtgaccgctaacgccatccagtaaaaaggccttgtggtcgtgaaccgtccctcgcaacacgccgccgcgctctggcaccttttcagtcgggacaaaattgcgcgccgcgacgccatggggttgatagcccgtagccgtcatccccaacggcacaaaaatgtgcttctgcagactggccgctaatgagccatcgacttgagccaccgcccagcccagtagaatataattcaaatccgaataaatcgtggtcgtgtccggaggcgcaactgccggcattgtttttacagcattaatcaagccgtcgcgatcaagatcgtgcgcgtttgccacatctgccggcagcccgctgcggtgtaacatgagctgctctatcgtcagttgcggatatcgcaagccatctacaagtgacccgatcggctgatccaactggattttcccggccaccagcagctgcaataaccgcgtcgtcgtccccaccactttagtcagcgaagccaagtcatagcgatcctgtggcattaacggtagctgatcgtcgccggcaccttgataacccagaaaatataacgcattttcatccggcgcaaccaaactaaacgaagcaccaaagacggcacccgcgtgaatggcctgggtgatcggcgccactaagtcaggattgttggccatgttcagcctcccatgccgttaaaaccgcactcacgacgccatcatgcgcagccaacacttgggttgcggtcgcggcatccatgccggttttggccatgacaattgctaccggcaccttatgcgccgctgccttcaataaggaagcagcgtgggccttggtaacgccagtggtttcaacgataatccgctcggcccgatcgaccagcttggcattagtcggcaggacatcgatcatcaagttgccaaacacttttccggcgcggatcatcacacccgtcgacaacatgttcagcaccattttttgagcggtaccagccttcatacgggtggagccggtaatcacttccgggccaaccactggcgcaatcgcaatgtcggcgtgggtggccaactcactatcggccacgcaggtgacggacacggccagtgcatgtgtctgttgggcgtacgtcaacgcgccaatcgcataaggcgtgcggccggacgcagtaatgccgatcaccgtgtcattggcattcagattcaagtgcttcaggtcgtgttcggccagttcagccgagtcctcggctccttccacagatttgaacatggccgacatgccgcccgcaatcaagcccactgctcgctctggcggaatgccataagtcggtaccaactcagccgcgtccaaaacacctaggcgcccggacgtgcctgccccggcatagatcagccgcccgccgcgattgtaccgctgactggcttcatcaatagccgcggcaatatgcgcctcttccttagcgatcgccggtgcaattttggcatcttcgtgattgatcaaggccacaatctcaggtgtcgtcatcgtgtcgatgtgcatgctggccggatttctttgttcggttgttaggtctgcgattgccattttcctcacctcgaattttcaattccccggttagctgtgatgtcgcccgataattctgctccgtgcgcttaatctcgccatgaaccacacctaaaaacagaatattggcgacgtaggtttccgtaaacattgacgtcacggcaccgatacgcaggagcggttccgtcggcggcaaggcaatcacgcaacttgccacattccgcaacggactcggctcatgacgggtcactgcgatcaccggggtatgattacgccgtgcctgttgcgctgccaacacaacttctttggtgatgccactgtaggaaaaggcgaccaccgcatcagccgaagtcgtataatacatccgctccaacgccgtgtgcgcatcatgatcaaaaatagccagatagcccgcccggatcaattttaaatataggtcctgcgcaacaagtgccgatgcgctgataccaaccagataaatatgccgagcatgccgcaacgtggtaatcgccgattgaaccgcatcttggtccaatgcttccggcaaatcccgcaccgccgcaatcgctgtctgactaagtttgcgcatcatggtcggcaaatcatcatcgtcttgcaccagcggatcaagcggttgcggatcgtctgccgtcttggtttcgcgcaccaaggcaagcttgaacgattgtaagtcatcaaaatcaaacaggcgcacaaagcgaatgacggacgcagccgagacaccgctggcttgggcaatctgggccgttgtctcggcgacaaacgcctccggatcggccaatacgtggtgggccaaggcgcggttaaccggactcaactgcgcaagccgcgcctccactctcgttaaaagcggcgtcattcggccttatcaataaacgtggcgattgacgttttgctttcattaggaaccatctgcgcagtaatggtcaccccttgtttgagcaaacgccgaataatcgcaatatcatcaggcgatagcgccacagacggcttgattttcttggtaccgggtttttctgacaggttgccaacattaaacgacttaatcggcacgccgccgtcaatcaacttcgccatgtccggaacattgcgggtgatcacaaacacttgatccgcggcaaacttaccattttgcagattttcaatggctttggccactgagctgatggccaattttttcccagccggccgggcaattttcagcccctgaatcgccatgtcatcgtggacgacttcatcgttgacgaccatcagccgattagcgccaaccgtattcgtccacaccatcgccacttggccgtgaatcatccgctcgtcaacccgtgctgccacaattgtcactggaatcactccttcctaaaaatgcttttttataccaagctaccaatccagccgaaaatcgcaccgagattgcctagcaccatgccgatcaaaatcaagacgaaaatcagtcgggtggaattcatatgcttgcgcccaagaatccagtatgagaacaaggcaatcgccaacggaatcaaggctggcataattttatcgagcatggtttggacattcatcgtgaccttgccgactttataggtcaaatcaagcttgtaattaatgacggcgggaatcatcgcgccgacaactgttaagccaaggatcgaagcgccttccgtgaaaatcgccatgctgtcggcgaaggtcgttgccagccgcgtgccttgtgccagcccgacttggaacaacttccaacgcacccataaaatggccaagcaaccaactaccggaatcaataggccgatcggttgattcgacaatgccatgtaggccgtgatggagtaaataatcgcattataaatcgcgacgaaaatggtatcgccgacgccggcaaaaggccccattaacccggttttcaatccggcaatggctttttcattttcatcgttcatccccagttgatcctgcaaggcaacatccgcgccgacaatcaaatgtgacatttgcggggtagtattgaagaagcccatctccatgttcagcgcctgcttcattttggcaggatcatctttatacagccgtttcaacgcaggcatcactgaatacgcgtagcctaagccttgcatcttttcgtagttccaacctagctgcaatcccaagacgttttgaatgaagatgtgcttgagatcttttttggttattttgtttaatttcaagtcagacatcgatctcgacctcctcgtcgtcgctactgccgctgtcgttaccaccattgtcaggcttgcttgggccattaccgttgccgccattgtgcttgcgttcgttggcctccatcacgtgaatggccgcaaagacgaagccgaccagcgccgtgcccagtagggagaatgacttcgtgaagtaagccatgaggacaaatccgagaatgaaataagggtagtaccgcttgattggcaggtaccgcatcaggatcgcaatccccatcgcaggtaaaataatcccggccgtcttcaagccaaccatcagccaccccggaatccaggcattgatggccttaacaaccgccgagccaaagaacaagcccacaaaaaccggcaacatacgtgaaaccgtccacggaatgatcccgtaaaggttgttccgttcgacgcctttataatcacccttgagtgccaagcgatcagcatgatgctgaaaaatcgtgttcgtcatccgcgccagaatatccatttgcgtcagtaacaagccaatcggaatcgccaatccgattccataagcagccccacgtccggacataatcgcaaacgcactgcccataatcgaaccggaaagaaagtccggtaccgttgcgccgccatacgtcgcgacccccaacgtggccaactgcaaagtcgcaccgacaatcaagccagttttgagatcgcccatgactagaccagttgccgcaccaccaaacaccggtgaaaataacccgatcttcagtgagagtgcatcgagttgtgccaagcccacatagatcgtcagaaaaataagtgcaaaagcagatatcgacatgatgtttcccctccctaataagatttcatcgatcaacttgattatggtcccatatgaaactgcatttcaagtatttgcgttataaaagttaacattgaaatacagtttcttgtggaacaaaaaagtgtcacgtgtaccaattaaggaattgcgagttagtttgccaacaaaacagtttgatgcatctgtatctgcatgagtgtgtacaagaaaatggtgcgcttcacgttgacgccgcgacgaacgaatgcataaaaaagtggccccaaattttcaggccactaaggatgttcggactattgcaactggaacttcagcacgaccggattgtgatcggaatactgaaaaccggttgataccacatgcacactttccgctttaatattgggggacagaatatagccgtcaattaacgtcacaaaactttttccgggttgatacggccgatcaagcgcgcgggcggaaggcactttagcttcagccaagcccatggtcgggatgtgaaaaccagctggcagtttcgacttaggaaacaggtgcgtccaggtttcttcgagatttttggtgtggaaaatctcggcagtatttttcaatagccggtggttataatcgccagcgaccatgacgtaattgccttgcttgtatgcatgatcaatatacttaaacaatttggcaaattgcgcctgctgcaccttcacgtttggggtaaaggcggacatatggatgttgaccatgatgaactgtttgccgtttgcgaccgtcgttttcgtggctgtaaatgcacgatccaaatcaataatcttgttgaagtcggtgtcgactggcaaactgtatcggcgggaactgtcgattttagccttgctcagcgttaaaatccccgatttcgccttcccaatcggctgggtaaacggatagaacaaataggcggaatcgtaattttgcccgtacacattggcgtattgtttttgcgcctgcgttaccatgttcacttcattcacgtggcgggaacgatcgccatccggatcgatttcctgataaaaggcaatgtccggattttgcgcctgcgtggttttaatgacaccattgatactttttcgcaccgcttgttgactataagcccgcgaatatttgccgccgtccatgaaaaaactataactcggcggataagagccgtatccgatgttataggtcatggccgtatacgtctggcctagcttgaattgggcatcttgctgatttttgactttcaacgcctgattatccggtagccggtaataagtcgtgaaaagataaatcaggtaaccgcctgcgaccagcacgacggcgccaacgacaatggcaatccatttcaataagcgtttcaccaatattcccccattaagtttggtttcaatcattataacagttgtcttttcaccagagaccggtacgattaagtatgtgtacatgcctgccattttcgcaagcaggatacacaactttacataacctagcattgaaaggaacctgttatgtcagccgaaatcgagcgcattttagccgcttttgatcaattcgataccattattattcatcgtcatatcaatcccgatccagacgccatcggttcacaaaccggactagcgttgctgttgcgggcagcttatccgcaaaagacagtctacactgccggcccggccgcgcccgacttagcttggatcgggccgcagcaagatgtgccagcagctgcttataaggacgcactggtggtggtgattgataccgccaatcgctcgcgcatcgccgggacgcattttgaccaaggcgccatgctgattaaaatcgatcaccatctgaatgaagatcaactcggcgccatcagttgggtcgacaccaacgcgtcaagtgcttcggaaatggtttgggagttggtgcaacacagcaagcgcctgacgctcaatcaaccggctgcggcggcgctttacgcggggatgatcggtgacaccggtcgctttctctacgacttaaccacggcccgcacgcatctggcagctgccgacttgcttgcgaccggcattgacgcaccggcgatcggccgccgcgaagaccagtttccggaaaaagtcgggcgactcatcggctgggcgctggaacatgttaaaattacggcaaacggtgccggatcactgctcatcacgcaaaaagtgttgcagcaattcggtttagcttacggcgaagagcagcgcgcagtcggcaatattggcaaactcgccagcatcgaccgctgggtagtattcacggaacgtcaagacggcaaatatcgcgtcgaactgcggggcaaaaccaaggaaatcaacaccttagccgtacgccatggcggcggtggccatcccttagcaagcggcgccgtggcagatgaccttgctgaagtgcaggcaattacgcaagagttagcgcaacaatgactttcatgggagacgagaaaactctaaaagtactcgttaacaaaaagaataaggcatttctcatcgagttgatgaagcaaccggttgttgaagcaaatgtcttaaaaatgtttcagctcgtgtttgaggctaacccacttgataaataaagaaggctttaaaatccgaaactagatcggattttaaagccttcttcacttattacttgcatactgcgactggtgctaatcgcaagtcgccgtttctacctcagtcttcatctttcttagccacaatgataaagcgatcttcaaaagttgtaatgtcaccgacacttgcaataatatcctgtaattggtgaagcttcggcatggctcggttaacgtcaaagttaggaaactcccaaggaatgaccgtcgcatagtacacaatggcaccaacatccgtaaagcgcattttaacaaaagaagcatctgcctttagaatctggaagccgctgttctgtaattgcgttataacctgtaacagattgttgtcagggaacgcgggagcgtacttctcattcaagaatcgcgataacgagtaattattagttgcccccacttgttgtgaaatgaaaataccgccaggacgtaagacacgcgcaattgcagcaattggcaatccaccatgactatttgtcaccacttcgaaatgatcactcggaacctgtgccatttggcctttcggatcggcatacagcgttatcccttgtggcaccagtgcacgcttcaacaaatcaatattcggctgccagccttctgtgaccgaagtcttttcaacgggatgctcaaacgaactcatcagttccccgccgccggtgtccatgtctagccattcatcatccggttttagatactgcctcaccaaatcacgatagttccacggcaaagcgccagtctcacagcggttctttaagtggctaaaatcccatccatgcatcgcttggcgactttcttcaagccaggactcttcattttgattcattacctttttacaccatcgctttcaaccaattcgattgtattaccaaacttttccgcaaatgcgttatatgtcgcaattaacaacggcttgccaccccaaccgctgctttcagcatatctcagacaagagccgtacaagaccttcgcacgatgcgattcggtaacatctgcacatcaccgcctttaatgtgacttaagtttatcatttcataaggttcatttggtgactaatcgccactcgtcactttaataccgacaattccgatgaccaacaacgcgatgaaaagccaagttgctggctgcagttgatccttaaacaaaaccacaccaacaatgatcgaaccaaccgcaccgatcccggtccagaccggatatgccagacttaacggaagatgcttgaccgccaacgcaagaaagccaaagcttaaaatcatccctgccaacgtagctaaggtaaaacctaatcgggaaaaaccgtgagacaacttcataaacgttgcccaaacgacttcaaaaccgcccgctaaaactaaataaaaccactgcatgttcttttcctcctgtgattaaatgccagtcatcaaccatcacagccaaacaaaaagggtgacagtacccgcaaccgctacattgacctaatgcggttgcgatactgtcacccggtagtgactagttatttaaattgctgttgttagttatcttttcacatatttacggtgatgtcaaattagacaagtaaaagatatgtgtcaatttgggcaactgctgattaacgctttttacgacgctttttactttttcgcttgccccgtttatagtcagatagcgagacagctctgccttttggttttggcttgggtaaaattgtgccccgcgcgcaaacatcgcaagcagttcatcaccatgctctttttcgatcttgtcattgaaaattaaatacaaaagtagatgcatccaactggcaacgagtgcctgagatttttctaatgactgtgtatgaatggtgttggtgatgtagtcaagaaagtgttccggtccccatgtctgtaaggtttctaaatgttgggcataaagcgcatcacccatctgaacaaccgcatcaatgaccactgattgaggataagcatcacgcagatcctgactgtcttcggctgcccatgccaatcttatgtacttaagcaattgatcgtgaacacttgttgccgtggccaattgccattgctgatcaccaattttgtccacatgttcctggttgagataagactcatcaggttgataagcctcgtctggtggctgatcgcctatatcgtcttcctctatgaacgcagcatctgcgtcccgctcatcgtctgacacattaggttcgtcaattccaaggaaagcatcagcacgatcggtaagaccagtcttgacggaattcatcacttgccaaatgtcaaattcccgtaagtgaagcgcattaattgccgacagccaatccaaaaaagtttcgataatccgcaaagtatttagtagcgtcattatctcatcaaagtcatctgttttctcgttagcaaaacgctctagggatcaacgaatgtctccgatggtccactcagccggttttaagccagaaatttcagccatatcactaaggtacatctggacgacacttggtgcattatcatcgaaacccagtgctgaatctgaatcccgatacaatttgctgttttcgaatcttggccagtactgtttaaacttggccacaacttgaggtgaaatcggctgatcagacatgatattttcccctttcaatgacactacataaactctggcattcccggcgcttgcgcatcatatagttctaacaccagattaacatttcccgatcattaattctgtccatccaagtacaaatcctgcccgaatcgcgacattcattgactgaacatgtgaaaactgtgtgccatagacgggcaaaatatccggccgccgactctgaatagtagcggtcagctgtttaaccaattggacggcaatgccgcgatgtcgatattgcggatcaagaatttcgacgctgatctcccagcaggcatccccattctggctcgcaccggctatggcttttaattcaccatcaacttgataagcaacgcccaatcgatctgggtaatggcgatcatagccgaacgccattgtgattgccttgtttgctcgataagcgggaatttcatccgcttcaatcagatgtatctccggcatgagatttgacacaaaccgctgactcggcacgaaaaagggggctatattgctcaccctcagaccaaaactgcttaatatcgttgctaatttagttaaattagccatcgacaaaaaccacgcgccatcctcttcgccaaacgcccgcctcaaagctattaaggcttctggatttgtcacacgcaccaacaaacgattgccccgaatcactatgtcgccttcatcgcgtgcccaaaaacgtgccatagcttgaggagattttgccacaaaaacgttttgcgaaccttccaactctgctgctgacaattgaaaatcgagtcctaactgggtgttgatcaatgacatgctgttgtcctcactaattgattctacccttcccgaatcatcatcaattcgcgaatcgtgccaaacctggtcacatcttctagcactgtgtccgtcttcttaaaaccaaactccaggtaaaacttttgagccgcaagattgttgttcagcacccgcacataattgttcgcataggtctggttaagttgtttcagcgcttgctcaatcagctgactcccgacgtgctggcgctggaattgcggcaaaacatacaacgaatataattcaccccaacctgcataatccgccatgcgtgcacgaccaaagctacaaaccccgacaatctcttcggatccagtgattgccaaaaacgtgttctgccaccgtttttcgggatgccacgatgctggcgtgagctgttttaaaaaacctgctggaatcagatgacgataagccgactgccaagtgtcgtaataaacccggctgacggcagcaaaatcggtcttcagcgttgctttaacaatacgaatattcgccatgtttagctaccttttttcttctgctaacaaaaacattaaccctgcaggtacaactcctgaaacttctcaatatcattcgctgtcaactgcaagccctgccgcaaatactgatcaaaactgccaaacttcgtatcaatcacctgaaaataatgctccagatacgcagcatccaccctcagcgccaacgcaatggtctgcagttgcgaggccggaacgccttgctttttcaaatctgctagaatcacctgattcgcggtcttgcgctcttgattggtcaacaaataatccgccatgatcgtttcgccgggtactgccaacaacttcaggatgatcgcggcgccaacgccggtgcggtcctttcccgcaaaacagtgaaaaacagtgggctctggtgctgccaacaaatcgtggataaacgcgtggtagcccgcctgcgccgagtcactcatcgccaactgttcataagtcgccagcatgttttcgcgcacatcgccttgttcggttatcatatgacccaagcttgcgtcgttggtggtggcgtctttcaaaatatccaacaccgtgtacgccgcacctggcagggtcgtgtcgggaaactgcgcgcgttcgtctgcactacgcatgtcaatgatgtgctggatgcccaccgtctcggtcagataacgtttctgagcatcatccagttcaaaaagctgcccagagagatacaacaacccctttttgaccatctgcttattcttgttgcgataaccgccaagttcgcgaaaatttgtgattttttccaagtccacatccccttgtgccaaaaacgtcactgccttgaatcaggatttcttgctgcattgcgatcgcctttttcaaaataagatgaccggcatcacgcctgatcctgctgctgttcagtcgatgacccaaccgctggcaagttcaagttgcgccaattcacttgctcataatcttccataaattgtgctatatactgaccggcatgtaagtccaaaagccgccgaccgccttcagaaagataaaccagcagcgattgctgattagagaagctgccgatcaaatccgacgcataaagcttagcaagcgcataattcagatcctccggcagggcgttcatcatcacctgctgccgcctgcctaaatggataagctggtaaaaaatcatagcctgcgattcttcggaaaaggtcgcgtaactatcatcaatttgaaacgttgtcccatgatggtgcccgtatttaatcagtgacagcacaaagaaatcctgataatcaaacgttagccaagtcgccgtttttaaaaattctgtcagctcttcagtcagctgtgcttgtgaacgcaagaaaaatgtcggcactttttgaaacccactgaaagcacggtggttactgattcggatggccaaatactggctcataggacgaccaagaatcacatagattgactgacttttccgcgcacaatagaagctgatgatacagtcttcagcgtctaaagcgccagcgatggccgctttgacttgcaattcgcgtttttcattcatccgattcacctcgatccgccttcaacatcagggtttgctactaatttaacacaatgaaggccgtgttataccgcattttacttgctaccaccaaaaaattggtgtctattggcacaagataagcagccagccacgggcaccgaaaatggcgattcaaaaattctgtgttaaagtctagaaagatgaaaatatcaagggaaggtgatcagtgtggccgatacaaccgtaacttttttgcagtttaaagacgaccaatacaaaaaaatcaaagagttggctgattcccatggcgtctccgtcacgcggtatatgcgcgaagctatccttgaacgtgtggaagatgaagaagactataatgccgcaacggctaacttaaacgcgagtcatggtgaaactgtttcccgtaccgaaatccgtaagcgtctcgagttaagttaagggcatcgacgctgaattcagccacatccgtttagttgtgcgccactgtttccttgtagatgctcaacgatttgccatacagttccttttgttgtactttaatcgcgggagtacttttatggattttgttcgctctaaaaccgaatccatagaagtgctctttgttgtctcgggccaaaacaaacgcggcgacagtaaaaactgctcgatgcaacgactcgaccacattcaatttttaagaatggagcgattattttggaaaaagatctagcgccgatcacccttatctctgccggccagtccaacatggatgggcgggtgcccgtggcggaactgcctgccgacattcagctgccgctggcggattgccactattgcagcaactacacccctgatcacgataaaggcgtctttcaacccagtttaaaaaccagcgatttatctcaggatcgctggggcttcgacttggtgacctaccacaacattttgcaacggacaccttatcaaggtctgtacgtcatcaaatgttccgaaggcgggacatcgattgacccaaccggtgacggtgatcgccactggaccacccattttgacgaactcgcttcgcctgatgactccttgctgctggcattcacccacctcatcaaacagtgtcttgcggcgagccagcaacacctcgacatcaaggcgaagccgaccgcggatcctattcgcaagctgccgccgatcattactacgacaatctcaaggctgtcttcacctactgccgccagttagtcggcaacgctaccttgcccatcatctgcggcaccgttagccatcactccgagcagtacgacccgcaagtcgaaaagagcatgatccaactagcttcggaagaccccaacatccacatgatcgacatgcaaaatggtaccttgctggacgcctatcattttgacgccaaaagcgccgagttctttggtaaccaagtcttcaactgcttaattgaccagaagatcatcgagggcaaaaagttagatctgcccgcagttaagatttattgacttccgaatatttacttacagaaaaagcctccaatatcggagacttttttgatgatgtcaaaatgttgttgcgtactaatcgtcaaaccggatacacaacatgaaacgattcgagaacgatccgcgctttcgctggatcaaactgtttaccctcttccgcatactcggctttaaaaaatgcttcatgaacctgtcgccaataggctaaactgcgatctccctcaccttcacgaaacgcatggtcggccgtcaccgctaaaaatggctggacttcgacagcatccgtgtaagtcacacaaacaggttcgttggatgaatttaaaatcacatcatacgcgcctgcttgtggcaatggttcatcgacagcatatagatctcgtgcacttgctgttgccgtctttttgccagcaagcacgagcgctgccaatttatctgcttcagcgccaaattgatacgcgctttgtaactgtgtggatcccggcagacccaacgcctgctttacctgggtgaaataggtttctggtgtcattatcttgctccttgcttagatggttcaatcgaacgaatacctgcctattttggccaatatatctcgaagatttgaagaaacagccgcctttaaaaatatatctcttagaaatagccaaaatgaagagatatatttttaagtggggtaagcattgtgattcttttcactttcaatgcccacgctcacttgtgatacgggctaccaatattaatcataaaagcgcggtagatctgctccatcaacaccaagcgcatcagctggtgcggcatggtcaatttaccgaagctcaaggtgtcgttggcgcgcttcatgacggccggcgacagaccaagcgagccgccgatcacaaaggtaatatccgagtggccatatgtaccaagatcggcaatctccttcgcaaagacttcggaggggcgctgcttgccttcaatcgctagggcaatgacccattccttgtccttgattttggccaaaatgcgcttaccttccttgtccttgacttccgccatttcggcttcggacagattctccggtgctttttcatccgccacctcgacaatcttgactttggcgaacttgtccattcgttttaagtactccgcaatgccttcgcgaaagtacttttctttcaacttaccgacaccaatgattttaatattcacgctatttgctgcccccgtcatcatgctcatgccacaatcttgtcttaattcaagtataccagacgttctgtcgggtttagctattgtcattgttcggtttttagcgcaaaatgtacaggttgagtttttttcaaatgaggtaaattgatgattgttattcggcgtctgatcagagatcgggtcctgcagatcaccggcttgttggtcgtcataagcctattcataggccggcctaaaataagcgacataagttttgccacattatggtccattcttgccatgatgacggtgattcaaatcttcgaacacctacatattcttgattactgggcatatcggttaacgtcccgggcgaacaacacgcgccagttaacgtggtggtttattttccttgccatttttgccagcatgtttctttccaacgatgtcacggttttaacgctgataccgttatatctgcgcgtggccaagaaatatcaactgccagaaattctcccagtaaccttgatcggaatggctgccaactttggtagcgccttcaccccattcggtaacacccacaatattttcctgatgcatcaattccagattaatctaaaagagtttttcagctggtcaatcccgttgctggcttgcagtttcctggtgttggtgctgctaagtctatttttgcgcaacgtccccgtacccaacgtgcccactgaacatattcatatccaaatccggccgacgatttttgccgtcattgttgcgtgcgtcgttttcgccggagtcattggcattgtgcctgcttgggtcggcgcggtattagcgattctcctttcagtcgccctcgatccaaaagacatgaaagatgtggattatgcggttgttttgactttcgccggttttttcgtgattgtcagcgtggtcggacagattccatgggtcacccattttattgccagtcttgaaaattcagaggattcggtttacttaagtggggttctgaccagtcaggttatttccaacgttccgtccaccgttctgttggcccgatttaccggctatgttgaagcgctgttttatggttccaatatcggcggtgtgggtacgttggtcggatcgatggctaacttattggttttcaagcagtatttggtttacggcagtcgcccacacgcacgcttttttgtcgggttcaccgtgttcaacttagtggcgctgatcattttggggtgcgccggttactggttaaccgtccgctaatcgtcgtacaataaaaagcaaacggaggtggcgcgattgaaactcaccattacagatgtggcgcagaaagccggcgtatctaaagcgacgatttcccgctatttgaatgggcgttttgaacatatgtcggacgccaccaaggcacacattgctgcggtgattgcggagctcaactatacccccagccgccaagccagctcgctgaaaacccaccgcagccacttaatcggtgtggtggtagccgatatctccaacatttattcgactttactcatcagcggcatcaataaagtcacgcagcattcgatggatcagattctgatcaatgacgcggccaatgacctgaaacgcgaagaaaaagcgttgaaaatgttactgagtatgaatgttgacgggattatcatgcagccgttaagcgccgtggcccatcactacgacctgattcgtgatagtcagacgcctatggttctggttgaccgattaactcgaccgctcgcttggccaactgtcactgccgacgactaccgctcgaccactaaactggcacaagcgattcttaaaagtcattaccgggatatcctgatcctcatcaatccggtcgcccagatttccacgcgccaatcccgttaccaagcgtttttggacacgtttaaaaatacgacgaccacagtaaccttattggaaaccgaaaacgatagtgtcgcaccgctggctacctggctcgaagcacatccccagacacacccactggtctttgccgcaaatggccgattgttaatggcaacgctgcgttggatgcatgcaaaaggcctgcgcatccctcaagatattgccatcagcggctatgatgactgggattgggccgagttggtcacgccgggcatctccgcgatatcacaacatcccgacgtcatcggcacaacggcagctcaattactggcacaacaaattgccggtgaaccggttgcggtccagcgtctggaaattcccgcggatgtgcgcattcgctcatcattttgattctgaaaatgaacaccaaagtaaatcgcttctagagatgaatggaatctctagaggcgatttttgcgttcctaggctgtgctacctcggccgcacattttaatcaaaacaaaacgggcgttttacttgaccgtgattgtaagcgcttgtatagtaacgatgtgctctttaaggaaaccggtttcccatttggatcaagttaactttttgttcgacgtaacacgcttccccttagcgcagaggggcggctcgcgctcacttttaggaggttgtaatcatgccagcaccaatcgttgccaatctgttattgctcgcttccgaatggcaggcgggcaaatcacaagctgacctcgtgtcagagttggtcaacttgggtttttcgaccattgaagtcagacgggaatattttcgtgatattgccaaggaactgccgcaagtggctgaacttgccaaggatcaccagctgacgcttttctacagtgttcctgacgaagttttcgttgctgagggtcaggtcaatccaaagcttcaaggttacttggatgaagcaaaagccatgggcgtgaccaagatcaagtggaacatcggcgcttttgccgagttttccggtgatctagccagcgccttgctttcgctgacccaacaagggatcgaaatcaatattgaaaatgatcaaaccactacgagcggtcgcttacagccggttttgacatttcttcaggccgttacggcggcgaatattccgatcggctatgtttacgatttaggtaattggccgttcgttggcgaagatccgctgaaggcagcgactgcgctgcgtcagtatacgcggtacatccacgtgaaagacgacctgaccggcggcgaaaagccagtcaccgttccgttagatcaaggcgatctgccgtggcgtgatattttggcgatcttgccagacacagtgcccatcgccttggaatatccgaccgcacatcacggcattatcttggaaggcaaaaaactgctgcaagatgagcaagctagggggtcacgtacatgaataaccaacgtttgcaaattgatccggaacaattcgccctgaattttatcaagtctttgaatattcaggtgtcaccggaaaaagtggatattgaggcagccagtaaagaagctttagctgcgtatttgtcggcattttatctcgctgagcggtttaactcgactgagaacaagttctttgaggatcctgatcaaagcggcatccgttctagttaccaacgcattttaagcgagttgaacaagtattaagggggcgcttcagatggggagtctaataaccggtattttacttgttttgactttcgttttattcattacgtttgcgatgcgcggtggcaacttaacggtcgggttcttcgtcatggcgattgtgtggaccatcatcggattggtgccaattaatgtcgcgattaaagagattttcactgatcctgtgctgaattacggcaaaaccgctttgtatatcattctcggttcctggtttggccgcgtgctagtggacaccggcattgccgggtcaatcagccggcgcacccaaagcgtcggcagcaaggcaccggtgattgccaccattttaattgccattatcaccgccttgatcttctcaagtgcctatggcgtgggctcggcgatcgcggtcggggtcattcttttcccgattatgttttcaatgggtgtcccaaaaaatattgcggtctcgattttcacgttgtcgatcggcgccgccatgtatattaatccggttttgtttaaccaattcaccgtcttcttcaaaggcgttgtctggggtgatcattatctgcggttcggctttgtcgccatggctattcagatgctggtcgtcatcgctatgatccttttttatgccaggaaaattagaaacggcaaaccattcgttgtcgagtcagagacgccagaaacaagcgtgccacctgatgtgaatccgatcacgtacctgctgccggtgttgcccgtggccatgagcattttcttcaaatgggatgcgattccggcattgttgctggccacgctcctggcatttgcgatgaccggcaatatgaaatcttacgtgcattttgtccagatgatgaacacgacaaccaaaacggccattggcgatattgccggcttgctgatcatgttgctggtcttgaccatgtttcaaagcgcggcagtccacaccatgggccaattcaccgcggttttcaaacgcatcatccctgatagccgcttattgatggtgttcatcatgatcgtcatcgcaccactgtcctacttccgcggcccgttgatgctttatggagcaggcgcagcaacggcggcgatttttaccgccaccggcttattcccgccttacttcttatacgggttgctcgttgtcccgaccatgatggcggtgtcggccgacatcacccagtcctggaatctctggtcggttgaatatgccaagcttgataccaaaacatttctgttaaccggattgccttgggcttggattgcgacgatcttgaatttgttggcggcttatgtgttgttgtaatatctgcgttcatttaaagaaggggaacataccatgtcagaatttcttaccatcggagaaccaattgcgctttttgcttcacaggatacagatcaatcacttaaggatgccttgaacttccggaagtatctggctggagccgaggttaatgtggctgtcggggtttcgcgtttaggccactcggcgcaatatatcacgcggctaggcgaagatccgtttggcgatttcatcaaggaccagttgcgtgaaaatcatgtccaaaccgattatattgatagtacgtcagattattggaccgcgttccagcttaaaaataaggtttcaaccggcgatccggatattttctatttccggcggggttctgcggccgcccacttcgatgccaaaacgcttgatcgcattgacttttcggaggtgaaattcgcccacctttccggcattttcccggcgatttcagaacaggcgctggccgcttttcgccacttgattgacctgctgcacgaacacaatattcggacgaccttcgacccgaacttgcgcccgcagttatggtccagcccgcaagaaatggcggcaacactcaatgagctggcaaaagaagccgagattattttgcccggcgacaacgaaggggaacttttggtaggctcgcgcgatccggaaacaattgccgacttttacctcaatcaaagcgagcgcacgcaaacggtggtcgtcaaagtcggtcctaaaggcgcgtatgttaagaataagggtgaagccggttattgggtgaagggctttaaggtagcgcaggtggtcgatacggttggcgccggtgatggttttgccttggggctgattaccgccttgatggaaggcaagtcccaacgtgatgcagtcgtccgcgcaaatgcaattggcgcttttgcggttcaggcgcctggcgataatgacggctatccgacgcctgagcaactgcaagcctttttggacaaaaatctggctgtgatgggagacgatttttaatgaaattacaggtggccattgatcgggtaccattagccgatgcggttgcattggcgcaacaattggatggtaaagtagcgattatcgaaatgggcactagcctagtgaaggacgaggggctcgccggttttcgcgcaatgcgggcggcgattcgtacatcacagttgctcattgatctaaaaacgattgacgagggtggttacgaattcaaacaaggctttgcagctggtgccgacattttaaccgtgatgggtgcggcgtcactggcaactctgaaaacaacggcagcggcgacggatgcggcgaagaaggaaatgatgatcgacttgatggaggttaatgcgaccaaacagcaagccatcagtattttcccaaatgcgatttatgcgctgcaccacagcactgaccgccaagatcacctggatccaaccgcaacggtggccgattttcacgccgcctttccgcaactcaagcgactggcgattgccggcgggattgatttggcgggtgcaacggcgctggccgcacaagggttaaccgaaatcgcgattgtcggcagcgccatcaccaaggcagccgatccagtcgcaacggcacaacaatttatggaggcaatcaacgcatgaaagtcattccggatattatgacagaaatcaaccaagtcatggcactcgtcgatgaagatcaattagacgcgaccatgccctacctgaccaaggacaaacgcatcttcgtcatcggcgccggtcgcagcggttttcaggcaaaaggttttgccatgcgcctcatgcacattggctataccgactatgtgatgggcgaaaccattacgccgtccattcaaaaaggcgatacatgggtggcagtttccggctcgggcaccacaaaaagcatcgttgccgatactgaagcagccaagaaacttggcctcaacattgtggcctttaccagtgccgttgactcgccgctagccaaactcgctgatgcggtcgtgattgttcctggcgcaaccaaaaccggtgccggcgttaaatcaatccagctgctctcgactttgttcgaccaaaccgtccacatcaccttggatgccctcacattgaaattagctaaacgtgatgacaccagtaatgccgacgccttgcacgaacacgttaatgttgaataaatcatgattgttctagatttcaagctttgtttttcctagctttctaaaaagtgcccttaaattgcgcagttcatttggcaatttgagggcatttttgggcttgtgaatcccgccatggcaattatgtatccgttttcattgcttttcttccggaacgtgctagaattaagctttgctaaagagattacgtatttttaaacaaaacttttgtaactggacagctgttgttcgatgatacttgggtttcatgatcatgtgtctagaacgcagcggctgtcagttgaactttttttattatctcgcacattaaggcgttcgcagtcgtagaaatctccgtgtaaggaccttggtcgcaatggcctaagtccgggtccacgcccaaggccacttacaattcgatttctaagcgctcctgctcacgctcatcaggaggaaaccgtttatgaagcgcaggacgttgttttcgatcatcgtcgtcacgctagtcgcaggttgtttcacacttttttatggcgtgcacagcacctggaccgacacccaatcagcacacgccgttcaagcggctaccaatcaagttgataccttgttcaaagactcatcgcatcaactgcctgccgcggaacttagtcaggaaaaaattgctgctgccgaggccagtttacaagccgcacgccgcaaactcaccgagccggagcaggctaaccaactcgccagcgcccaagcagacgtcgatgccgccaagcaaatgctaactgtcaaaaatgcagtggcacaaaaaccaaccaaattgactgagttgaagacgttaacgagcgaatcgcagcaagcattagccaaactggccaaacaaaagccaacgttcgttcagacttatcaaaaacaggttgcccagctgtccgatcaagaagcggctgtggctaaagtcgccagcttatttactgacgccgattttaaagaacccaagtccggcttaagtaccagcgagattcaggctgccttggcagcactcaaacatattgacaaccagcaactgactgaccaaatgctgccggcgatcgccactgcccaacaagcagcttcggatgatacttccagcgctgaagcaagtgtatcgtcctcgacggtgccaagttcctcagcaagcggctccgagtcatctgccacgaacagtcagtcgacatcttctgcttcaagtaccagcaatgagtctaaccaaagccagcaggagtctagcaactcatcgtcagcaagttctgctagttcttcgagttcgcaagattaagctgcccaaaaagaaagaggctacgcgtaaaatagcgtgcggcctctttgtttttgctttgcgtttggaattgctgaacctcttaaactattaagcataatgaaaaataagaagaatacccacaacaaacaaaacaatttcgagaattatggaaaacctaacaatcatatcagcatcatgattgtttttgtctatcataatcttcttttgaaaggatgaatctccttttatcaattcatctaaggttagtcccaattcatcactaatcatgatgagctgttttatgttgggatatttacggccagattcccagattgcaacttgagtcaccgtcgtatgaactgatttcgctaactgatatctgcttaacgccattgcttcacgtttttgtttaattgaattcccaaaagacatatcatttccacctcttttgccgagattattttacattgtcttcgtcatacggtgttgagagcttatcgtaaggtaagaagccttgaatgatggaatttttgtcgaaaaaaaaagcgattaatcccaggtagataactttggccatcatgtctctccttcatctaaagaacatattcttcttgtgatattgtatgtataccagatgtggtaacagtgtacaggaccaaaagttttccagtcaaccctttttcgaaacgttcgttatagaataacggtgaccatcaaaaaaatcttttccaacatttggaaaagattttaagcgtttgtgttcaggtgtacatgctgtattgccgttacaaactaatatatcagagttttgagctttaatatttcaaaatcgctctgggtatccagctatgtttttcactttagagtaagactttttataacttctatttttttagcaagattgtcccagagcttgagcctcctttttaggccaagtaggggggttcgttagtttctctgctttataccgccaacttacccaccagttgcgtcaaataatcgataaaccgcaaataatccgcaatcgccacattctcatttggcccgtgcgctgccgagttggcattgccgatgccgcaggaaataatcggggcgtgattgatgtcgtaaaaatacttcatcgggccgctgcctggtgaatttaattcgatttgaacctcgtcatccccataagtcgccttggccagcgccactgcttcttgcacacgcgggtcgtctggatcggttcggaaaggcggctcgccgagaaaatccgatacaatgacgtcatcataaccgccggctgtcagtgccgctttgattaagcgcacggtctcggctggcgtttggttcggaaccagccgcaaatcgattttggccagcgccgtatgcggcaaaatcgttttaccgattcccgggccttcatacccgctcgaaaaaccgttgatcgtcatgctcggccgattatacaaagcttctttaatatcatcagccggcacggtcgccggacgcgtgatgccatagttcttagcaaaagccgcataatcaaagaccgcactgtcgatgagttgcttttgggtggtggtcaagggcttcacggcatcgagaaaatgcggaatcgtgatctcgtctttggcattcttcaaggtcgccagcgcctgcaccaagcgccatgccggattctcggtaatcgcgcccaagctggaatgaagatcaaaatcagccgtcttgacgctaagctgaaacgctacgccacctttgacgccaagcgaaatctgaaacttgccttgctcattgcggccgccggattcccacaaacaaaagtccgccgccaacaaatcagcatattgcttcaacaagtcttccaagtgcggactgccttgttcttccccaccttcaacaagaaacttaatcgtacaaggcaagccaccttgcgcttgtaaccgttggatggcagccaaccgcgcggctaattcgcctttgtcgtcattaatcccgcgagcatacaggtgtgtatccgtcatttttaactggaatggatcacttttccataaatccaagggttccgccggctgaacatcatagtgattatagaaaagtaacgtcggcgcatccgcggattgacccgggaaaaccgcgtaaaccgctggattcgccgcttcggtggttaagatccgactggtggtcgcgccaaatttggtaaattgttgctttaaaaaggcagctgtttcatcaatctcattgtcggtcgctaacgaaaccgaacgcaaccgcaaatactgagttaaaaatgcttgcatcggaagagtcattttcaagcctactctcttataaccttatttgaaatacgcatagcgatattcggccggttgcaacatgctgtagtgcaggccgccgactttggtattgatcaggcgactgttggcactttgaaagaccggaatgtagccagccacatcaattacgcgagcattagcggccagttcttgctgatagcgggccgttgaactttgaccggtggtggtgttgacttttttcatcaacgcggtgaattgctcatcgctaaacttcgaaaagttcgaaatgttatccgccgttgccgtgtttagataatctgacggatcctgaatcgttgagttccaactcatcaagaccgcgtcaaacttgccgtcaagcgatcgttgaatgcgcgtcatttttggcaggctgctgaccgtgactttcagctgtggcagcaccttggttagctgactctggatgtattcgccgacttgcttgtcagtatcaacatcggacgtgagaatcgaaaaactgatgctatcagtgttgagctctttcaacgccgccttgagatacgctttggccttggtcggcgaatatgtcagcggcgtcttggcatcttcagtaaagtctttgccggtcgttggattggttttaaggcccttaggtacaaatgctttagccggttgggagccatcctgcagaactttactggtgagtgcctgccgatcgagtgcagccgaaatggcacggcgcaagttgacgttattaagctgcggattcttggtattgagttgcagatagttcatattggcggccggtgtcttcgtcaaggccgggttttgcgcttctttttgaatcaagttgccagatagcggcgcatcgtctaacttgccagtcgcaaaaaggttatcgaccgtgctggaatctttcaaaacgttgacgtgaacgtgattgatcttgacggttttagccgcgtagaagttcggatctttcacatagtccccgctatcactagtggtgctgaaatttttaattttatacgcgccgttcgtcacaatcttgtcggcgcttgaaccgaatttcttaccataacgtttaaccgccgcttcattggtcgggtaataaccggtcatctgactggaaaaatagggtgttggctgactgagttggattttgagcacatatttgcttggggcggaaacgccaagggtatcgggtgactttttgccgtcgacgatatcctgataattggcaatggcatcatattggtacgcgaattcggttttggttttcggatccacaatccgcttgagtgaatagacaaaatccttggctgttaccggggtgccatcactccattttacatctttgcgcaacgtgagggtgtaggttttgccattgttggttggcttcacgaccttagtggccatggccggaatgattttgccggatttgtcatggtcgtacaatggcgtcatgatttgctgcagaatggcgccgctggtcgcatcgactgcgtgggccggatcaagggagctggcttcggtgctgacagcaacgtttagggcgcgttggttggtcgctgctttggttgattggccgcatgcggctagaagcaaggttagggtgatgcaggttagtcccagggcgttatactttttcattttgtgccacctcgtgaaagttttttggttggcgtgcttggcgttggagggggggtaaagttctccgatgctgttgcgcgccataacgcgttcactggcgcaggagccagttcacactcaacaaaaaaagaaaccgtccataacaaactcacttgttaaggacggtttcccgcggtgccaccttagtttgatcatgagactgcacctagggtttttgcccttggcagttaatgatcacgcttagcccggggccaacaccccggcgacaactgacgtatgccaacacgtttccccgtactcgatgatctttcgggggaaccctcagtggtccatttactgacttgcgttcggccggactctcagcagcgccggctctctgtgcgtgcaccatcagcttgatctccacttcaaaggtttgcatgaacggtttatttgattgacaccaacgttaaccgactgcctggttaattgtcaagcatctggccattaaataaccaaatagactaaaaataattttaatgggcgctcattcttgccgttatagtcaccacggctccttttcaatttggcaggggttgcattcatttagtaaaccccttatattacgaatatattaatgtgtaacaaaaaagattcaattcgtgacctgtttgcaatggttctgttaagtccagcccgtaccattaggttattggaggtggcatcaatgaaacagaaacatattttccaaatcctggtcggcactttgatcgctgggtacctgaccgttttctacgggatgcggagcacgatcgatacctcatttgcgcaacacgcggttcaagcggcaacgcaacaaaccaatcaactatacacatccgcaaagcgaactttcccagctaaacatttgtctaggtccgcggtaacttcaactcaggaaaagttgaagcaactagccaacaatgttgatgatcgcaagcaaaagaaaacgattctgaaagataaacaagacgctgatgcagccagttacatgttgacgattgaagaaaccacgaaggctcagagcagcaatctggctcaacttgccgaagatggttcacaggccaataaagcttacaaggccattgcgtcgactaagcctgaatttgccgctgattaccaacaatcagtcagtcagctttacagaaaatcgctggcaatttcccagattcagaaactctataaggatcaaaacctgcagcatcccaaatccgatctcagcagcagcagtgtcgacttagccgttaacgctgttgaaaatgtcgagaaccaggactttgccaaaaatgttttaccactggttcaagttgcccgtaagtcccaggaaagcagcgactcaaacgttgcgatgggtaacacgacatcaagcggtcaaagcacgcaaaagcaagacgcgactgccaccagttcggaaccggccagtggcgttggcaagaaggataacacatctagtcaggcaccgaccagcagcgccagtcagtccaaccaaaccgatcagtcctcctccgcggcgacaagtagcagttcctcaagcaagtcagacaatcagacgcaaccttcatccgacccgactgcttcaagtagtttggaaccgatgacgacggttctcagtggcggcctgtacaagacttatgatgacgctgtcgcagccatcaaagttcaaggcaagtctgttgatgatatgaccgtgaaatcagtgacgatgagtgatggttcttatcagtggacatggggcccaactggtgacagtggaagcagcagcaaaacgagcgcttcctcaagcaccagcagctctgcaccgaccacaagttctgataatgcccaatcatctagccaaaacaattaatcttaatgtctttttgagcgaactggagtcccaaaacgcggacttcagtttttttgtgcgcatcatccactgccaacatcttggctgacaaaccgtcatgttcttccgcgaattttcccacaagcggcgtagcatatcattcatgacgtctgttatgattggtgcagtgaggcttcatcaagacaaggaggttgcgcccatgccaaccattttcaatggagttccctggtacgatcaacaccagcaagtcgttaatgctgttggcggttgcttgattcaggaaagtggcaagttttatttattcggtgagtatcggcaagcagaatcgacggaattcgccggattctcgcgctatgtatcaaccgatttagaaaactggaccttcacgggacttgctttaccggttcagccgtctggtctattagggccgcatcgagtcggcgatcgggtcaaggttctccgcgcccaaaccggccagtatatcatgctcatgcacaccgatgatgaacgcactttcgatccggttgtcgcttacgccatggctgatcggctaaccgacacgttcacttttaagggtccactgcttttcaacaaccaatccattcgtatgtggcatattggcagtttcaccgacgatgatggtacgagttatttgctaacacatgaaggcgatatctatcggttagcggctgacggcacaaccgctgaggctaaaatcatcagcaacatcgcacccggaaccgaagcaccggcgatgtttcgctttcatgatcattatttcttgttggcatcccaaaagaccagctgggggcacaacgataacgtttatttttccgctgaccaattaaccggcccatggacagcacatggcccattttgtccgccgggaacgctgacgtataactcccaaactgccgatgtcgcgctaatacccacggccaaaggcatcgttcctttatacttaggcgatcggcacacttacccacatctagaaaatagtactcacgtttggctgcctttaagtgttcatgaaaccacattatccattccccactactggcctatatgggactggtaccaacaacgcgagcagcccatgacgtttacccccttggcttggaccggacagaccaatgatgcccggctgatgctcaagtttcatggcacgggtattacgataaccggacaatccggcacacatggcggttttgccaaaatgacgctgcgtgatgaagccggtcacatcaaatcccaggtatatacagacttttacagtcttctgcacgaggacgcgccgtgctatcgttcaccgactgagccgcttggccattatgaattaacgatcgaagcgctcggtgtgcacggtgattggtatgataaatcgcgccgccgttatggtagcaatggtaatcgtgtgacgatcaccggctatcatattgatcaccccacaaacaagcgcccaaaagccgtcattacatatcatgcttccaagcaaccatttacgcttaataaaatcggatttaactgggctcagtcagcgatagcccgacctgaaggcagcggcgattatcaatggttacagagtgatattggtgaaggcgaactgactatcggcgatcagcaaattaatttgcgcccggggcagggtattttgattaacctgaatacgagttacgcttatcatccagtgacatcgctttggcagacgagctatctcagtttcaatggtacgattctcgatgatctcatccctggactgaaaaccgcaagctcgcttttctttccagtgctgggaacagaagtactaggcttcattcatgaacatacacgttatcaacaggcgcatcgctatgaagacgatcaggatgcggcgattgtccaagactttttaaccaaattaaaaccttatactgcacgcttcaaagcagacccgaccaagcaagcattggccgagcagacattgagcctattgcaggaacattttcaagaagacctgacaaacgagcatctagccgaaatgaccaactacagtgtgcaatacatgctgcaaacgtttcatgatttataccaaaccacgccccgccggcttttgacgatctatcgggtgattcaggccaaacagctactcattgaacaacctgatttaccgctttcccaaattgcccgccaatcagggtttcattccgaaacttacatgattcgggcgtttaaacggcaggaacatttgacgccgggtgagtttcggacgattgcccatcagttgcggtcttaattcaaaacaattattggacaacgcaaaaaagccccgctgcgggctttttttgcgtgaatataattttgcatcgttaaaacgaacgtatttttaacacatcgctttaagtgccgcagtaatctgcggctcgtaaaacaatcgatacccatcagcattagggtgcgttcccgttccaccgacggcattgaggttatgcccgtcagcatcaagcttgtcataggaataatcatgttgataagcagggatgaaggcgttaaacccgctttgtgtgtacaggtccacgacagggatgctccatttgcgacaaatcgcaagcgaaacgtcatgcagcttttcttgggtcgctaaagtacgcgctggggttttgtgggtggtgatgtaaagtggatgcgcgccttgatacttagttaacaacgtgcggcatactgtctcgaacgcaccgcaataagtagccgtgtccagctcatcggcaaatccggtactgatgctgccaagaactttcggatcatcagtcacactggcataggcgtcattggcgataccgtcaaacacgatcaagtccggtactattttgggtgcctgcgtgacttgatgaacgatgttgatgactggatcttcattgggcaccacgcgcatcgtagcaccattaatggcgtacttgtgatagaccatgtggtgggctctggcgatgtcgtcgacaaaactttcgtgggcagcatggccttctacgatactggttccgaaagcgtataacatttttttattgaggggatcttgcatgttgggtttcctttctgtttggttgttgtacccgtaatattagtgttaataaaaaatgcctaacaactctgggagtagaagttgttaggcatctataacgatctaagcgaattcagtgagcttgaaaaatggcttctgctggacaacatcacctccttaaaagatgcaatttagaatccattaagctttcgttgatggatcattaggtgttgccggctgttgatcgttgcgacgccagaattcaattgaatcatatggcacaccggtcaactgttcgcaaacccgtttggtatccggcttaacgtctttcatgctgccgcctttttgcagacgggttaattcagcagccaacacattgaatgtcttcttgctgagatggaaccggctagcaaagaacatcgcgattaagatcatgatgcccacgccgccagaaacaatgaacaagatcatatttgtcgcacttgcaggctgcgaaaccgcaccgcttgtggactgacggaaaccggcaacatcaagcagatagccagcaaccactgaagccaagccctgactgatttggttgatgaagaccatgaccgaagcgaataatccggcacgatttttaccagtgaccaaggtgtccacatcaggaatgaatgggaagacattccacggaacaaagtatagaatgtacaaaccaatttcataaagcaaagtaccaacaatcagccagaccatgacgcctgcaggtttggttaacccgataaacgcccaatcaatgacactgatcaagatcaatgaataaccaaacagatacagtgcgcgcggtgaaattttcgtgacgatataaccggctaaaatcgtaaccggaactgagacgatactcaacgattgcaacattccggaaacacttgttgttttaccaacaacaaagacaatgtagtaaacaaacgttgtggaccacagaatagaagcaaagtaagaactcagataaatgcccatgtgtgtccggaaactcttaattttgaatgtggagaagtagttccgaatttcggacttgaacgaactcttcttgccgccattatcttcaagcgcttgagcctgcagcttcttcgcttcgtttttagtaacgaagtgttcccaagtggtcttataagtaaccaagatcaagaagaaggtaacaattgagaacatgatctgcataatcaaatatggtgtcggtgacgtctttggatagaaccggaacaattgggcaggaacgaattgtgctaacatgttacccaaaccggcaatgaccatccggacggttgacatcgtggtccgctgattgtaatccttggtcatttcgtttggcagtgtttcccaagggatctggagcactgacattaaaacagtggtaatcacataagtaatcagatagtaccagtaactcattccagcaacccagagcgtaatcgcgaataatacggatggcgctgcggctagaataaagatatgacgccgaccaaaccggcggccaatcttgtacttgtaaatgttatcggaaatattacccataaccagcgaggcaatcgcatcagcgacacgaccaattaggaaaatggtcgcaccttgacctgctgacaaaccgcaaaacgtggtatagaagaacagtagccatgcaccaactaacccctgcatggaaatactgaacatcgaaaaaacaccgaatcctagtgaccggccgataccgatctttttgccacgcgaatggtaaattttcttcgaggcgaattcgtcccaaccatcgtggacaacggcttttttattttccattgttttttcctctttcacactttcaatttattatttttcatcaatcaattgttcgcgcaatttcttggcaatttgatcatctgaaagcgccagatgggtattcgacaaaagcataacccgtgcatctgccggttccatcaagtacttgcgttcccattgatcttcatccggaccgtcacccaaaacccgtagatacgagcgcaggcgccgtaacttaatcgcattcagctcaatgtttgagtatgcatcgttgtggaagaaatcaacccacttaggggacggattatcgcgccgcaaccgcatgatcgcatcgttggctcgaaccgcttcatcggcacccaggaaagcatgcacgatttcggcattttggtagtggcgataagcttcaatgctggcacgcaaggcatgcaacgagcaggcgtgaacggcaatgcccatcagcatatcgttgtagaaaagccgttgcggttgctggcccatgatatcggcgtaaacttgggaagcacgtcgatacaaatgatcccatgcggcgtatttggtatcaattaattgcgtgattttggtaagttgctcatcaagagacacatcgccggttaaccagttcatctgctcaagctgcggataatgacccatccatgctttaacgactttccggatgagatacggggcaaattcatcgccggctttttgatcatcatgcggaccatattggataggcgacttgaaataatcttcataaatgtcagtaatctctttttgcgcctcagaataataatgattgacatagtctttgataatctcgtcttcgctgcgaacttggaaatcacggcgccacgagcgggcaacttcgcgaatgaataaaatgtgcggcttgacattgccgacgttgattaattccaaagtgtccatgtcggctttcctgactttttcaagctctgccgcgacaaaatgtgggctattcggcaataatgtcaaaaagctggatgcctgcaaatcatggaaagtcacatgataataaatgccgcgggcacgatgcgccttgttaggaatcgtcagaaccggtgaccgcggatcatcatcccattgccggcgtgataccattttgccatagccgttgtcggcccagatctcaatgacatcttgcggcagcttcagtaaaccttgattgaacaaaccggttaactcgccataaatgctgactgaacattgtgcgccaggatcgagttcctgcaccatgtcgtattgaagcttgatggtgtcattgatgacctttgccttttcctcatccgtccatttgtgcgtcgtatcgtctgcccagaatggccggtcgccttggccgcggaaccctaagccgtaaacgacttcatggccgcgttgttccaaaatactgtcgttccagagcttcttaaagagttccggatacttaagatacgaagcttcaagattcggataaacccgggcaaacatctccgcgccaagtggttcagcatgatgatgcgcaataatcaagcccatatcccgcgcaccggcacgatggaaccgactctctttgtcggtaccgggtacgatcaggttgccaccaacccgcagcaacgtttcgtaaatccgatcccacacatattcttttgaatcatgatcctgccagtctgcgatcaggagttcatcattaacaaaccagccgcggtatttagtctgaaaatcaggcaactgttggctgaaatcagaccaggtgacgcttgcctgcttcttaatcggcgtatccatgaaataccagaagtcatcaatgcctaggacttcacgggaaacagccagcgcgccatacatcaacccgcgagtagtagccgcggtaatttcaactttctgtggatcaacataatgcattgcaaatgcatcaggtactttctgatcggcctttggttgcaacaccaagtcaatctgattggtatcggcttgtgaagtcgttaccttttgaatatcccgctgtaaaatattgacggcattcttcaaaaccggatccgccatattgtcagtcgagacacttgtatttctggaaattacaaatgtttgatttgccatacacaactccttctctcgatgaaaccagctaaaaaacttaacactgcaagcacccgttgtcataaggcactcgccaacttctgtgatctgatatattaaaaccttaattacaagatgattgtagcgcttgcagtaaccgcttccaataaactactttctgcaaccattgaactggttactgttgtgtgagcgtgagcatgagcgcttagacgccggagtgtaagtggccttgggcgtgatggctgggttttggccattgcgaccaaggtccttacacgcaggcttctgcgaatgcgaacgcgttatagaaagcggcagttcaacacccaattgccaacaatagaaaaagcgctgagcgtgagccggcgcgcttagaagtcggagtgtaagtggccttgggcgtgatggcccgggcttaggccattgcgaacaaggtccttacacgcagatttctgcgccggcgaacgcgttatagaacacgacagtccaacaacaccccaattgccaacaatagaaaaagctgcctccatacttcccccaccgcaaaacctctcgcccacccaacacaaaaacctaacccaaaacaaaaacctaacccaaaacaaaaaagccaaccgcctccgcgaataatcgcgaaaccgattggcctttcaacatatatatactgctaaaatctataatttcctatcaaacaactcttaagcccgagcttctgcccgaaccggatcgaccaaagcctgacgatgcaagccattccgagcacgcagcgcgtacaaaatggtaaccgtatcaacgacttcctgcaacatcgcgccaatgatcgttgggataactccgaaactggcgatgaccatcaacccggtacaaatcgcaatcccgatgagcacggactgcttggcgatgaccatagtttccttggcaatcaaggttgccgcagcgaccttagccaaatcgtcacgtaacacaacggcatcggcagattcactggccgccgttgcgccatgtgcccccatggcaattccgacatcggcaatcgccaatgatggggcatcgttaacgccatcgccaaccatgacaaccggccggccacttttaggcagtttatccaacacttcgattttctgttgtggcaactgctcagcataaacctggtcaataccgacttcttcagcaactttatcagcaatcgactgctggtcaccggaaatcatgatcaagttagcatcattcagttcgtgcagcttggacatcgtttcttttgcttccggccgaatctggtcagagaaggtaatggcgccggcgtatttaccgtcaacgttgacataaaccgccgtcgtattgatggtatccgttgtcccggcaaactctgctttaccgaccttaaccttgtggccgtcaaccgtcgcattcaccccgaaactggtggcttcggaaacatcggtcgctggcagacggtcagcaaccggcacagcatcggtcagggaccgcgccaaaatgtgggttgactgaccttctgcgctcgccgccaagttcaacaattcatcttgtgagaaacctgcttgtggcaagatcgccgccacttttaaaataccgcgcgtcaccgtaccggttttatcaaacgcaaacgtccgggcatcactaagtttttcaagtgtggtgcctgacttgacgataatcccgttacgactgttgcggctcatgccggagaccatcgcaatcggtgccgccaaaatcagcggacatggcgaagcaacaacgagcacttgggcaaaccgaaccggatcgcctgacaagtaccagcctagaccggcaatcacataagcgatcaaagtgaacggtaccgcatagcgatcggccatccggacaaaatgcgccggccgtgcttctgattccttaactaatttgataatcccttgatactgactatcttcggcacgctgggtaactttaacggttaacgcagcatcaccgttaattgtcccggacatgatatccgtacctgcgtttttggcaactggtttagactcaccggttaaactggcttcatcgaccaaactctcgcctgccaaaaccgtaccatcgactggaacaacttcccgcggcttaaccaagatcgtttcaccgacttggaccgcatcaacatcaacatcttcaacgtgaccatcaaccatccgatgagccgttgtcggtgcattttccaacaactgtttcaattcgctgctggcttttgtcgcagcaaaatcttccagcgcatcgccaccggttaacatgagcaacacaatcatcgatgcccagtactgaccgactgccaacgttgcgacaaccgccgtaatggctaataagtccaccccaaagttaccggaccgaattgttttcaccatgcccccgaacataatcaaggcgataatcgaccccatcaccgtgattagcccctgagcaatcaatggctgttttaatacgaacgcaaagaccagcgcaacggcacttacagcgagcaccatcattaactgccagttcttcttcattgttgccactcccttttcctaagtaccttaattataaccattacaatctgaaaaagcaatcctttttagaacgaatataatctggcttggaaaatgtttttcacgcaacgcccaattcagcttggactaacttactgggaaagatcccgttaacaccgcgcccttttgccgctttaacggtaatgatgtacccggtttattttttggcatccctaatatttaccttccattatacgcctttgcaggtaaaagattcgcggattgaagcttatttgtgcgtcaatttcacatgggattgggaatggttcgaaagaatccgctgccaagatggtctctgaatcttatacgtgacacttctgctttcgataacgcgctccccggcgcaggggtcggctcacgctcacacgaaaaaaagattcccaccggtttcccgatgagaatctttgtcgtgacttgtgttgctaggcaaacagattcgaattagtcaatcgtgatctgatggcttccttcttgatcgcctgtcaacttaggcagatcaatcgtcaagacaccatcagtgactttagcgctgatcttaccctcatcaacatttggcaaccgatagctgcggctcatccgaccatagctgcgttcagacatcagcatattgccttcgttgtctgaatgatcggcttgctcttcatgcttaaccgcaacactcagaatgccatgatcgtaactcagattaatgtttggcttctcgataccgggaacatctaccttcacaacatatgacttgtcattttcctgaatatccgttttcagcaggcgactgctatcaccgccacgactcggcgtgaagctgtcaaaaatatgccgtcctaaatcattgaagaatggatcatccaaccaatcattgcgccgcataagatcattagccatcatcgaaaacttcctttcaatatagtgagcgtgagcaggagcgcttagaaatcggagtgtaagcggcttcagacgtgaatggctgaactttggccatttacgtctgaagtccttacacggagatttctgcgactgcgaacgcgttatggacattgacgtcattgctgttcccttagaacacataaagtataacacaaaaattagcactcgtcatgcacgagtgctaatttttgttcttctaacctttgctaactcacagtttctgctcttggaactcgcaacaacgatccgctatttagcaaatcttgccgcccaaggatttcatttcttcacgccgcttgtcatcggattgcggttttgccgtcacgtggttcagtgtcaccgcgccgtccaaaatgccgctatcatcgcgcaaagctaacgaagcattcttgaaatcaagcgttagcccgctgccgaaataatctgtctccggatcaccggtcgtcaagttgaaaccggcgtcgttttctagcggcagtgcataatcctgatcgtccgtatccgtcacgacaatttggtacttattgccaatggcacaggaaccgcctaatttggaatacttactcgaaccatcatccaatgccaggaacaaatgttgatccttggcaacatggttgttcaaataagtcaccgcagctggtttgatcgtgatcttcatgttggaccatcctttcaaatacattgtgcacaacttatttaccatctttatggtatccagtttgtccccagaagtcaaattccgagtttttcgcaatcaacaacaggttgtccacacgggttatccacatgtgcgtaacttgacacccaaaatatagtatgaagaactggaattgacaccaaatagacgattcgaaaaattcaagtaaaaaatttttcgaacgcagtcatccacagtttttaatcgttcgatttcacaaacttcagcgcaccaatcccgctcccatggctgggaacaaacgttttgtcacaagtaaaaaaagtttatccacaagttatccccagatcggtggacaacttaatcacacccgaaaatcttagttatgaacagtatccacagagttatccacaggtcaatgagcacttttaccaaaaagttacccactcttgacaaaactttttcttgaacttttccacaggttattcgctaaactttcgttaaaatttgggaaaccgcttccgactaactacgcaaatgaatctaaaaaatccccgaccaagaaccgaacattctcaatcggggattttctaatttaattctttaaatcgctggtcgtctgggtcagtttaaacgaaacggtttgttgctgaccttcgcgatacacggtgagcttaatcgtatcgccaaccttgtgcttatacagttgtgtgtgtaactcagctgtgttggtaacattgacaccatccagtgcggtaatgacatcatacttcttcatccccgcgtttttggcgctgctgccactggtaaaaccggcaaccacgacgccaccggtgatgctagatggcaatttcaggactgacttttgctgtgtggcagaaacggtggataagtcgcgaacctcaacgccaagcgctggccgaacgactttgccgttttgtacaagctggttgatgatcgaaaccacttcgtcacttggaattgcgaagcccatgccttcgatcgtggcactatcagaactgctgctggaactgccggatagcttcattgagttaatcccgacgacctgcccggctaagttaatcagcgggccaccggaattccctgagttaatcgcggcatcggtctgaataaccgttgcctggccggttgtattgccgttactgtccgtgacatcaatcgttcggctcttggcactaacaatcccctgggtcacactggtcgcgtattgtgaacccagcggcgagccaatcgctaagacagtctgtccagctgcaatcttacttgaatcgccaaaacttgcgacggtggtgaccttgctgccatcaatcgtcagaaccgctaagtcagacgtcgaatcggttccgactaagctagccgtcaacttggtgccatcgcttaaaatgacttcaagtttatccgaaccgctaaccacgtgattattcgtgacaatataggctttgccgtctttcttttggtaaatcacaccagaaccttcgctggcttcttcaaggcttgaagagctgttactcgaactgctgctactttgttggttaccttgaccaaaaataccttcaaggccgccaaaagtgtcaaggccatcgctgttactttcggctttttgcatattcacaacggaaacaacggcacctttgactttagcaaaagcctgctccgatgcgctgctttggttaaccgagacattagagattttcgtcgtccctgccttgccggaagtatcggtcacgccaagactggcattgtggttcatcgcccagtaggcggttccgccaccaacaccgccaccgatcaaagcagcaaccaccgccacaatcgcaatcagtttccagccgctattcttcggcttcttcgacccccgttgcggttgctgatcttgtggtgtctcttgaaagttatgacttccattatccataacttgatcctccttgtgggcaattctaactcaccctgtttacaatcattattgtaagtggcgattttgacgaaattatgaacaacatagggcttttttaaatcaacgcagaccggtaataaaaaagcggccaaccctatgcacaagtcgtctgctttttcctaccaactgctatccgaaacactgcaccaatcatctcacacaacaaacaatggatcggcaatggccggatcagtatcataaagatgaaaatcgtgatcgaccgcgagcccttgttgtgccaataacgaggcaacggttaaatgagccagcggtttattattattatgtggcgatagatgtccgagataaattcgcttggtgcgcaagccaatcacatccatcaacgcatcggcaccgtcctcattggacaaatgcccttgatcgctcaaaattcgttgcttcaacggccatggatacggaccggtccgcaacatctcaaggtcatgattacattccatcacataagcatcagcatcgcgaatcgtcccggccacccgatccgacacataaccggtatcagtcaggatcgtgaaggttttgccatcatggtgaaattgataaaactgtggcgccgcagcatcatgcgaaacgccaaagctttcaacatccagatcgcctaaagtcagcgtggcccccatatcaaaaagccgcaactgatcttctggaatcttaccgacacttttcggtaacgccgcaaacgttttggcgttggcgtacacactaatttgcggataacgtcgcgccaaaacgccgacaccgcgcacatgatcgctatgttcatgcgtgatgaaaacactgtccacatcggtcagatcccgcccgatgctttgcatgagcttttcaattttcttgccggacaagccagcatcaaccagcaccttgtgaccaggcgtttcaatgtaggttgcgttaccggaactgctactggcaaggacactgacacgcatcccaaaatcttcgcccacgatcaacatctcccaactttaccattcggctgactacctaatttggcacccagccgttatcgctttacattctaacactaattgtcactgcgattcttcataaccgttcgcgtaatcgcattgacacgtttgaccgtcacatttccggttgcccgatttttaacgccaatgtaccaggcgggcacataaaccgtgctgccttttgcatcgagtagataactataagctaacttggtcgaaacaatcgccgaattgtttggaatgtcgttgtcccgatacagggcgattacggcgtcctgctcactcattaaattcaagcgatctcgtaacacgctcaacttggacaggtaggtctgtgtgtagcttaccaggcgattatcgttaacatgtaaagtgaccgctgcacgccgatcataaattaacccggctttaggatgctgagcaaagacgattcgctcatcgttagaaagcgccggcgcatattcgtactctttgccgtgatagacgttgtttttaacaaatgttgccagctgctgttgttcctggtttttcttcagggtaatcggctcatccaaactcgcctgtagctcttgatagtcgccttcgctaattgtcacctgctgcttcaccagcagactgcgcgccgctgacaaggcggtgttggcttggctggcaaggtaatcgccttgaggtgtctttttgcttaaatgcggcaacttaatctgatcgcgggtaatatcggtaatcgtcgccgcatccccgctcttaatcgtcgccagatcgacttgctgcgcctgaaaatagctgatgcccagaaaaatattcaagccaacgaagacaaccagaaagatccattcaattcgtcgaaaatccacagtactcgcctcctaagctgagcgtgaaccagcccggttagaaaccggagtgtaggccttcagtcactgcgacgcccccgaatcactcgaactgccagctgccgcattattacttggggttgccgtttggctgctagcagcactggcagaagaagcactgctatgattcagccaactttgatagtcgcgatactcgcccttcatctcgacataataagtcggctgcagatcaaccacctgctgatcattactgctgccggtccactgatagccaatcagaatatccgtaatctgactcgcccggtaacctgccgccaccaactgattcacgatagtagcagttgccggcaaggtttgcgcaggctggttcgtcggaatcggcaccgtcaaattggtattggaaaagttaatctcctcagatgtctgtgtataccgaaccgtcacatcgcctttttgatcggcattaaaaatcgggaacccttgcgcatacgttttataaatgacagaaccgcgactcgcatcatactggaaataccgcatgctggacagattcgtcatctgcaaggcactaagccctttgaatgttgcatggaagaaattagctaggccattattgggaaaggctgccgcataattttcaaactcaatggccccggtcgtcgaatcagcggtcatccggcgggttgatccggccgtatacagcgtactatcaccgatttcacgggcatccacattgctggctgtcttagacggcatcaacaaggaaacataataattggcactttgttgatccatcaaatacgcatacggctgcaacttaatcggctgggtgaaaaaggcaacctcattaccgctcaaccgtttttcttcaattgggaaagccttggtggaacgctttttaacaagattttctaactgcccggtcgtcacattcgttagcttcgcttcataaaccgtgcgcgttgcgtcattaatgaacgtcagacgattagcaccggtctccagattcaacaggatgcgattaaaatgaaagtctgatgacttgaggtttggctgtttgttgaaataccactgttcaaactgcttaaagctcatcacatcttggtaaatcagctgtaaactgtcgtcctgctgcaaataattgtcatagttagtcgaagaaaccttgccaatcgttttgattttcgtcatgtgccaatcagccatggtttggcgtacttgccgacccatattcgcgttggcttccatcagcaactgcttctgcccgccatgcgtgtagtaaacctgattcggcagataaatagtgccttccagttttttaacgttcggatcgttctcagtcgtcacctgcacattcgatgtgttccgtcgctcctgccgtgaagggtttcgccaaattagcgacgtgaagacgaagctcaagatgaccatggcaatcaggctgacccgtaaaatccaattactaagcttcatcccagtcatcccctccgtctgtgatcggttcgtaaggcaatgaaatatagaaggtactgccgcgaccctcttgggaatcaacccagatgcggccatgcaaggcttcgacaacttccttggaaattgccaagcctaagccggtgccgccttgtttgcgtgagcgcgccttgtcgacccgatagaagcggtcgaaaattttgcccagatcctggcgcggaatacccagaccctggtcgctgatggacaaaatcacgtggtcatgcgtctggaacagccgagccgtgatcacaccgccatccggactgtacttaatcgcgttattcataatgttatcgatcacttgcatgaacttatcggtatcaatttcaacccaaagatcttcattggtaatttcccgtttaatcgaatagcgtttcttatggccatcaggctgcggcaacggctgggccgttcgcgcctcaccagtgtgttcgttgtcggtcttgagcatcatgtcaaagcgatccagtacataattgaagaattcgttgagattaacggtttccagattaaacttactggtgccggagtccagtcgggacagactcagcaggtcattaatcattcgaatcatgcgatccgtttcctcttgggtcacgttcagaaaacgcggtgccaacttcggatctttccaggcaccatcactcaaagcttcgatataactgcgtaccgatgtcagtggcgtccgcaactcatgcgagacattcgagacaaattccttacgatcacgatcaatcttttgctgctcggtaacatcatgcaaaaccgcaaccaagccagaaataaaaccggtttcgcgttgaatcaggctaaagtcgacccgcagaatcaggtcatgatccattttttccgaaaaatcgagtaacaactcggtttggtgttccagcaaatcacgtaaggtgtaatccttggcaatgttgagcagtttcaaaatcgagacgccgatgacatcctcatttttggtgttgaggaagttcaaggctgtctggttgatgataatgacgttaccacggcgatccgtcgcaatcacgccatcggtcatatgcgccagcacactgtccaagcgccggcgctccgcctcagatgcttcctgggcttcttcaacccggacactcagattattgaccgcaaccgccaattggccgagttcatcctgaccataaatccgtacttgcccggaatagtcaccgcgggccatgcgaatcgcctgcttcttcatttcgtcaattggccgggtaattgcccggctaatgacaatcgaaagcagtgtacccagtaaaccggcaaccaaactggaaatcaggaaaatgccgacaatcttattgatgctgtcataggcctgttccatggatgccgaaatcgcaatcgcgccgatgaccgagttgttgtcaccggtggcattcggattcttaattggaatcactttgtaataagtcgaaccggttcgatcgcgatactcataaccttcatactgttggcctgagtacagcgtatttttaatgttggaattagccgacttctggcctacattggtctgggcattaatgtcactgtcgccgcgaatcgtcccttttgaatccaccacttgtaaatcagctgagttggcaatatctgcttggctcagcgtgcttttgatatcatcattggcattatccgtatcagtgcgcaacaaatccgcggccagtttatcctgaatatagctgtccacgttcacactggttttaaactgctcgatgttttgttgctccagggtcttcacaaaataggccccgatcatttccagcgtcacgaccagcaaaagaataaagacgatcgcgattttaaaatgaatcgactgaaagaagcgaatctttttattcaacagtgctgctcctaattattcagcatcaggattccgcaaataatagccaacgccgcgccgggtcaccagccattccggatgggacggattatcctcgattttttcgcgcaaccgccgaacggtcacgtcaactgtccggacatcaccaaaataatcatagccccagacggtttgtagtaagtgttcccgggtcataacttggcccaagtggcgcgccaaataatgcagcaattcaaattcgcgatgcgtcagttcgatattctcaccacgtttcgaaaccgtgtacgcatctggatgaatcgtcagatcaccgacttgcagttcgcgattggcctcatcctcttcgttattggcggcgcttgatgctgaggttcgccgcaaattggctttcacgcgcgcgactaactcacgattggaaaatggtttggtgacataatcatccgcgccgagttccaatcccaaaaccttgtcaatttcggaatcttttgcggtcagcataataatcggtgtgtcatgttctttacgaatttgtcgggcgacttcaagcccatcgattttcggtaacatcaggtcaagtaaaatcaaatcgggtgattctgattcaactttctttaaggcttcttcgccatcataagcggttacgacatcgtaaccttctttatccaaattaaacttgacgatatctgagattggcttctcatcgtcaacgaccaagatttttttcgccatcatcggccctccttggtttaagatactcttctatagtataacggttttgtaagacgagtgcgacccgcctgctgtgtggcagcggcaactcgcgtcaaagccgcttctgtcgcttgttttgccctatctttaaatttcgcaaaagttgacgtctagcccttgttttgggaggaatgcgccggctcacgctcactttctctggaggttattatatgttcttctatcacaacgatctaaaactctactatcacaaaagcgggcacgggccggcgattattttgctgcatggcaacggcgaggatcatacgatttttagcgacttgatcacttacctagcgccgcattataccgtgattgcgcttgatagtcgtgaccacggccagagcacccgcacggatcagcttagttatgatgccatgacggaagatgtcgccgcgttgatcagcgagttgtcgctgcaacggccgatcattcttgggttttcggatggtggcattatcgctttgctgttggcgattcgccatccgaagttagtgggtgccttgattgtagccggtgccaacctgacgcctcaagggttgcggtggtattcccggattctttttcggattgctgccgggcatcgaccttcgcctaagctggccatgatgctccacgaaccgcaaattacgccagccatgttgcacaccatttccgtgccgacgctggtgctggccggtagtcgcgacctgattgcccgcaaagagactttcacgattgcgacgcatattcaaaatgccgaactgcatatcctccccggcgaaacccacaactcctacattcgcgataataccaagctttggcacctcatctccccgttcttggctggacttcgggcaactggctaaaaatgaattaattttgcatatttaacattttccttgcatattcattgaaatgagtatatattcagtccataatcattagcgaggagtgaattatatgcggggaatcaaacattgggcagttgccatcgttgcacttttagccatgttcatcggcttcaccgttcagcaaccgacaccaacggcagctgccggcgatgatctggcagcgatccaaaagcgcggctatctgatcgttggcttgtctgccgattatgcccccttagagttccatgcaacattgaatggggctgataccatcgtcggcgctgatatttccatgtccaaacagatcgccaaggatatgggcgtgaaactgcaaatcaaagaaatgaatttcaccgccctgatcggcgcactgaagaccggcaaaatcgatttgattgtctccggtatgtccaaaacgccggaacgggaaaaagaagttaatttctcgcaaccatacctgtacgaaactcaggtcatggtgattcgcaaagccgataaagccaagtataaatcaatcgccgacttttccggtaagcgggttggcgcgcagaaacaaaccacccaggagcaattagccaaaacccaactgcctggcgcaaaggtcacaagtctcgacaaggccaatgatgtcatcgcccagatttcttacaacaaattggacgccggcgtcatggcgagcaccattgctgattcatatgtggcccgtacgccgagcctgatggtgttggatccgcattttgccaccgacaaagcgccgactgccattgcggttaacaagcagtcgccggcactccttgcacaagtcaacaagaccatcagcaaggtcaaaggcgccaagtataagcagtatttgcaagcggcttacaagctgcaggatcagaatcagggtttctgggctaaatacggaaactacttcatccgcggcgcgatttataccttgattttcgcggcgttaaccgtcttcttcggcaccatcatcggtaccttgctggcgttgatgaagctcagccgcaattggctcgccaaggccatcgccaatgtctacatcgaattcattcgcggcacgccattactggtccaagcgttcatcgttttcttcggcacgcagattctcggattggatctcagcgccttcattgccggtgcgatcgcgatggccatcaactccggtgcctatgttgccgaaatcatccggggcgggatcaactctgtcccggttgggcaaaccgaagcggcccgttcgctggggctgcaccaacgccaggcgatgcgctacgtgattttaccgcaagccatgaagaacatctggccggcgctcgggaacgaatttgtcaccgatatcaaggaaagctcagtgctatccgtcattggcgccaccgaattaatgtttgaaggcacggtcgttcaaggcgcttcgttcaagccgttcctaccgctggtggtcgtcgccatcttctacttcatcatgaccttcaccttgtcgcgtttgttacgtttaatcgaaaaacggtttaactaaaataaaaaaggagatattcacacatgacagaaaaaattgtattagcttactcaggcggtcttgacacatccgttgcgattccttggttgatggataaaggatacgaggtcatcgccgtggttttaaacgtcggccagccggatgccgattttgacgcgattcagcaaaaggcgcttaaagtcggggcgattgattcaatcgtcgttgatgcgcaagacgaatttgccgatcactatgtcgcgccggtcatcaaggctaatgcattatatgaaggcgactatccccttgtctcagcgttatcccgtcctttgatcattgaacatctggtcaaaattgcccaccagcaaaacgccacggccatcgcccacggttcaaccggcaaaggcaatgatcaggtccgttttgaagcggcaattcacgccttggatcccgatatgaaaatcgaagcaccgattcgcgattttcactggtcacgcgaagaagaaatcgactacgcaaaagagcacaacgttccggtaccgatcggcaaagcatccccctattccattgatgccaatctctggggtcgcgccaatgaagccggtattctcgagaatccttggaatcaagcgcctgatgatgcttggggcatgaccgttgctccagaagaagcccctgacgaaccgacttttcttgatctgaccttcgaacagggtgtgccggtcgccttaaatgacgagcacatgccgctggccgctatgatcaaaaagctcaatcaaattgccggcgcaaacggcatcggtcgaattgacaaaatcgaaaaccggcttgtcggtatcaagtcccgcgaagtttacgaagccccagccgctgccgtcatcatggccgcccaccacgacttagaaaatctgacgctcgaacgcgacgtgcaacacttcaagccaacgatcgaaaacaaactcacgaacatgatttacgaagctcagtggatttcacctttgttcgacgccttaatggccttcatcgatcagacgcaagcggttgtcaacgggacggtcaaaatgaagctttacaaaggcaatgctgtcgctgttgcccgcaagtccgcgcataactcactctacgacgaagatctggccacctacaccagcgccgactccttcgatcaggaagcagcagccggcttcatcaaactctggactctgccgaccaccgttttcgagcaggtcaaccacgttcactccgaggaaaagcaacatgactgataaactatggggcgggcgcttcaccgaaaaagccgcgcactgggtcgatgctttcggcgcctccatcggttttgaccaacaaatggctaaagaggatctggaaggttccttagcccacgtcaaaatgttagggaaaaccggcatcatcccacaaagtgatgcagacaaaattactgccggcctgcaccatctgcaaaaagaactggccgccgggaaattgcattttaccgtggagaatgaagacatccacctcaacatggaggctttgctcactgccgaaatcggcccggttgccggcaagctgcacacagcacgctcccgcaatgaccaggttgccaccgatttacacctctggctcaagcatcgtctgccggaaatcaaagaagccttgaccaatttacaaacggttttggtcggtcaagccaaagtccacgccgccacgatcatgcctggctacacccacatgcagcacgctcagccgatcacctatggccattatttgttggcgtatttcgaaatgttccagcgtgactgggaacgtttcgactttacccaaaagcacaccgacatcttgccattaggtgcggctgcgttggctggcaccaccttcccgattgatcgcacattggtcgcgaaagaacttggctttgatcagctgtaccataacagcttggacgccgtatccgaccgggacttcgcacttgaatttctcagcaacagtgccattttgatgcaacatctaagtaggatggccgaagaactgatcttgtggtccacatttgagttcaactacatcgagctcggcgatgatttttccactggcagttcgattatgccgcaaaagaaaaacccggacttcgccgaactcattcgcggtaaaaccggacgggtgtatggtgctctaatgggactgctcaccaccatgaaggcgatcccgctggcctataacaaggacatgcaggaagacaaggagccgatttttgacacctacaacaccattctcggttcgctgcatattttcaccggcatgctaagcgatctcaccgtgcacgaaaagcgcatggcccaagccaccacccacgacttcagcaacgcaaccgaactcgccgactacctggccacaaaaggcgttcctttccgccaggcacacgccatcgtcggtgaactcgtgctaaaaggcatcaaatccggcaccgccctgcaggaaatgccactaagcgagctccaacaggccgctccgcaaatcgaaaacgacgtctacgccgaactcacctccaaagtcgccgtcaatcgccgcacgtcactaggcggcaccgccgtcagcaacgtcttgaaagaggtggcccgggatgaaaaaatcattgcggcacatgagaagaagcaagcacaataacttgatacgtcaggttattatcaagacttttgctggtgtcttgcattaagtggaacataattaacggtcaaaataaaaagcgaaggtgcttcccaaaaaatcggaagtgccttcgcttttgtttacgggaaaataatctgtggggaacattaagaccctagtgccaaagcggagcaatcgtaggccagatggggctcagcagtggaattgttgttggtggggcgctttttgccccgcctacaacaaggccgagcttcgaaaccgcggtctttgcgggttcgaagtcgtgcccaccactctagcttcgcggtcgccatcccacatctggccggagattgcggagtttggcacgactcggaacaaattgcctaagtttttacctcaattactcaacttctccaacacaaacgtcgaccaaggtttaaccaaatccaaaaagccaaggtcgtccgcacagatgcggccgatccgattccgctggccgtcatccttaaatggagccaaaacgacttgcagctcgcctttgtaccggccatatgccgagttcacaactaagatgtccccccgctcaaatgattggccgttgtcatgagcggggacatctgccgcactgtacgtgatgcgcggctgggtatcccgcagcagataggctgaagcatccccgcgataaagatgcggcgcggcaaaggcaattttttcctcagtcggcgtcatgttggctgacatctcggcatgcagcacaggatatggcgtcaaaaaagttgcggcgactgccttaagttccgcttcactagcaaacgcgttaccgatgatcacgtcatcaatctgacccgtcagcaccaaatggctggtttgactgacaatatcccgatgccgatcactttccatcgtcggcaggccgtcatgaatcggccagggaccgatttttccgttagccgacgacacaaacgccgctgtgtgtaacccataatggcggtattgctgcgagtattcggtaaaaatggcatcactcaacccggtaaaggcttgcggataaaagttatggcagccgattaggttatcgcgatcgggatcataggacatgatactcgccagataattggtcccccggctcatattcagttcgatttttaagccataaggattgtgcgtcatccgtgcttcttctgccccagtgaagccttcatccagccgcagtccccaaacatggaggttctcgaaaaaacttagatcatcataactgatcttcaattccttgaacaacgccggattgatatccacgatcgtcttaaacccaagctggttagcataatcaatcgtttggctaaactttgccaacaaatcctccccgtctttgcccgaaagctgcaaaagcgaggtgaatatacggctataaccataatgatgggccagatcgagataggctttgttcacctcgaaactgctttgatccggataaagcgagatgcctaatcgtttcatttcacaaaaatcccttcttagctaaaatattgtgcagccatttgacgcgacatctttttaaagcgatgcttacgttgccagtttaataaaaacccggctgtgcgattattagctttgcctttagcggttttaccctcaattgtttcagtatagtgcagcatcgtcttgtggtcaccgagatcgcgtaattgataatccacctgataatgatcgcgggcggtgtcaagctcatacgcgtaacgctcattggcgatggcatgcgtgatcgtcagctttccggtcatgccattggcccactttttctgatatgtgaagccatccagactgcccggcaacacttcccggccggtatgcgtcttgatgtcggcctgcacagaccgaatcagttggccgtacatgaacgctgccggcactttgaacatcatttgaatttccaattaaaaatcacctctctagaatcaatggcgtttgccgctggtggatcttttaatcaaacgtcaagttgtgctggtttgatgcggttggcagctttgacaaatggcacgtagattaagaagccgatcaccatgttaaccagctgcaagactgccgctcgccagtccatggtcgcaactaacgcattcaaaaatggcggcatggaccaaacaatctggtttttaatcggtgagaccaaccccatcgtcacggcgccgtatgcaatggaaaccatgacaactggcgccataataaacggaatgaagtaaatcggatccaacacaatcggcatcccgaacatcaccggctcattcacgttgaagaacccaggtgcaatagacaacttggccactgcccgttgatcatcccgcttggagaacatcaaaatcgcaatcagcagcaataacgttgagcctgcgccgccgatccatgcatacaagtcgaatgaattacgggtccacagatatggtaaggactgacccttatggaaagcattgatattggccaattgcgccgtcaaccaaatactatcaagcaccggccccaacacattggtcccgtgaatcccgaagaaccagaaaacctgaaccaaaatggtcatcagcaacacggcgccatagccttggctcaaccccaacagcggttcctgcaagactttagcaataaattcgatcaccgtggtaccaaactgggtgaaaagataattgataataccaacgccgtaaagtgcgactgcggcaggtacaataccggtgaaagcattagcaacagccgggggaactgaatccggcattttaatcgtaatgtgctttttcatcaaccagatataaatcgtcgcagcaatggcacccatcagcatgacggtgaagaaaccgtacgcgccaaagaatttaccaaagttaaagaagccccacatactgacgtctttaccggaaacaacggcgccggcatcggtcagagttttgacggccccttttgccaatccggccttcaacgtcagggtaaagttttgcggcaagctcataatgaacgtgcccaacgtgacgatccctgccgtcaccggttcgaccttatattgaaccgccagttggtaaccgaacgtaaacgagaaaatcaacccgagaatggccaacgttcctgtccaaacaaccgcgttaatcccgatcagccactgcatcgaattcacgaatccggtccagccgaattgcgttggaatatcccgaattaacgcattcaacacagtcgaaatcgccccggccatcatcgccggcatgatggcaataaaagcatcacgcaacgcgaccaaccaacgaatcgacccgatccgcgccgcgattgggacaacatgtttattgagccaattgataagcttattcattatttacaccccttgtaattgttgagcgtgaaccagcctggttagaaaccggagtgtaagtggccttgggcgtgatggcccggtcttaggccattgcgaccaaggttcttacacgcaggtttctgggctggtgaacgcgttatgttgagcgtgagccagcccggccctaccgctccaaatcgatatttgtcgtgtggtaatacagcgttagaccctgataaacaaaataagttcgtgaaaagttgaaaactttgccgcttgccaaatagttaatcccatcaagacaaagatgattggtttctaccggcaaccccatcaagtcagcatagtcagctggcagtggcaatgtttgaatgtagttctcggtcgtactgccaaccatgtgatacgtgttgcgcaagtatgcgaagatcgatccctgcgcaatttcagccgaaagatgcggcacaatcgcttgcgggaaatacgattcttccaagtcatacagctgcttttttaagtaccgcagtcgcacgacttggtaaaccggagcgccgcgggtgacattaccgcgctgagccaacgcagctgttgcggggatcagcgcaaacttaacgactttagatgtcagcgggccaccttttaccatggccgtttgatcaaaaccgatcgacatattaagcaccgcatccgactgcgccgaatgatcaatgacgtaatagccactgccctgaacccggcgcaccagtccgtgggcaaacaccacgtccaatgctttacggatcgtgttgcgactggcttgataacgatccatcaacacctgttcggttggcagcttgaccggatactgtcctgccagaatatcttgaatcagttgctctgcaatatcgtgatacatcgacaacctcccccaatttcaaatcctgaaaacgcttgtaaaatttgtacctacgaattataatagcacaagaaacagaaaacggttacactttttaaaaaaggggtcagaaaaatgacagagaaaaaaattatgttggtctgcgccgccggtatgtcaacaagtatgctggttgcacgcatgcaaaaagccgccgaaaaagacggcatcaccgttaatatttttgccacttcggcttccgatgccgacaacaaacttgcggcagaaaacccagacgttttaatgctcggcccgcaagttcgctaccttgaaggccagttcaagaaagatttagacatccccgtcagcgtcattaatatgcaggactacggtttaatgaacggcgaaaaagtattgaaggcctcgttaaaggcgattgatgacggcaaaggagcagcctcatgagcgaagaagatcagagcctcgaaaccgtcatgggattgattatcaatggcgggaatgcaaaaagttcggcctttgaagccattcacgcagctaaggatggcgatttcaaactggctgatgagaaacttaaagaagccgatcagttcttaacccaagcccacaatgtccaaagcggcatgctgacggcggaagcgcaaggcgatcacgccaaggtcaccttattgatggtgcatagtcaggatcacttgatgaacgccatcacctttcgcgatctagctggcgaaatagtggcactttataagcgattaagtacccaagaagccaaataaataaacccttgccagtcatgtgaaccggcaaaggcgtatttgtggcgaaaaatgcgactccttatgctgcaatgacgctttctttatctcactctcgctgcaccgcagtcgcattcaaagcccaaaaagaccagcaaaaaagcgacttgactaagccgcctcttttgctggtctttaacttattgctgttgtcgcagcgcttgccattcctcacgtaagatgccgtatttaatggaatcccagtagcgatcctggtaataccgaacttgacgcacacgggcttcttgcttcatccccactgcctcggccaaaccgatcatccgctcgttcccggaccaagtcgtgatgcccagatgcggcaagtcaattaggccgaagatccgatcaatccactgatccagcgcctgcttgccaatgcctttaccccagtagctctcatcgtaaatcacgatgcccaagtccagccaccgttgcaaatccccgtcttcataatgcgcggagacgtcgccgattaagataccatcatcccaaatgccgttaacaaaaggattagcaacccattgatagccggtctgattggcctgatcatcctgcatttctttcagtgtgggaatttcgtcattaaagtaaggcccattccacttgtgccattctgcattgggatcggaaaaggcaaccttccacaatgtctcaagatcttccgtttgaaaatgttttaacgttactgtcatgtttgggcacgctctctttcttcatttggttacacgatttgaggagctttaagtaaaaggtctcattatatttcctgaacgcggttactggccactgattcaccaatttctaaacgctcctgcttgcattttatgtttgtctaaaacataccacaattattacccaggaaataatccaagtcgcaactatgttaacctaaatcatagcatgactccgcacttgtttgttggagtagactcaattttcgggagggatttttttggcagactatattaagcaggttcgcgcaaaagtcggacatatgccgctgattatggcggggacgattggcattttaacggatgacgctggccgcgttttacttcagcagcgcagcgattttaccggtgaatgggggctcatcagcggtacgattgaatatggggaaacgcctgcgcagacaatggttcgcgagttcaaagaagaaactaacttaacggtcgcggttgtctccttgctcggcgtcaatggcaatctgacccttacctatccaaacggcgatgtcgcccagtggctgtgcccagtgtttctcgtgaaacaattaggcggcgaactgaatagcgataatgatgagaccgaggcactaaagttcttcgatcccgcagctgctccacgtttgtttaaccagcaacaccgtgaggccctcgcccatttcatcgctggggaaagagggtatttcgactaatgcatcaactcgtcattcttcgcggcaattcaggcggtggcaaaacaaccacggctaaagtcttgcgcgaacacctcactgacacacttctgatctcccaggatgtcatccgccgcgacatgttagcggaaaaagataaacctgacagtccgaatattgccttaattgaactcatcgcccgcttcggcctgcaacatgaaaaagtggtcatcgttgaaggcaaactgaatgcggcacgttacggccagatgttgcaaggattaattgccgcagccgatcgtagttttagctactattatgatctgtcatttgaagaaacccttcatcgtcatgccggtcgcgctaaagctaacgagtttggtgccgacagcatgcgccgctggttccagccccatgatttattgggtgttccgggtgagcagaccattcctgcaagttggtcacaggatgaggtggttgggcgtattttggctgatctcaatagttgaaagtgtttgaggccacttacgctctggtttctaaccggccacgctcacgctctgggcaaattattactgcttttatcaagatcggattagaatgagctggtagggatactttcggtttcgtcattcactaaaactaggagagtggtttttaatgacaagttatccacggcgtgatcctgtaacagatcagctattaacaccagaaaattcagcgttgattttgattgactatcagccaacgcaggtcgaatctatcggctccatgaatcatcatgcgcttattcagaacgtggtgatgaccgctaaattggccaaaatttatcaagtcccgatcgtgctttcaacggttaatgtcaaaagtggccggaataaggacacgattcctgatttgaaaaaagttctcggcgaccaacccagcattgaccgaacttcaattaatgcctggcaggatcaggattttgttgaagcagtcaaagctaccggacggaaaaagctcatcatggccgcattatggaccgaagcctgtctcaccttcccgacgcttgatgcgttagcggaaggcttccaggtttatccggtcgtcgatgccgttggcggcacctcaaagattgcccacgaaacggccctgcgacgggttgaacaggctggtgcgcagctgattaccaatgcgcagttagcttgcgagtggcagcgcgactggaaccggaccgatactgtgccggatttcgttaaaattttgctcgaaaacggtgacttcatcaacttaggcgcttaatcctttttcgacgatgcggttaacgccgacagcagttgataccttttaaaatcgaatattaatgtccttaggggcaatggccaagcgcgccattgcccctaagattttcacagagcgcaaacaggagcgcttagaaatcggagtgtaagtggcctcacgcctaaatggctggtctttagccatttaggcgtgaggtccttacacgtagatttctgcgactgtgagcgcattttgggggaatttatatgcagcgttttgcaactggatccaagcgttggtggttactgatagcattaggttttttcgctttcatgacgaatcttgatgggtcaatcgtcaatattgcgattccgattatggcgaagaaccttgacgtttcggcgagtcgtatggagtggacggtctctctatacctgatcgttctaagtgccctactgctgccgtttggtaaacttggagaccgcattggcaaacgccgaattttcaagtggggcaccggtaccttcgtggttgggtcattgatggctggcattaatcttggctttaattttctgatggtgggccgcatggtgcaagccatcgggggtgcgatgaccttggcgaacacttacgggattgtgacgtcaacgtttgccctggctgaacgcggccgcgctatgggcgttgtcagcacgtttgtggcgcttgggggcgtggccggacctagtctcggcggtctcattttggcgcattttagttggccgatgatttttttgatcaatgtaccgatcggcgttgtcgcattggggatctcgctgtggtcaatggataacggcgaaccgcaacccggcacgtatgacaagtgggggatgctgctgcaggccacggccatcgccagcggtttctggggactgaacttggctcaacaaagcggcttcggcgatccagttgtgcttgctaccttcgctttggccatcatcagtctggcggcattcctgatctttgaaaatcatcaagagacgccgttactgccaatgagtatctttcgagtccgcattttcactttaggagtcctgaccgtcttcttcattttcatggttcagtttttcagcaccgttttaatgcccttctaccttgaagatgcacgtggcctcacgccgggggctgcaggtaccttactatcactctatccattgatgatggtgttctttgcaccattcggcggctggttggctgacaagtggcaggtgccggccgttgcgttgctgggcagcctgcttattgcggccggcagcattgtcggcgcatttttaaaattggatgcaccactcatggtttatattatcagcacccttttgatcggtatcggcagtgggctgtttcaatctcccatcggcgacgtggtcatgtcagtggtgccaaaagatcagctgggcatcgccggcagtttcaacgcgctggcccgtaatcttgggatggtcagcggtaccgcggtggcaacaacggttttgtttggaacgatgagccagcttgccggcagtcgggttaccacttatccgacgaatcatccggaatactttatcgccggtcttcagatcgccatgctggttgctgcaggactggcattgttgggtgccattgctattgggttgacgatcaagccgtggcaagtgcatgagaagaattgattgttgagtttttacaacgcgtttgtctccaatttctaactgcgccagttcacgctctttcggaaaagtgctagcattagactgctagtcacttttcgaggaggacatgacacatggagaagcatcattcgaccaccttgcttacatggggcattcttttggtgggggctaatttgcgcttgccgattaccatgattccaccgctgttgccgacgattgagcatacgcttgggttgccggcttctatggctggtttattaacgacgattccgctgctgatgtttgccttggcgtcacctgttatcgccaaaatggggaatcgccgcggtaacgagtggagtttgcttgttgcgctcgtgattttattactcggcagtttgttgcggattattcctagtttgatcgctttaatcgttggcacgttgctgatcggctttgggatctctggagggaacgttttactaccggcgattatcaaagatcagtttccgcagtcaatcggcgcgaaaaccagcctgtataccgtgaccatggggctggttgcttcactggggactggcttggctggcctcttgaaccagcaattccatatgaagctgaccatggcggctttttcactcgttggcgtagccggtttggtgatctgggcattggcgttgcgcaccttgccacccgtcaaaacctggcaaggcagtgcccgcaaaaacgtggccgtctctcattcgctgttggcttggtggattgctttatttttcggcctacagagctttctctattactccctcctgacctggttgccgagtctgtggcaggctgttggcttctcgcaactaaccgcgggtaatctggctacgatttttcagttgagcggcatgccggcgacattatccattccatttattgccgaacggcgccacggccttgcttacagcgtctggggcattatgctgggctttgcgctaggcgccttgggcattcttattcccggcgctaacttcggcttaaacgtgattttctccctgctgatgggcgttgcttccggggcagcatttgcgatctgcattgtcttcttccaaaagaaaacggccgatgcatacgaaactgccagtttatccggcttcgcccaaagcttgggatacttatttgcgtcagtgggtccgatgctttatggctttatccaaacactcaccggatcatggaatctacttttgtgggtcacagtggtcttaaccctgatcatgtttgcggttgggctggtcatcaacgccacacccagcatttttagtgcatcagatcgaaaatagcgtttgcacattaggcttactttttctaaactggcattatgttaggctcatattaacgcgttcgctggttagaatctggctcacgctcactcaagacaaggagattgacaaatggcacttacaacaacgatcggaaaaagcaatgtcgttaccggcaaactcgggttgggcaccaataaggttggcggacataatctgttccccaacttacacgatgaagacgggctagccgttgtgaaaacagcgttggatcatggcatcgacatgcttgatactgcttatatgtatggccttggccaatccgaaaccttgattggtcaggcgattcaaggctatgaccgtgcaaaaattgttctggcgaccaaagcggcacaagacccccaccaggatctcaaacccaacaacgatcccaagtttttgacccaagcgattgatgacgcgttgctacgcctgaaaaccgactacctcgatattttctatattcattttcctgatgaaaaaaccgataaagccgaagcggtcaatgccgtcgcgaatgcccgcaaagccgggaaagttcgcgctattggcgtttccaatttttcactcgatcaaattaaagaagcgaatcaggatcagcaagtcgatgttgtagaagacaactatagcctcgtgcatcgtgacgctgaaacgaagctgttcccttacctccgggaacaacacatcagcttcgttccttacttcccgcttgcttctggcttattaaccggcaagtatggtccggatgacgccgaaaaattcagcggccgtttttccgcttcccagttcaagacgattctggccgccttacgcgaagttgacggcatcgcagacgcgcatcaagcaaccattgcccaaatcatgcttgcctggtatatgaagaatccagatattgccgtggtcatccctggcgcacgcttgccggaacaagccgctagcaacgccgaggctttgaaagttcaactgcgcgatccggaatatggttctattaatgaactgtttaaagaatttcggcctaagtaacgttagcggtcatgacggttgtcaatgccgcgctacaaatattaagaatgcaaaaaggcagcttgccactccgatttccggaaatggcgagctgccttttcttgacgccctctgatagaagacgccatttattttttgcgggtaaacgcccgtttcacgacttgccagaaagtcagtgacttgacaatccgatcggcaggaatgtgctcacgaatggcgcgcaagaccttcttggcatctttcgccgcaaacgtatacgtcccgttcttcttggttttaatggcaaaacgaggaatccatttgcccctgaagatgacagatgcaatgacccagttaacttcatcccaaggaatttgataaaagtcatgcacatttttttcgttgaaaaattcgaagcccttatcgccgatcatgatcttgccatagaccggcattcccataaaggcagtgccttccatcactaattctgatttggtgttgattgattgaaccattttttgccatccttttagactgatcttgtgtgttgtgggagtgtggctaagcgctctgtgtaagaggctaaagcttaaagcttacgcggttgcccgaaacgccacaaacgcgttcgctggcgcagaagtctgcgtgtaaggacctcaggcgcaatggccaagttcgggccatcacgcctgaggccacttacactccggcttctaaccgcgccagctcacgctcttccataaacgcgttcgcgtggccagaaacctgcacataaggaccttggtcgtaatggccaaagaccagccatcacgcccaaggccacttatgctccggtttctaaccggccacgctcacgctcttccattataaatcaaaagcccagactttgtgtctgagcttttgggcgttttgttcgattttggtaatttgtcttacatcaaaccgatgacgtggaagacaaccccgacaacgaacaggccaaggataatgacgattggagaaaccttcttcttcagtaaccacatgcagaataaggttagcaacaagcccattaggcctggaatcaactgatccaagttatcttgtaacgttgtcactttattctttgttagtgacagtccttgagattgcaattccaaagccttttggatgccggctttaccgcttggcaatgaactccagtcaatgtaggcacccttttggttcggaacatcagaaacaactggcgtgaacttgacggaaacccatcgattgaccagtgatcccagaatgaacatacctaggattgtggcaccctttgtaacttcctgtagcaaaccaccggaaaggtcttcggtaatcttgctcccggctttgtaaccaaattcctgagtgtaccataggaacgccatacggatcgcattccaaagtacgaagtaaaggattggtcccattaagttgccggccatcgccagtgatgcggctaacgcaccaataattggcttaaccgtgaaccagaacactggatcgccgacaccagccagcggacccatcatcccgactttgacaccctgaatggctttgtcatcaatcggggcgccattggcacgttcttcttccagtgccatcgtaacacccagaatcggtgatgccagatatgggtgagtgttaaagaattctagatgccgttttaaagcagctgcgcggtcttctttggtgtgatacaaacgtttcagcgcagggattaaggtgtaagcccagccaccgttctgcatacgttcgtagttccaagaaccttgaaggaaggttgaccgccaccaaaccttaattcggtcgctttttgtgatatgaacttcttcagccatgtttgtcaacctccttctcaataattgtcaataatgtcgccgacaggatcaccggcaccactattatttgagctgccgccgttacctgaaccgccgccttgcttggacagtgccaagtaaatcagtgctaaggaaataccaatagcaccaaggccgattaaggtaatttctttgacagtcgccagaacaaaaccaatagcaaagaatggccatacttcgcgggtcgccatcatgttaataaccatggcatacccaacggcaacaaccatgcccccgccaatgccaagacctttagtgagccaatcaggcatttgttcaagcaatgcccgcactgggccagcaccaacggcaaggatcaagccggctggaatggcaatccgcaagccctgcatgcagatcgcaacccattgccagaaatcaattttacggaaactaccttcttcagcagcgcggtccatgatatgaacaatcgcggttgccaaggtacgaaccaaagtggtcagcaacaaaccggcaacggccagcggaaccgcaatcgcaatcgctgagctaatgcctttagtaccctgaccgccaagaacaagaataatagctgatgcaactgatgccaatgcagcatcgggtgcgacggccgcgccaatgttggcccagcctaaggcgatcatctacaactgcccgccaagcatcaagcaaggggtcaagtcgcctgtcacaagtccgatcaacgtgcacgcaataactggctgatggaagtggaattcatccaaaataccttccataccagcaaggaatgacacgatgaggaccaggatgatttgaataaaattcaaagtcataagtcttcttcctccatttcaaaaattacttctgcgcattcagttcgtcttgagctttcttcaaaatcgcgttcatatcatccggatgatcggatggcactttacgaacgtcgaatttgacgccatctttggccagttcgtggaaggtgtcgatatccttctggtcaaaggccagcactttattaggctgaaccttaccaactgaatgtgacattgacccgatattaagctccttaatcggaacaccgccctcaatggcgcgtaatgcgtcttcaggggtttcaaataatagcaatgcgcgttgaccgccaaaatgcttatcatctttggccaacttaatcatctgatcaatcggaacaacatgtgccttgacgccagatggtgccgcttccttaatcaggttcttccgcagctcatcttttgccactgtgtcagagacaacaataatccgcgtcgggttcgtggtcttagtccaagtggttgcaacctgaccatgtaacaaacgtgaatcaacccgggccagaacatactggaatgatcccggttggccagcattggctgtacttggtgcggcagcttgagcagctggcttcttcaccttgtccagtgattctggcttaatcttgataccgtcacgtccggcttcaagtaaatgtgcggcaatgtcttgtgcagaatccattgacagccgcgagccataagcctcaatcagcatcggcaaattcagtccggtcacaatcgcccatttatccttgtgttcctcataaatcgtgttcgcttggttaaatggtgatccgccccacaaatcgatcaaaaacaaaacttcatcgtctgggtcgaacttagcgatcgcatcttcgaggtgcttgtgcaagtcatctgggccttcatcgggcatgaaggtcacagcttcgactttttcttgctcaccgaagatcatttgaccggattgcttgatgccagcagcgaattggccatgactagcaagaatgattccgaccattattacgcctcctaaaaatttgtggttgcctcgaaaataatatctgcaaaaaacaaaaataatcaaaaatacaaggcttcccaataagttagtatgacttcctccgcgccgctatgcaagcattttcacttaaaatgaaatttaaaaaaagaagcgcatacattcagtacgcacttctaattggtatctatggaaattggtatattggtcgataccaattaattcaaagcctgactaggccttttctgactggccttcggaatcggtaaagactgggtcggcaatgcgcgtgcctaccaataaaagcactaataataacacagctgacagcgccgccatgagcatccagcttgccgcagcgctcacgacatttgccaatgtgaagaacaccacttgaccgaccggcatacctaaaagggccactaggttaacaactcctgccgttgtccccatctgctgttcaggaacaagccgcatcatcaccgtcgacacccgcgggttgatttttcccatgagataggacgtcacgaagctgaatcccatgacggcagcaagcgagcggaaaaggaagaaactaaaactgagcccgatcatcgccgctgtcaaaagactcagcagtttgaacgtactgagacgctgcaggccatcctgcgcaaacagtgcgcctaaaatcagccctaccgagaagacaatgtttaacaacgcaactgtcgtaccaaaatcacgcagccacatgccgggttgctggaccagcgaaaccgacattaagccgtccaccgatgagcccagtgtattgacaaacattgcgaaaacaatgactgccaaaagaaaacggttggttgccaaaaatttgagcaccttgccaatatccttcagaatcggctgatgcgcatgcgtcacgattggcggctctgcctgtttaaggcgactcttttcccgggttataacccaagctgcgagtaaaaaagtcacagcattaagcccgccaaacagcgcataattgtggttgagcaagacaatcaggcttgcaccgaccgcctgaaaaaccatttgaaccgtcgtaccggtcgcgctttgaaaactgatcgccgtgttcagttctttagcgggaatcagtcgatgcaacagtggcagcaccagaccattcccatattgccccagggtatcagaaagtatgttgatgcccagcaacagcaaaaacaatggcaagctggcaggcagcaggatcatccctgccaaccctaggaaaagtaacgtttggccaatacgcgtagccaccatatgactggttttggcctgggttcgatcggccagactgccagtcaccagcgacagcatcgtcggcaaagtggttgccatcgctgccaatgtgacggccagacttttaaacggcatcgtggccgcgtaaatgataaacacgatgttatacaggctatcgccaatcccgcttaacaaactggcatttaaaatggcgcgataaccccgattattgaaatattcatgcatgttgctacctccctgcagccaagcatgtcattttcgattcctacttggtttgtactttgagtgtaagcaggctacactcaaggcgaggtgaaattccactatggtagaaaaaatcaatcccactgacggcgccgtcttccgccaactccggcgcaaccaccatctgaccttggcacaggtggccgatgcacataattccatcgctttcattagtaagttcgaacaaggccactccaatatcagctttgcccgcctgagtcacctgctctttcgcatcaacatttcggtggaagaattcgtcttcattcgcgatctccaggcaggcgccgtcccaccctcggctcacacgcggtttgtttacaacactttagttcaccgcgacttcgaagaggtcatcgccaatcaggaccggcttggctttgaaaatcccacgctagccgactatcaatatttgttgaaacaggaaaaggcttggcagaaacggtacgagcacgaccacaaccgccaaacccaatttgaactcatcagcatccagattttccgcctaaccatgattgatcgcgtcaagccccctgaccagccatcaccattcaaaaatgtgaccgacgccatggcccaattgcaggaacgcgccaagccgctggtcagctatctctactcggtcgaaacctggaattactttgagctttattggttccgccatctcatggtcgccttacctgctgaaaccattcaaaacttgttgccaatagcgatgaagcgttcggaaaaatatcgcgccttcaatcaaatcggcaatctgcggattcagacgctcttctccgccttcaccgtgttcatcaacacacgccacttaaccgatgccaaaaaagtcctcaccactgccgaaaaaattttacatgacaccaacgacctttcaaactcggctctcctcttatttttacgcggctggtaccaagccgtcattggtcaaaccacagccggatacgagttatgccaacaggccatcagtttagagcatatcttggaccaaccgacacaagaacagtggctgcggtacttattgaaggtcgtccgaatcaatatcaaggatccacaaggtggcgcgtactttctttgactgcgaacctattatcgtgtcaaaaaaacagttttccttcttaactcacgacgtttcacgtggaacacaccaaaaaacggatccacaatcaacttaattccgctgatcgcgagtccgttacaaactgctactatccgaactttccaaaaagcaaagtcaggcttccttaccacaccgctttgcctcagctaacgcctccaaagccggcagccaacttgctgtccagtccgatgccgccacctcattcaatattgccttcagttgagcaagctcttgccaaccgcgcgctgccctgcttttatccggtgaataaatcatcactaaacgcttagtgcaggcaatctgaaactcaatccccatgtcgcccactgtggcctgccgaattaacgcaagcgtttcctgcgcgttgtccagttgccctgccgcaatataccgaagagaagcagtcaagaacgcgcgattggccagattcaaatgatcctgtggtgtgttcggtgtttgcacttggttcgcaatggccttgatcagtccttccaaatccttcatcgcgatgatgccggttaattgaagcgcgatcagccgcaacaacagtgaccattccgttgtatgcgtcaacaacgaccacgcctgtttacgttcacgggccaacacggaaaagcgttccggtgcatggttatgcagcgtcaaatgcaacagcaaccgttgattggtattcgccagcggcaactggcgtaagatacctgccagcgcctgaacatctgcctgctgtgccgccaccagataacgatgcaaaaatggtaatggtgcatccgagcgtgaaggcgtgaacgcatcccagtccagattcaatcgatccagcaataggaaaaagcgatcggcggccaactgtgaggtgccattttcaaattttgaaaggcttgataccgaaacaatgtcgccagcggcttcttttaacgtcagccgccgttctttacgcaatcgtttgaattgttcaccgatcgtcattttgcctgcgcctcctccttcaggaatcgtcgccaacttttcgtcaacaattgggcaaaaaacggcgagtccaataacgccagcgttgccagtaagtttttaaccgccattttggccgcccgatgctggccgcgatgataggtcagcaggtgctcttgatagcgcaacatgatccgggcatagagatcatcggccggaatgggtaagttcttggcgacgttgagcagccgcacagcatccgtaaactcccgacgatgaatcagcaaggcgatgctattcgtcaaaatcgcccacagatactggttccgggttggatggcccttcacatccggccagtccaaaaccagctccatgaccaaactcatcagttgctcatgatcatagatcaccaaggtggcggcaaagagatcaagctcatacaatccccagtaccgaatccgtttcaaatacttgataacgtcggctttcatctgtggtgttgtctgaaaactcggatccgtatacccattgtgggccagaatattaatctgattcagtcggtaaaaaatcagcccggtttgtcgccacaagcgatactgcttttgcgctaacacctgcaacgctgacttaccggcaaccgtggcccggttaacctgttggaaaaaattctccggattcaatgcccgatagccttgttgcatcaattcaacatcttgatcaaagcgcgttaacagttttaaaacaacggctgcactgagctgggtctccccccgttcaaagcgtgacaaagtagcggccgtcgtaatccccgccgcaatttcttccaatgagtcattttcctcaagacgcaacgcccgtaaataggccccgactttgacaggctcctccgccatcagcacccgcctctttttatgagaagtttattagacaaatttaacacgttttgtcattttttcaaaatcgaaatatttttctgcgctttgcatttgttaatctgtatgtttttatttttagtctgtgcctatttttaaacttgttaaccattaacgctaattgttacaatgggcgcgtatttatgtagtccagtttttatagcattcaaaagtctaaaaaaggacagataattggggaaaataatatccattggcggttcactgctaaagcactctcttctcctcacaggcatcttactgcttgatatcttaactgaattccatgatttttttacaatcagcaaattgcagcaagaccaatatgaagttctagtgattgaactaatattgaaaggggcgttcatttggtttcttcattggctatatttccggcaattgaaacgttttaatccaaatggctatggcctaaaaccactttcgagaaagaacatactcatatttctcattggggttgcgtctctcttcgggttgctgtgtgttgaatctctcacgcctttcaacgcggacaatgccacgaatcaggtgcttgttaacaaattcattcgaactgcgccattattagccagtgttgacgctgtattagcggcaccaattattgaggaatttatattgcgcggcattttctttaactattttttcaacaagaacactattatgagcaaaattttcgttgtcttggtctctggcttcgtgtttggtttgcttcacgaacctcatttcaccgtcaatcttttggtttactgcaccatgggatggctatttggttccgtctacgcgctgactggggatttacgctatagcatcgcgctgcacatccttaacaatgtcttagcctttgtttctatgttttgacagcggttcaaaaatgcttctcgtaagtatgcctgctaatataaacttcttccaccataacgtgttcactgccgcagaagtctgtatgtatggacctcagacgcaatagccaaaaaccggccatcacgcctatgccacttacacaccgccttctaaccgcgccaattcacgctcacatccaattgacatccacctcccattccgctacactcggttttgacatttaaatacaccaccaagaaatagaggttgcggtgggcaacgaaaactggggagtgccggatcatgttgaaccagtcgtaagtgccgccgccgaaatgtcgggccgtgttcggacgatccgcattgggccatgagcgcataactcatggactgtcgaagcaggttgcttcggggcgctatgattctggtttatgactaaaatcgatggaatcgacctttattgcttgttcaataaaggtcgattttttggttccagctctatttcccactacaagaagggagaatgtcattttatgaaaaaacactgggttgcacgtttgggtgtgctggggctcgtattgagtctgctgcttggcggttttgctgctaagccagtcaatgctgcgagcgatgacaacacattcaaagtcggtatggaagccggctatgcaccgttcaattggacgcagaacacagatgccaataatgcggtcaagattcaaggcagtcatgaatacgctaatggttacgatgttcagattgcgcggaaagtcgccaaagcactgcacaagaaagtcgtcgtggtcaaaacctcttgggatggcctgccgcctgctttaacttccggcaaaatcgatgctattatcgccgggatgtcaccaacaccggatcggcgcaaaacgattgattttaccaatccgtactacatttccaatctgaccatggtcgtccgtaaagacagcaaatatgcaaaagccaagagcattgctgattttaaaggcgccaaagtgacagcgcagctcagtacgtatcactatcaggccattaaccaaatcaaaggggtcgtcaaggaaccggccatgaacgatttcccggcaatgcgggtggccttggagtctggcaccattgacggctacgtttccgaagttcctgaagggatcacggcagaacgcgccaacccgaacctgatgtatatccattttgccaagggtcagggatttaaaaccgatgccagcgacaccaacctggcaatcgggttgcggaaaaacgatcccaataaagctaaaatcaatgaactgctcgctacgatttccaaaaaagatcgggcacgcctgatgaatgaggcggtcgataatcagccttcgaccgaaaagagcggcaactggttcatggccattatgaaacagtatgggccgatgctcttgcgtggtaccggtatgacgttgttactggccttggtcggcactcttgttggcttcatcatcggcctgttagtcgggattattcgcaccacgccaaaacccaagaagttgggacagcgcggtttgcgggcagttatcaattggctgctttccttgtatatcgaagtcttccgtggcacgccaatgattgttcaggcagcggtcttgtattatggcgccgcccaagcctggcacctgaacatggatcgcaccaccgcagcgcttttgattgtttcgattaacactggcgcctacatttctgaaattatccgtggcgggattatttccgttgatgaaggacagttcgaagcagcaagtgcgctgggcatgacgcatctacaaaccatgatgaaagttatcctgccgcaagcggttcgtaactccctgccagcggtcacgaatgagttcattgtgaatattaaagatacttcggtgctgtcggttatctcggtttccgaactgttcttcagcggcgaaaccattgccggacaaagcttccagttcttccacacctatctgatcgtcagcggcatctatctcatcatgaccttcaccatcagccgcctcttccggctcatcgaaaaacatctcgacggacccaaagactacaacgtgatgaacaatcaaatgcaggttgaaacgccgaaaatcggcaccgcaaaagagggggactagatcatggcaaacgaaccattaatccaagttaaaaatctcaaaaagagttttgggaaccacgaagtcctgactgacatcaactttaacgtccaagccggcgaagttgtttcaatcatcggtcgcagtggctccggcaagtcaaccctgctgcgcaacatcaatctgttggaaaccccaactggcggcgatattctttttcacggcaaaagcattctaggtgaagacgtaaagttaagcacctatcgcgccaaagtcggcatggtgtttcagagcttcaacttgttcaacaacatgaccgtcttgcaaaatgtgatggtgccgcagcaaaccgttttaaaacgcgacgctgctgccgccaaaacccacgcgttggaactgttgaaacaagtcggcatggatcccttcattgccgcaaaaccggatcagctctccggcgggcaggaacagcgggtcgccattgcccgcgccgaagcaatggatccagaagtgctcctgtttgatgaaccgaccagtgcgctggatccggaaatggttgatgatgtcctgaacacgatgacggccctagcccacactggcctgaccatgatcatcgtcacccacgaaatggccttcgctcgcgatgtttccgatcgcgtcgtcttcatgaacaacggcatcattgccgagtccggcacaccggatcaaatcttcggcaatccgcaacaaacagcgacaaaggaattcctgaagcgttacttgaaccgggtttaactgaattagcctcataaacagataaaaatgaagccggatcataattcacggccacaatacaaaagcgggcatactcaacaataactggagtatgtccgcttttagttttcctaggaaattggtttgaattattaaaacgtcagtgccaaagcgtagcaatcggaggccagatggggctcagtggtgaaatcattgttggcggtttaccgcctacaatgaggccgatctttgagcctcagccggttttgctgaggctcaaagtcgtgcccaccactctagcttcgcggtcgccatccctcatctggccggagattgcggagtttggcacgacaatctattattttgtcttccgcttcttttcccgatgttcgcgccatgtgtccagactcaccacgatgaagaacaggaaaaagccgccgaccacggactctgccgttagcaaaaggtagcgcaaggcaaggtagccttttccagcggtgacgtcttgatagccgacatagccaaacgtcattagcaccgctaagcccagtaccagcacgttgtaaataagggttcgttttaaaatccgtttgaatgtcgtcatggacgcgcctgctttcttttggttaattaacgattatctttcgaaatggtttcggcttgcttttgcagcgtggttagcacggtcttaggctcggcctttttggaaacggtctggtcaacggcatccaacaggttgttgcggtaagtgttatagccgatgaatggtgttgacgagaacgcatcatcataagcatcgaccgcggcctggtagttcgggttggcttttagataggcttgatagtcacttgacttcgtggcagtcgacacaaccggcacgtacccgctggctttagcccactgagtctgaatcttggtgctcatcagaaacttcatgaacttaaccgcgcccttgatttgctccgcagaggcacccttgaaaacagaaatcccattgtttcccagaaccgaactggatttgccatcaaaactcggcatcacagcggtcccccagtgcatgctcttaggtgccgttgatgcaatctgctgaatcgtggcgctagagccgaagccggcaaaaattttgccttgaacaaatggtacattgaagtaattatctaatcctgctgtgacagctgtcttatcctgcagcatgctggtgatcgccgtcatcgctttgatgctagctggcgtgtcaatcttcgccttgtattgcggcgtaatcaggcgattgccggcatcatacgctaatgtctcaaattcaaaatcataactcttattaaacgcgacgcctgtgatgccatcacctttaagctgttgcccgattttggtcaattcttcccaagttttcggcacagtgaggtgatatttttccaggatatccttgttataaaacatcaaccgcgtcccagtggcaaacggaatctgataataattgccctgatacttcagattcgtggcaatgccgggataaatcgacttcagctcagcagcggaaaattgggattttacctgcttatcaatgttgaccagcatcccgtcatggacgtattccggaataatcgtatccgtcacctgcccaatcgtcggtaaggttttggacttcgccgatgccaggtacttcttctgcaagttgtcatacgaaccctgcgatgttgcaacgaccttgtattgcttttgactactgttaaacgtcttgatatacccttccaacgccttgttgtaattaccggtcatccggtgccaaaaagtaatcgtcaccggacccttagaggttttctgcgccgaactgccactactgcatgcagtcagcaacaagaccatcaatgcagtggcaacaccaagtaaccaacgtctcttcatcacatgtacccccattattgtcgtaaacgcatcgtgtcgttgtggacaagacccgcaaaccgccgatcccatccggctttaaaactatatacagtataccaatacttaccgcaagcggtatcttttgctgaaaaaaaaagaaagccgattttgctttctttttgcattttactgcggtattaagcttgttcttccgttaatttaagatagaaattcgccaaagtcatactgcggtacgggatgacccagatggaagccagccccatagtaatcaactctaacagccaccaacccagaaagctcagcaataacacaaagtaatcccacttatggccaaacatcaactctcggctgcgggtcacggcttcggtatagccgatcggttggccgctatcgatcgcatcccgataaatccattgcgcctgtgaatacgccatcgccttaacaatccccgggacaatcagcaagaacatccacaggaaaatccagacccattgcaacagaccaatcaacaaactgcccagaaaatattcgccccgttcaaaaatcttgaacatctgcatccaactaaactgatgatccgaccggccgcgaagaccatcgatcatcgcaaacatgacgccaatcatcagtaacacacccaacaggctcaaaaagataacaattgactgccacatctgccagtattcgttcacgtggccgcctgtgactgtgaacgatccgctctgcgccatcatccgccatgtatgccacgtcccgcgatgtgcttcatgaacagcaggaaacggcacaagtgtcgcgaatgccatcaatagtaatgccggtaaactaatgcgcagataatagctaaagttgggattcaattccgccttggcttgattctttagtgatgtccggtccacagacaactcccccttaactgtgattgcctcatacagttgctgggaatatcataacagaaaagcctgttttgttacacaaacttgagcgggaccttcggattgagtcgtggcttcccgcgcaaaagtgtaaactcatcgccacttacggttaactcggttttcgaatcgaaaaacccggccgcatagcttttgattaaaaccggtccgactggggaatcaaggtgcgcatcaaatacatccggcacgttacggcgtggcaatatcaggagactgaatttagcttgcgatgtatcatgatactgccgcgagtatggcccgatgccatcattcaaatccaaaaccaacacccgatctgcgtgtaaaagcggcgccagtcgggctgctgcctgtgcagatatattaagctccatatttcacccccacaagtacaataatccttgtcgcccacattatggaacggattgccacaggatacaaccagcttgtaaaagtttaacgaaatgcctaaaattggtgtaatgaaccacgatgctattctgtcagttaagacgaggtgtgccaatgaatatctattcggctttaaagtttatccagatcgatcatgcacaagtcaatcacctgcaggttgtcgtcaccgaccaaagcggcaagcctgatgccggcatgaccgatttattaatcgactgcctcaacaagatcgatattttcgttgatctcagcaccaccgaccgcgtcagtgatgtcattgacgatctcaacttactcacgccgctgccatatgatgttctcgaagaataccaaaagattcttgagcagcccatcaacggcatcaacgttgcgatgaaaaagcagttgatcgaattcatttatgcgccgactgtttgaaccaacggcgccaactgcttctgctgtttcattttaacaagctcgcctctctgccagcaatctttgctgccgcagataggtgggcttttttagtgtgagcgtgaaccagcgcgcttagaagtcggagtgtaagcggccttgggcgtgatggcccgggcttaggccattgcgcctgaggtccttacacgcaggtttctgggctggcgaacgcgttatggttaagcgacagccatttcaaaacgcacgcactcgcttcaatctaactcgtgtgacaaaagcaccgtgataagttcatttttatgacaacaacagtttcgtttgtcgccattttctgctatcctgacgaaaacggaggcgaaaaaatgaacgaaacgggacatgctttgccagccaacatcaaatttgtctggcgcgccgatatattcatctggtctttcattttttttgttgtcggcttacttttgctcatcgccagttctttttggcattggccttcatggctaggttttggtgtcatcgggttaacggtgctgcaatatattatccggcgggccctcgtgccttatcgctatcgattcctgcgttacaacatcacgccgaccgcagttttccttcaaaaagggttcttcttccgtaaaaatgaagcgatcccgattgctcgcattcaaaatgtgacgttggaacagggaccgcttctccggtggcaacaactgcaacaggtcaacatcgaaaccgccagcacggcccatgtcattgacggggtaacggcatccgttgccaatcagttgcggacccagattttgaagctggcacaggaggcgcgcgatgaatgaacaaccgcaccaccttgcgcctgtcgcgttactgatactatgggtcaaaaatgtcgtcgctttatggccaatatttgtcggtggcttattttcgatgttcggttccaaaatgagttttaaagaactgctgttttggctagccttgattcttgggagcgtcaccttaatgctcggatggtcaatcctgcgttatttgcgtttcacctattcagtagcacctgatggcttaaccattcaaagcggggtgttcatccgcaagaccaaccatattccgtacgaccggattcaaaccgtccagcgccagcaatggtttttcctgaagccacttaggctggaacaggtctccatcgaaactgccggaaaagaaaccagaaaagcggaaggccaactggcagctgtgccgacagccgttgccgacaccatcaatcgctatcgccaaggaattagcgcagaaccaacaacatcttctgccgctgaatcggttgatgctgacgctaccacccagacacgcgtcgtcaacacggaaccggttccggacgctgcctataaaatcaattcccacgaccttaatcaatatgcgctcacatcgcttggtttcatccccatcatcaccgggatcctttgggtgttggacaaggctcaggaatacctacctgatagctggtatcagcaagccgaacacgccatcacgggtttagctatttatcttctgatcggcttaagcattatcgttttagtgctgggatttgctgtttcttatttgaacatcctgcaaaaatattatcgcttcacgctcgttcgaaccggtaacgaactgcgcaccagccgcggctttttccaaaccaacacagtcagcgcccgtctctcgcgcgtgcaggcagtccggtttaaacaaagcattctccgccaatggtttcatctcaccaccgttcaggcgttgctggcttcaggtgcagctgatgacgagcaaaataatgatctggttctaatgccggtgatccggcaacgctcggccatgacggacatgcgcaagttcattagctggttgccgacagcaataccggaactgcaaccgattccggtgcgaaatcgctggtactatgtgcggaatatggtactagggaatctcgcttttattgtcgcaccgattattttaaccagcgttttgtggctgcacgtcagctggtgggtctggttgctaccgattggcgggctatggctgctcatcatggcactccaaggccaatacgccgcaacaaacgctgctatcgccattgcgccgccagatcaactcgtcatccaagtcggcgaagtctggacccggcagcgctactatgtccggaaaaaagacatccaagcgatgagcttagcgcaatccatctggatgaaaccgcgcggcgttgcgcacttaaacattcatgtgcgaaaaggcaatagcgatcaaacgattacgtcccgctacatgaaagctgacttagctaagcaaattttaagttggtatcagccgctgccatagtctaggtaaatgaagttaggagcttgccatgctactgaataaaattcaatatacgccgccacttcaggcaacatcctatccattcaacctcccttggcaagcgcatttccgtgaactaaagctgacgcagccggtgaccattttgaccggtgataacggcagcggcaaatcaacgttgctaaacgcgatcgccgccaactacaacgctatcttgatgagcggcgcgtccctcgaagatgatcctgaatacgacaatagccgggcattggcgcaccagttaaaattaacgtggacttatcgcaccaagtccggctttttattccgcgccgacgatttcatttcattcattcgcgccacccgcggccgcatcaaatatgcccaggatcagcttgaacacttggcgcccaaaagtctggaacgtctgccgtatctgaatacactggcagaagtccgccacctttataaagtcgacttagacaccctatcacacggccaagcctttctcgccttatttcgcgcccgcttacacgcgaacgccctatatttgctagacgaacccgaatctccattgaccccggaaaatcaactgagtttgctagctttgattcatgaagcggtaaccggtggagctcaattcatcatcagcacccactcgcctattctaatggcctaccctgatgcgcagctattggccttgggtgacacgcttgcacccattcaatacgaccagatcgagcacatcactttcctccgcagctttttggatgacccgcaacgattcgtttatcacctgttacatgattgaatcattgtcattagcggcaaaaatgttttaaggtgacattagagcatcgtctggcgttgaaagacccaatgtttatcgatctttttccaccgatgaccgtcggagatgcccgtgagaggagagatacttgcatgcttacatcagcttggaccaagcaattaccattagatcatatcacctcgatcaccccggttggcggaggtgatgtcaacaaagcttatcgggttgatacctccgagaagccttactttctgctcgttcaacctggctaccccgccagcttctatgccggggaaatcgccggcttaaaagcctttgaagccgcacaggtgttagcgccacgcgttatcgccaacggcagcatcgaaggcgatggctacctattattgagcttcttgaccagtggccatggctcgcaacgtgaactcgggcggcttgtcgcccacctgcatcagcatcacgaacccgccggccgcttcggcttcgactatccatacgccggcacgagcgtatcattttccaatgattggaccgattcgtgggcggacttgttcattcaccaacgtctcgacaaactagccgctcacatactgaaaaaaggcctgtggcaggccgacgatcaagcaacgtttgaccaagttcgcaccattatcagcaagaccctcagccagcatcacagcgaagcatccttactccatggtgacttatggggtggcaactacatgttcacggcagacggtcagccggcactcattgaccccgccgcagtttatggtgaccgcgaactggatatcggtgtcaccactgtctttggcggattcaaccaagagttctacgccggctaccaagaaacctatccacttgaacccggctacccatttcgactcgacttttaccggttgtattacttaatggtgcatctcgacaaattcggcatggcctatgccggcagcgtggcagcagtcatggatcgcattctcgaccatggcgtgccggagaatcaggaacgaaacgattagcatgccaacatgaatgggaaaacatttcgactaagcacccattattttccggaaacaacggcacattctgcaaccttcctggggtatcaacgtttctagcaccatcaattttacggtggcacagttttgaccctttttaaattattttggctcatcgggcacccctttggagaatatcccgttgagtttttttgcgacttcaaagttggctgttggggtatagatgaccatatttgccgagcacgtttctgtgtccttatgccccaaacgttctttgatctggagtggattttcattgagtctgatcaacagcgacacatgcgagtgacggagaccgtgcacggtaattcgcttaacttcgatgcgttcgctgtatgcgtccacaatgcgtccacaatatcaatgaattgctggtcagagtatgaatcccatcacgtgagaatacccgcaattaccaatgaataagggcaattcagcggatggtgcgagaactaggtcgagcatttcttgatggttcaaagaatctgcatcatcgattagctgtggttctgaaatctttctgtgattgataacagttattttgagtcccactgtattctcacctttttcaaaacgatcaccattaagacgctcaatatcaacacatagacaatgttattgccaattttagataattcgaaatcgcccacccaaaggtattgcatgacttggatgcagtgatacattggaaagacatgtgcaaatttctggacgaatccgggtaatgagtctgtgggaattgcaatgccagatgtaaaaataaaaatcatgaaaattcctgaggtgactaaactagcagtcctggatgatgtgataaatagtgaaatcaaatatcccagtgagaagaaaatcaatgcagttaggaagtaaaaaaatataaacaatagcgtttgccccacattcatgcgccatatcgcatgatatattgcaaagctcatccctccaaaaatcgcagttgaaataatgctaacgaccagaaatgcggcaaataatgattgaaaatattgccagtaagtaactgggtacgtcatgtacctcttaagtacaccttggcctttaatgtctgaaatagtaattgagattcccatcaaacctgtgttggctaaaaggaaaacaacatttatcggaactaccgtgtcaattcctaggacatttttgccaaagatagtcgggctatcaccaaaggttccgccaaagacaacagttaatgcaataggaacaataatcataaagaacattgacgtatgttctcggaaaagtgcttttaattcgacttttagaaatggtgtgtatttatcaatcctactcatttacgtcatctccggtatacatgagataaccatcctcgaatgtaagactgtgtatgctcacatggtggttattcaagatatttgaggttcttacagagctatctgtatacaaataaaagtttttacctgttgacctcgagatataatcaattccttgttctttcagatccctctcgattggccgcaattgattgacatcaattggtgtataaacgaactttctcagctggctttcaagttctggaattaaaccagactcaacgattttcccagcgtgtagcatatatacaaagtcacaataatcggccgcttgatttagatagtggtccgaaactattacaaggtggtttttaccatattgcttaatcaggttccaaatttccttccgattaaaagtatctagtccagatgcgggttcatctagaatgactatgggagcctctgtcatcagagtcatggcaattaaaactctgcgtttagtaccgcctgataaattggcagtacgtgtatctaaaaattcggttagatggtattgatcagccacctgccgctcggaaatgtttctttgatagagcttcaaaactagttgaaattcttcgcgaactgtgtttagcttcctcaaattgttttcctgaaacaagaaggcaatttttgcagtattcggctcaacaacgatgcttcccgaacttagccgtctcaatccaacgattgattccaaaagagtcgtcttaccgcttccgtttggtcctgcaatcagatacagtccttttccgttaaacgacatgttggcatcggaaatagccgtccttttcttgtaaactttttttgcgtgatctatccgcagtaaggtcattcagcatcactccttgatgattttttgttaatattgctagacaaatagttaaagattacgtgcatcataaccggcacccacacggaatgtgtgatcactaaagatgctcccaacagcatcccaaagagtgattttacaaaggcttcatcatcatcgaaagatgttaccaaggcaaacaagcaaatttacaatatttgcgtaaattaaaattattttaccataatcgcatccgtttgattataataaaattagaaaaagggtgagtatattgaaagactgtgaattgggacaacttttttaagagattcgcacggagcggggccttcgcatttcggatatatctgaacctttaaacataagtacggtttcgaagcttgaaaacgggctcacggaaatttctgctgaaaatctcttcaaacttctccgtaatatctgcgttgaaccaacagaatttttagaacttctcgaaaaaaggaaccgatctcatattgatgacgctgatttacctcagcgtgattttgaccagaaaattctacagttatctttgcaaaaaaagatcggagaattgcaacgactcaagcagaacttgatccagaagttcttaaccactcgtaacattttgttcaaattgcgttctgttatgaagtgacccctgtcaaccccatctttataagattttcgatattgtcgttggcactaacaagctccagaattccgttg

SEQ ID NO: 336 - DNA, 26424 bp, Lactobacillus casei
gtaatgattgtatggttcgttttaacacaacaccattatcagtctaaatccccgagtcgacaatctagggggtcacttcatattatctattattgtcactgcagtacaaattgacacccaaggcacctccgatcatctttcaaaagaagattgggatgtggttataaattatttgatgaatcgatccttttggagagcgaatactttgaaaagccgtacgagaaattactgataattcattttacattaaaacatcaaaatgtccatcaaaatcttttttaccaggtactgtataataccgctgtgatgttttactaccaagaagactacgaacgaactttgttgactttgacacaattacaagggcatgaacttcctgatgattacttttacatacgaatacaaatcgagctcttacagaaacagtgtcaaatcaaactcggcaacgactcaaaaaaccaaaacgagttaaaacagctcttggatgtgtttttgattagcccagcttttgggaaaaatggaaagaagcgtttgagattgatccctgatctgatcaacaggctctagagcacattcttgcgaaatatgttgttcatctgaagacgtttatcacgagtggcgttggtatgaatgagcttaacaaaatccaacacgatttggcagactatcagattaaatcttatgcgggcttgttgcagaacataaacatgtttctagtaactagctttaaacaatctaattgatgtctagacgagaggacgcaaaaagcctaatcttagtgctcatcgtggtcggttccgatatgagtactcagattaggcatttgcggatataattcttgaatttgtacgttaagagcggcacatctgtggcacattccatcagtgttttatattttgttggcgcggtgaaaccttcttagagaagcgttacgctgcgattctgtaagctagtctagcgagcacattatttcccgggaaatcctcaaaaattgccaaacaaaaaacggttcagaagagacaagcttgtctcactgaaccgtttttgtcgtgtcaccggcaaagccttgccataacactgacttttaagcattcaagaccttattcaagaagttcttggttcgctcttcttttggatgctcaaagatatcttcaggcttgccttgttcaaggatggtgccgttatcaaagaagaccacccgatcggcaacttccttggcgaagcccatttcgtgagtcacgatcaccatggtcatcccttgcttggcaagccgccgcatgacacccagaacgtcaccgaccatttccggatccaacgcactggttggttcgtcaaacaacatgatatccggatgcatggccaacgcccgcgcaatcgcgacacgctgctgctgcccgccggaaagctgcgccggcatcgcatcggccttgtctgtcagcccaaccacttcaagcatttccttggcctgcttgacagcttcgtctttgctgacaatgcccagttcggtcggtgccaaggtgatgttgcccatcacggacatgttcgggaaaagattgaaatgctggaacaccatgccgatcttttcacgcactttgttgatatcagtgcctttatgggcaatatcttcgccgtcgacaaggatctcgccacttgtgacggtttccaaaccattaatcatgcgcaagacggtacttttaccggcaccggaagcgccgatcatgacgacgacttcattgttggcgacattcaggttgacgcctttaaccacatcgttgtcgccgaagctcttgtggacatttttcatttctactcgatactgactcatgctttcaccttcttctgaacccagttacttagccaggttaatagcgtaataataattaagtaaatcagtgctaccatggtccagatcttaaagccttccatattccgggcaatgatgatcttcccggtttgggtcagctctaacagaccgatgatcgacaggatggaggtatccttcaaggtaataataaactggttgatgaaacttgggatcatgatcttaatgccctgtggcaagataaccttgcgcatggctttcccaaatggtagccctaagctgcgcgcggcttccatttgcccgggatcaaccgcttggatgccacctttaacgaaggccgctgtgtaggccccttcattaagcgtcaacgtcacgatgccggcgatgaatgccgggacttttgacccgatcaggctcggtaccccagtgtagatgaacaaggccagcaccattagtggtaagccacggaaaatgtaaataaatgttgttgctgtgccttgacataacttatttggaataacccctaaaagtccgaccagaatcccgaccaatgttgcaaagaagatcgcgacaatcgtcagtaccatggtctcgcgcaaaccacccatcaaagttgaccagttggccttcaacaacccgatgaacgagcggtcagtcgtctgactgttaccggcagcagttttttgtgactttgcactgccgttgcccaagtaacgttcgatgatcttatcgtattgaccattggcccgcagtttcttaagaccggcattgaacttggtcatcaatgcctgattgttcttagaagtcgcaaaaccataagcaccttcacgcgccggtttaccgacaatctttagcgccatgccattattaataccatattgcatgaccggctgatcttcaaaacaggccgccgagttaccggtcgtcacatcttgatacatgttattggagtcatcaaaagtaactgttgtaaagccgtacttttgcttgacgctgttggcataatccgccgagtccgtaccggttttgatagcaacccgcttgccgcgtaaatccttcaatgacttgatcgtacttttcttcgccacggccatcacaacgccggacttataatacggatcgctcatcagaaacttctgttttcgttctggggtgattgacataccggcaatcacgccatcaatttgcttggcttcaagtgcctgaaccgctgcgttgaatcccaacggcttgacatcgaccttgaaaccttcttccttggcaattgccttgatgagatcaaggtcaatccccacatacttattatcctggttcgcaaactcaaacggtgcaaaggtcacatccgtccctatcgtatacgtcttctgtgctgccgccaccgtcttgccggggagtaatgccccaagcattaaaggcaaggcgatcagcaaacttagcagccactttcgcttcaacctaaacaccacgctttctaatgattacaagcccattaggccgttattgcatgcgccagttgatgatcaactggttgtgcgctaagcccgcgtcttgtctgatcgacacgggtctgattcaaccacgtcttcgttcaagtacgcggctaagcgcagctcatctcctcgcattttggtcgattttaaatctactgtttatgctagcggaatggaatagcgactgtccagcgttgatgttagcttttctgacatttgtcacattattttacgcaagcggactagaccttcatgcgccgttggacccagttactgagccaggtcaggagtgtgataataatcaagtaaatgagcgcgaccatggtccagattttgaacccttccatgttacgcgcaatgatgattttcccggtttgggtcagttccaagataccgataatcgacagaatcgaggtgtcttttaacgtgataatgaactgattaatgaaactcggtaccataattctaattccttgcggcagaatcactttccgcatggctttgccaaacggaagtcctaaactacgcgccgcttccatttgaccagcatcgactgcctggatgccgcccttcacgaaggccgccgtgtacgccccttcatttaatgtcagcgtaatgatcccggcaacgaatgccggaattttagaaccgatcaaactcggtatgcctgtgtaaatgaacaatgccaacaccagtagtggcaagccgcggaaaatataaataaacgtcgtagcaactccccgggcgaagcgattcggtaaaacgcccagaagtccgatcagaatcccgacaatcgttgcaaagatgatggccactagggtcacgaccatcgtttcccgcagcccattcattaaggttccccagttttcccgtaacaggccaagaaaactgcgatccgtatcttgggttttggcgctggtttccttttgggccgcttgtgttccgttgcctaagtatttcgcgacaattttggcataggtgccgtcagccttcacttttttcagtccggcattgaaccgctgatccaactggtcgctgcgccctttttgcgtggcaaagccataatagctcgccttgctttcgggaccggcaagcttcagcttcaggccggttgcaatggcatattgcagcaccggcttatcatcaaaacaagcgaccgagttccccgtaatcacgtcctggtacatattattggaatcatcgaaggttacggtatgaaaaccatacttgtcttttaggctcatcgcaaaatctgccgcggctgtcccggtctttaaagccacccgcttgccccgcagatccttaagacttttgacgccgctatttttcgcaacggccatcgccaccgcggttttgtaataaggatcgctcatggcaaacttctgcttgcgctccggcgtaatctgcatgccggcgatgaccccgtcaatctggtgagcttcaagtgcctgcaccgcggcattaaatcccagcggcttgatatccactttgaagccttctgccttggccactgcttgcatgagatcaatatcgatcccgacgtagcggttgttcttgtctgcaaactcaaacggtgcataggtgacatccgtaccgatcacatatgtttttttcgccgcctgcgttgataccggcatggtcaagccaatcgccaataccaacgctgctaccccggcgacgcaccacttccaaacccgtctcataaaaacaccatctttctcattcgaatcctaatgcaacgctaaaccattcaatgtgaagcagccatcacgagctgtgggcaaaccagttcgcaccggcaacattcacaggtaacaagtctaccgattttatgagagcttgtctacgcgcgccgaatgcaagattgttttatacttagagaaactaaaaagaaaatgggatgaaatgatgtttagctacttaattgactacgatcttaaactcgcactgccccgcccggaaattgacggcccgcttttatttgaacagatcgaaaccagccgtgagaccttatcagcctatctgacttgggtggacgcgacgctcaccgctgacgacgagatcaactttttaacaaccgagctaaagtccttcggcgagcaaaagtcattaaccttggtcattcatcaagccgacgcccctgttggtctgatcaccctaaacaccattgaccaactcgtccaccacaaagccgatatcgggtactggttaaccacaccggcacgtggtaaaggtgtgatgcacaaatccgtcaaggccattgcagacatcgccttccacgactatcacctgaacaaactgattatcaacgccgctgtcaccaatgacgccagcaaccacgtcgccgaaaaagccggcttccacctggacggcatcctgcgccaagaagaccctaaccctcgcggcggattcttcgatgtgaatacatactcgttgctacgctcagaatggtcataatgtttcacgagaaacattttgttggtcaagttggttctccgtaaaacaagtagttggggcatagttcactatggcaatataaaaacgaacatactttagcagtaactgtatgttcgttctttgttctccaagaataattcgttagaaatgtcgagatattagtgccaaagcggagcaatcgtaggccagatggggctcagtggtgaaatcattgttggcggtttaccgcttacaatgaggccgagctttgagactctgcgggctttgcagaggctcaaagtcgtgcccaccacgttccagccccatctggccggagattgcggagtttggcacggcatggaacctattgccagaaccttttctgaatcatttggaatttattaagctgttaattctcttatagaattatggctcatctttttcttgcttaaacaagtgtcaaccgcaagcaggtcaatgtacgatcaaccgtaaaagcaccggcgtaatgaagccttcgataattgccgcaaaagcaatcgctggtaccacgatggcgaaatactgtaccgcaatggctttggcatccagcggcgacttttcatagtggggattggcaaagaatcgtttgatcgattggcgtaacgccttgttgacctgcgccgccagcgccacagcgacgatcatcgcactcatttcaaagatcccatgtggcaaaatgcccagcacaaacgcaccaaaagcaccgctgataccgagtttggccgcatagataccaagaaccagaccgaccgaagcacacgtgaccacgtacgaaatccaatataagaatggaattgggatcatgcccactaacatcatcgtgaaggtgacccgctcattgttcagcaaaatcgcccagaaagcgtgccaattatcagtcgctccaggaaacttagcggacaacccggtcatgaggccgcggacaaaatgcggatttgacttcatgacgatataacttaacaggcccaccaagatcgtcatcacgatgaaaatcagccaaccgattaatagataatgtccaatcacattcaggtgatacttcagtcgttctttcatttgcttgcccccactcattggatggttaccggctatggtcacagtataccgcaagcaaaaatgtgtcgccattgagaagattccggtgccaaaatgaagcccgcagtacatctgctcgtcaaccgcgtaccaatcggcgcccggtctgcaaccgatatattcatatttttttacaacacggcaggaaacttgctgtttggtgctttttcctgaataatggcggcatggaggggatcacgatggaaatcaatgaagcgcaatcaatcttttcggcagcgcagcaacaagtcgcgaccattgtggttggcaagccgatgccgatcaagctggcctttacggctttattagccaacggccacgtcttatttgaagatattcccggcgtcggcaagactaccttagtacaggcgatcgccaaaacgctggcaatgcctttttcccggatccaattcacgccggatatgttgcctagcgatgttctcgggacgtccattttcaaccgcgctacgaatgcatttgaatttcagcgcggtccgatttttaccagcatcttactggctgacgaaatcaatcgcgctaccccacgcactcaggcggctttattggaagcgatgggtgaacgccgcgtcaccaccgacggacacacttacccattgtcgcctgatttctttgtcatggccacggaaaacccgactgactatgcgggaacctatcccttgcctgaagcgcagctggatcggtttatgttgcgactgtcgcttggctatcccgatgccgctgctgaaaaaagtttacttctaagcccggaccggcaaactatgattgccgccttgaaaccacgacttgatcccgccactttagcagcgagcaaaaagcttgtcacaaccatcaccgtgaccgatgcgattgccaattatgttcttgcgcttgtcgaagcgacccggacagaccaacggattcgtttaggcattagcccgcgtggcggcattgcgctggtaagtgccgcgaaagccttcgctatgctcaacggccgcagttatgtgacccctgaagatattcagacattaacaatccctgtctttggtcaccgcttgatcatgaaagatccaacttcttcgtcaactgagattctaactgacattctgcaacgcatcaccgcaccagtccgggggtgataccacatgcattggcgcaatttttatataaatagtgcacttgtcgtcttgctcagcctgctcgtcggtttcggaatgacgtttaactcaccgaccagctggtttgtgagtgaatttgccttgatgctcctcctgctgctcgcactgccactactttggccgatgcgtggacatctgcgcttcacgcctaatcagacaacaatgatcgccgagcgcccgaccatgcgccatttgacgctaacaaaaggcagatggctgcccaacttatttttactagatgctgccaaaaccagcacctggcatctgccggttggtcaacgcaccgccaaagttaccttgcagttaccacggggcgtttatgatcagctgccgttcaccgtgactgtcaccgactttttcgggtggttccgcaaaacccttcccatgcaactcacaaccccgataacagttggaccggttcgccagcccgagactgctgccaaaattgccacggatttttcacaaaaaatggcggcatccgacgctggcctacctagcgaccggattaaaaatttccgcgaatatttcccgggtgataatatccaacaaatcgcgtggaaaattagcgcccatgcagattcactgattgttcatgatgatgagtatgaaggccaaaccgcttggacgctgttgctggttgtaacgccttcgctgcctcttgaatcagccttgactctttttgcgagtttgctggataccggcattttcagtggtgacggctacttgctggatcagcggctaacccgtattccccgcggccaacaagatgcgctactagcgggttttcatcctgaaggcgtcgctaatcccgcggctttagtcgacttggcatcaccacaacatcatcgcgcctatctcgtgctgacggcggattcagctacagcaacaccgtttttgcaagcactctcgcctgctgctgccactttgatttccttgtcaggaggtgacgagcatgcctaagtggttgcagcgactcatcatggttttattgacatggtggctcctatttctttttttggagccatttgccgacatcaatccgatcggccacccgcgtgcactggtggtttatgtcatcggcattagccttatcctttatgtcgccacgttctggccgcgatggtggcctttgtggggtgctatgacagtcgctgccatgatcggcgggctttgggccattgtgccgttaaaacagccatttggcatctcttggttttccgcctatctacagactttttccgcggcgacctcaaagtttttacgtgtcggcggtgtcgatgtgccaactgtgctcagcatgacgctgattattactttagtagcatttctcctgcttttaacagttgtcgtccggttttatcccggcgccattgcgattgtgctcagctatttactagccgttcatatttttaacggcaatgatctcacggcacaattcattcaactcgcggtactcactggcttgatggcgatgctgcatctttatggcaatcattggtggccgcttttaattggctgcacacttatcagcggggtcacgctcggcttggcatggctgtcttcagcaacccccttgaatgaacaattagccaacatgtccgttccatttcgtgaccgtttaaatcagcgaggcttctacgcaggcattcaaacttacgtcaacggccccggccgaaccggctatacggaaaacagtcgcgtgttaggcggtccggtttatgacgatcccacgcccgtttttacggctaccagcgccgaagccagttactatcgcgtggcggttgatgctgcatacaccggcaccggttggcaacctggcgtcgatcaaagtcagaccgtgccgctggatggcgccatcatgcgcgatccaaatgcttcggttgactatggtcctgcccaaagtacaaccttgaccttcaacggcagcaaatcatttttaccgcttccttatgggcaactgacgttcacaggcggtcaacccgatcccacgactgacttcctgctcaatgctgccacccgccgcgtcagcacgacaaatcaagctccttttcaacgcttagacattcaggtgcaggcaaaacaaatcacggccgcacaattaaccgctgcaaccagcagtcgccagcaagttggcagccgctacctacaattaccatcaactctgccgaaacgtgtgaagcaactggccgaaaaaatcacggctaaagcaccgacgccttatgaaaaagtgctcgcgatccaaaactatctcaaatccgaccctcgcttcacttactccaaaaccgatgcgcagcggacaccacccggtcacgattatgtcgattactttctttttgattccccaatcggctactgtgataatttctcctcggcaatggtcgtgctatgtcgcagcatcggcttgcctgctcgatgggccaagggatttaataccggaacttttattggcggatcaggccaacacaaacagtatgtgatccgtaacagcaacgctcactcatggcccgaagttttcttcaaccatttaggttggctgccattcgagccgacgcccggctttaatgatcccgcaacgccagaagaaaatattccctcctcatccgctaacaacagcgtcgctaatagcatgccgtcatcatcaagcatgagctcgtccgcctctatatcgcgtacaccatcaactggttcgccatccgcaacgaaaacgcattctcgatcgtctctcagcaacgtcacctggctcggcatcttgctccttatcgtcattttgttgctgactgcacttgcattctggcaactcccggcgcttgtcgcctggctcattggcattggacttacggcaaccaacttcccgcgccgctatcggctattgctctggagcttgcggcgaattcaacatcgtcctgtcagccaaaccttaagtgcgtatgccaaaataattgatagacgtttgggtgaacaaactaatatgtccacactaaccgacgcttacgaacaaatgatcttcggcaaaatgactgtcgatgtgcggcctttaatcttgcctctgcagaagcttcgcggtcaacttgtcgcttacacgtctcgcaggtttcacgtgaaacatcgttaatctcatgaatcttttcacttgttccacgtgaaaccaatcaaaacatgccaacttttcaaagaatttgatcaaaacaatcccgtcagctgtttcgacatttgtagctgcatcattgtgattgtttccaacacgctctagacggcatattttacctgtttccgttcaaaagcaatcgacaaagcccctcacttcacaaaataagttatgcattgcttaagcgcttccttaatgttgcgccgattttcacgtgaaacaaaacacgaacgattaatgcaactctcatggtccccctttttcgacgagcacaccttgcgctaacccctgatgtatcaaccttgcagcgaaaaaacttgcgcttactaataaaaagcgcgtatgataatataaacagttttgaatatcctttaaaaagctgttctgaccccgctactatttttagtagtcgtgccacttcgactggacgctgcagtcagttcgtaacgtactcagaagaaaggggggagccgctgatcgttagcggcgaacacttatgaaagttatgatcgttcttgaaaacatcgtgatggatggcgttaaacgcgcttcaacggttttaggtaatgatctcgttaaacagtatgacgtcagtttctacaccttggcggatgcacctgcctattttgacttgaacgcgcctttgattattgcccggcgcccaaccgatcccaagttgctgaacttttttggcagtgatccttatactcattaccaggatcaaatcgaggatctcatcgctacgattcgcgaccagcatttccaaactgtcatcttgcctgcaggtttgaccactagttttgcaccgctgattaaacgggctttgccggacgtgaatctgattggctggatgcacaacaactatgctacttacatggaagattactacgtccagatgcaagccgagtttgaaggtggtcttcaagctgtcgacacactggtgaccttgaccgaaagtgatttgaactcatacaaacgcttcaatccgcgaaccgttaaaatctacaatcccctcaccttagtgccaactggtgaggcggacctcgatgcccaccggattgcgttcaccggccgcatcgccatcgcccacaaaggtatcgacttcctgttggaggccgccgcatctttacctgacgattggaaaatcgccattgccggtggcggtaccgatgaagacatgaaaaacttttatgatctgatcgattacttccatgtgagcgataaactcatttatcagggaccgttaaaggaccaagcgcttcgagatcactatcgcgccgcctccattttcgtttcaacctcacgttgggaaggcatgccgcttgttattggtgaagccatggcctctggacttccggtcgttgccatggaaaacaccggctcacgtgagtacctcggcaacaatcaatacgggctgctcaccaaagcccaggatgttcctgactttgttgccaatctcaaaaaaatgatggcacaaccagagctgcgtcagcactacgctcatcaaagcctagaacgtgccagtcactttagtccggaaaacattgtgtcgcaatggatgccaattattgaacaccagccaaccagaaccaaggttgccggctaatatttgccagaaattgtcgatgacgacatgaaaaagacgcttgcgataaaaatgccgtaagcgtctttttgatttgtccggtaactaaccgcgaccattagtgaaccatgttccacgtgaaacgccaattctcacacataaagttccacatgaaacacaacataatgattcgactgtttcatgtggaacaaccagctcccccagaaccgtccacctcagcgcttctccccagcagcctccttctgaaccggctcttcattggtcatcacggccggtgaaaaaagatgggcaatcaacgtatcaggtaactgatgctgccgtctaagcagttccggaatcgccacatgcttttcaagactggttttgacaagttttgtggtggcttcatagcctaagtatgggcttaaaatcgtggcactaatcgcggaatgctcaacattttcagcgcactgccgttggttgactgttaagccagtcacacagttggtggttagcgtatcgatgccgcgcgccaagtaccgctctccctgcaacaaatcgcggaaaataatcggttcaaaggcattcaattccagttgtcctgcctcggcagccatgctgatcgttaagtcctgtccaatgacctgaaaagcgatttgattgaccacttcaggaatcaccggattaaccttccctggcataatcgaggatcccgcctgcttagctggcagatggagctcgttcaacgcagcctggggaccactgctcaataagcgcaaatcgttggcaaacttcgacaaatcagtcgccaagcctttcatcgcaccggaaaaagcaaccaaaacatcgcaattctgcgttgcatcaaccaagtcttccgcttgctcaagatttaaagtaatcaaacgattgacttgccgaacaatgtgttcccggtaatacggcgaagcatttaagccggtacctatcgcagttccgcctaagttgacaacccgcaaatcatcagctgctcgcgtcaatcgcacctgatcgcgctgaaacaaatgcgcatatgcctggaaggtatgaccaaatgttgtcggaaccgcatcttgcaactgagtacgcccaactttgacaacatcagcaaattcatcagctttaactagcaatgatttcactaaaaatgtcaaagcctgttgcaacggtggcagtgcttgcaaagccgccattttcccggctgtcggataagtgtcgttcgtcgactggcactgattgacgtcatcattaggatgcacccgttcggtcgtgtgacggctcgccagattggcaatgacctcgttcacattcatattcaccgatgtccctgcgctcccctgaatagccggggcaaccaacgcatcgttgtgttcccccatcagcagactattgcacgccgcaataattgccttagctttcggcgccgtcagcgtcccagccgcagcattgacttgcgccgcggcctttttgatgataatcaaactcttgaaaagtaacggatcggtccgttcatgactaatcggaaaattcgccagtgcgcgggtggtgtggatcccgtacaagacatcctcgtctactgccaacttgccaatacaatcttcctcgatacgcattgtgaactccctttcatataccaatatttacgttatcagtatatgcgtgtcacaacgcgcgtcaacgtttggtgtcaggtagtctgacaaaggcagtaaaaagtataccaatgttttaaaaattaccataaatttcatggtcaaacatcggacacaggcaatcttcccccatcattccactgaccgatcattcgatgtgcctgacacgcattggcaaacttagtcaaccgttggcgaaacagctttggctgattgcgtttaatttgaatggtgtcacatctgacacgttgatatagtgccggacatgattgaaaataagcccacgcaccaggccgcctcttaagagcacgaacaatgctagcatcgattttaaaactattgggatccatatttggcaacattgcatacccagctggcgtcatccgccccaaatggatcatgcgccgacatcgctctttatttagctccgaccaaatactcccagtttgtctaggaacaaatctttgtgaagccggttgatccggagccaattttttgtatgtactatcaatccatccaaaacacatagcttcttcaacagcatcaacataccaaaatgtgccatccggtttgggcacaccacgtttaacatccacccaacattcagtcgcatcttgataatgagtcgctagccattttctaaactgctgacgattagtaacggttaaatgattaacaatcttttttaccaacttttctgcttcccatactgattttttggccagcgttaataataaaaattctacgtaaataagacaactttacgtagaatccggatttgattaagcgtcaacagtcaatgaccgcgatgcttctccaaacgtttggtctgtttcttcaaacgaacttcacgagcatgctgatcttttaaccgctttcgtcgttgctttttcaaccgcaagttctgtttgtgctctaacttcaaaagtgttgatgctcggccttttctggagttccgaacctcttttcgtgcttgccgactgcgcctcttcgggttcatcgtcagtggcacttcagaaagaacgctttcttgggccgctacccagtgcaagctgctccatcgttgttgaatcaaacacaacaactcattcgttgtcggagcctgcgtaccaaatgtgaccttggcaacacgatacgtgtcccccactacttgttcgaatagcccccgataaaagggctgttcaaaataaactgttagcttgccttgattcgtcaaactaacacctcctttaagtttttcacgcaatccggacatccaaggaggaaggatactgacgacctaagccgcgtctggactaccaaccagactgtgtttttgataacgcagtgttattgtctgactttgatggggttgtgtcaaatagaggttttgctttttaataaaccgacctgtgcatgtaaagatgagattaacagatgatacgatgcatgactttattaattccgaatttattcaaaaacctcctgacagtctacaacaccaaccctgtcagaaggttcacaacaaaacctctatccctcaaccgttgccttagccgcatgccgcacactttcggccacgacttcggcaacatccccgtcaaacgcattaggaataatattcgttgtcgacaattcagtgtctgggattaaactcgcaatccctttagctgccgcaatctgcatctcaatcgtaattttacgtgccctagcatccaaggccccgcggaaaatgcccggaaatgccagcacgttgttgatttgattcgcaaaatcactacgccctgtccctacaatataggcaccaccggccaaggcctgatccgggaaaatttccggctctggattagccattgcaaaaataatcggtttatcagccatcgttttgatccattctggtttcaaaacatgcggtgccgatacaccaacgaagacatcagcaccttttaaggcatcttccaaagtaccggtacgattttcccgattcgtaattttggcaatagccgcatgatgtggtggcaattgatcggcattcttttccgccaaaataccgaccttatcaacgaccatcatgtgcttaacgccagcggccaggaagcgacgcgcaacggataatccggcagagccgccaccgttaacaacgactctgatatcgccaatgcttttaccagcaactttcagcgcattgtatagcgcggcaagcaccacaatggcggtcccatgctgatcatcatgaaaaaccggaatattgagttcatcaatcaagcgggcttcaatctcaaaacatcggggtgcactgatgtcctccagattaatcccgccaaaagtcggcgcaatggctttgacggccgcaataatttcttcggtatcctgcgtatctaacacaatcggcaccgcatccactttagcaaaacgcttaaataacgccgccttaccttccattaccggcatcgctgcctcagccccgatattgcctaagcctaaaaccgctgagccatcactgacgacggcaacagtgttcttcttggtcgtcaaatcatagaccagcgacgaatccttggcaatggcagaagataccgcgccgacaccaggggtataggcaatgctcaagtcatcccgcgtctcaatcggtaccttgggtgttacactcagtttgccaccatattgtttggcctgagtcagtgctagttgattgaaatccttcttagccatgttcgttctcctcctcaattctgaaaaaacgtctgtctaaaacactatccgcaaaatagcggtcatcgtaatcaccgtgatcgcaccgcctaatcgcgtcgcaacctgcgcaaacggcatcaaattcatgcgattagccgtactcagaattgccacgtcgccagtgccgcccatcccgctttggcatgccgttacaatggccgtttcaaccggattcatattcaaaaaccgagccacgaaaaatccggtcgcaactaccgtaaacacaacactgatcaccacaataaaatattgccagctcagcatgcccacgacgtcttttagcggaatgtataagagtcctagtccggccatcaacggaaaagtaaaattactggaaataaacttgtagagttgcttggcgccacgctgcgtctctcccggaatgacattgagatacttcagaatcgccgcggccacaatcatcaaaaccggtccgggaaaacctgtgaccgactgcagcagcatccctaaaatgaataacgtgcaagccgtgagtacgccagcgcccatcattttgagatcaagtgggccggtatcatcttttaaggcatcggcgagatcgtcttctgcgccattgagtcgcaccaattgcccctgtccagacaactctggtcgcttttctcctagccgattcaacaaacctgaacacatgatcgcaaagaagttaccgataatcgtagccgggatcagctgagccacaagcgcgccgctggtcgtcccggtgatcgtactgtatcctaaagacagcggtagaattccttcaccaattccaccggccaaaaccggcgtcacaatgaagaaaagggtatgcttccactccaaccccaacaacacgccgaccaaagtgccgacacccatcgcaaggatcatacccagcatcatcggaacgatcatccgcattaagccttggatcaagatctttcgattcatccccaaaatgctaccgcagaccagacacgcgatatagaaataaagaaaattcgcttgtttcatcagcatatcggtcgcttttagcacattgggattcatcgcgttataaaagactaaaatcgatggcacaagtaatgataaaatcgctggtccgccaaaatttttgacgaccgggatattggcaccaatcgtccctagtaaccaccccaacgttaaaataactgcaaaaccgccgagcatgttcaccggcaactgctgcatcactcccgcaaggacaataacagctgccatcacaagataaaccggcagcggcaccgaaccgactttaaaacccatccacttcccttgtgtccctgaccccatcttagctgtcgtggatttgtttgccattgttttctcccccttcaactgcttatttattgacagcttaatgtaagcgctttatttagggaagattatttaactttttaaagcataaaatcatttctttaagccttcaataactcgttcacaaactatttcaccacttaggagtatgaaaaacgtgaagataaaaggatggcgcctgtggggctggctttcgctcattttcacctcaaccctgttagtgacggttttcacggtctatggcttaaccatgctagaaaaccggcagcagtttgaaacccgcgaaggccaactgttacttgcgattggtcgccaattagcccgggaaccacgggtcatagcggcacttgaagccgatcatgcggatcaggcaacccgctcctacgctaatacgctggcgaaaaacttcaatctggacttcgtggtcgtgatgaatatgcaaggcatccgcctcacccatcctgatcccagccagatcaatcatcattttcaaggcggcgacgaagtaacggctttacgtgggcatgaacatgtctcggtgcgccggggaacgttaggccgatcactccgcggcttcgttccggtttatcgagatggtaaagagatcggggttgtcgcgttaggcatcaaagtgaccgcgctgcaaactcttatccaccactcccagatcggctttcgtttggcattgcttgtcggcctggtcatgggcatcctgattgctttcttggtcgcctattatattaagaggcaacttcacgacttagagccgcgggaaatcgctcgtttgcttgaggaacgaaatgccatgctcgaagaaacaaaagatccggtcatcgtgattgatctcaaccaaaagattatgttggtcaacaaagctgccagcaagctgcaaaaccaccttatcccgcaaagtgcatttatcggccaaccactaaccgcactgattacacatcccgaacacgttaagctgacggtcaaaaccgaacagttctaccaacaagacggtcaggactaccttttctcggccgccccgattatggttaaaaagcaaaaaattggttacgtgatctttttgcgaaatgcgactgaagcgattttcgttgccgaccagctggccaacaccacaagctacgccaacgccttacaaagtcaatcccatgaattcatgaacaaactgcatgtgatttacggcttggtcgctatcgaacaatacgacgaactggcgatctatctgcaagatctactgaaaccggaacaggaatttgccaaccgcctcgccttactcgtgaaaaatccgcttattgccggctttatgattggtgaacgggaaaaattctcggaacgaaagaccaccctcgactacgaaattttcccggaactacccgccaatcgcaatgtagcagaaacgaaaacgctgctaacgctcagccgctacttgcattttgcccttcttcagcacgatctgcctgacagcatgctcattcaactggactatgcagacaatcgactaaccatcacctaccatctaggcaccataacaaatcgtgatgcacttttatcattcgttcatcaagcttacttccagcaattgctttctgatttacacggcaccataacattcaaccaagatggcccgctagtattgaagttagttgtagactatcacggcgacgaccttattctcaacgaaaagagggaaaacacatgacaagcattctgattgttgaagacgatccgatggtgcaattcattcaccgtaactatttggaaaagatcggtacattttcgaatatttactcttcagacaccattgctgaagcccggaatttattagcaactcgatccatccaactcattcttttagatattcggctcaaggatggtaacggcattgaccttctaaccgaactgcgacgtaccaagcaaaccgttgacgtcattttaatcaccgcagccaatgaagttgaaatcgtcaacgatgcactacacttaggcgtcatcgactacctcatcaaaccattcacgctgcaacgcttcgaaaagagcattcaccgtttttacgccaagaaccgcatgtttgacagcgatcaactcaatcaaaaccaactcgacgcctatcttgaaccacaatcacatgcatcagccccactcgaactagataaaggactaagcatggctaccctaaaaatcatccaagaggctatcgcccaactcccacaaccattcacggtgcctcaattaaccgccaaaaccgggctttcccacgtttctgtacgtaaatatttaaattttctggaaacccatcgttttctaaaaagcgacaccatctatcgcaaaaccgggcggccgtttaaaacttacaagttactaacaactttgccgatttaatttccgctctttggtactttacctcctgttagaagttactaagggtaaacgatcggctagataatcttttctcggtctccgagcttcgctgcaaagcaagcccactttcttcgttgtattttcttcccaggaatgtgctcgtcagttataatttaagtgtcatagccattggtatatccaattgaaaggagaggagtcaatatggaaatcagcaacagtaaattgggacagctcttctctccttcaacgttgcgaaagctcatcgatgatccgacgatgccattcatcacccggttaaaacagacacaaaacgctccgatacctaacaagaagctctttgatgaagcatacgcccttatggcaaagcaatatcgcaatgaatacttttttaagaatacactgcttaataaaatcttattaggcaggcatagtattcgtacctcgacagcgatcagagaactacccgttgcagggtccatcttggattttttaattattaacggcgttggacaagtctacgagattaaaacaaagttggataacttgaaacgcctttcatcgcagttatctagttactacaaggcattcaaatacgtctcagtggtcactgataacagccatgcagaggtattgtacgagcaactgcaggggacagacgtgggcttagttgttctaacaccacgtcaaaccctgagtactttgattgagccaaaagaacacctagcggatcttaatcaggcagttatgttcaaaatattgcgcaagtcagaatacgaaacagctcttttagattattttcatgtgcttccggatgttagtcaatttgaatactatcggacgtgtttgaagtggtttgaagaaattgatgtggaaatttgccatcaatatttactgcgagcgctaaaaacaaggaataatgttcgtaagcacgaaaaagcatttaacaatgtccccacgagcattaaagaactggtatactttcaagattatagtcaagcagagtaccagcaactgttcacaatgttggatcaggaataatggaggtagtttaaatgtattatccatacttacgtgggaaacaattcgagttaattgctctgcgtgagatgcttaacgagcatacattgaaatctcgtgtagtgccaattattgaaccgattaaagctagcagcacactaaagagttcgcttcggagctttaacgatgaaaatcacgacttagcggtgattcaaaacccgcaggtaacggcctacaagccatttgttgataacaaggaagttacttcattaaagaaagagcgctcttttattccggctgttattggtacaacagagcaagcggttgctactttaagtgaatacgacaacccaaagtcaatgattatactcccaagcaatgctcatccggcattgaactggcagagcctagtttggaaacaggcaatcaaagttattgctcctgataatcgttcgttacgacggcacgctaatggagaagtagcagtgctggaggatgcgtttgacaaagaatcgcgtaacgcagactatgcggatagaggcgagcagttcttttcggatacacatatttattacaagcaggatggttacactggatttagcgactactctgtgattggttctgaatatgttgataagggatttgctccgagagccgttgcaattcatatcgtgtatttccggaaagatgaagaactttggatccgacattttgtttcaaaaacaaacgatgacatcaatgatgttcccggaaagttcgccgaagcactagaagcgttgatggaatggtaccattctcccaatttcgatcatgaccgcaatgattcacgagcattaaaagaatttgaaacgatgtcgaagctcaaacaatattcggggttaggtgtagtcaagaagctgtctattaaacatcatcttgaaattatgggacgttatttagcagagagggccgacgcatgaaatgttgccttaattgcttccgcgacatacagattcgcaactggattcagagggttggtgaagagggctgttgcgatgtgagtagtcgtcatcgcgcacagttgactaaaacgattgatcttgatctgcttgaacgcgatgcaagctacatggaaggttttcaatccgagttcattgaaatatttgatttatatattcctagtgagagtcatcatattcatcatgctcagaaattgtctgcacagctcagagaccactgggggatttttaatttagaaacaaatgagcttgaggtgcttttaaaatatttggctccaacctatttccgcgataatccgaaaatgttgcaagggttggtaatacccttgcatgtgactagtgaagagtaccaacttgaactaggaatcttctcggggaaaagttgggcggagtttgaaaacatcattagacacgagaaccgttatcacagtggcatcatggttactaaaaacttaacttattttttacagttcttggtaatttcaatagcggcagatgaaacatactactatcgcgcccgaaagatttcagaaatagatctgccacagcttgatgttcatgacatagcaacgattggacctgcaccagtagttaaagctggcgccggccgtttgaatgcacccggcttttcatatttgtacttgggtagcaacgagacaacaagtttagtcgaaatcaagactgcaattcgagatcttgtggcaattggtacttttaaggtgacaacaccgttacaagttgttgacttagatggattggttgaattaagtccgtttggtggcgttgataaaatggcgtatttagttaatcgccctattctgttggatatcgacaaagcgatgaggcgtccaagtggccgtaatcgttctgaagtggattatgtgccgacacagtttattagcgacctgatcaaaacaatgggtgttgatggaatgcgctatgctagttcggttgatccattggcatttgatttggttttgttcagaactgataaaatcagtttggcaggcaacatcaaaatatacgaaattgatcaactaacgccgcatcgaaaaccggtggacactaagtacctttcctagttatcaatgtccgaggatgtatgaccggtaacagccattatcttaattcatgcattacgggtactcaaaagaacaaacagttgtagccaacattcgcgccattgcgatagtttcgttctaatcagtaacatctttcatcagcctggttgttttgcgctaaattttgcgtgcacgcaattctgcaaactctaccctcaagagtttaaacgttatgacaatgatttatcgcgattcggtgacaaagaaatattgtttgcgaatgtttgagcccccttgaagaaagcccaactaaagtcagaaattaaaaatcagccatagcaaaaatccattagtgccagcctgcttcgctggtactaatggattttctgcattcgacagattaccgcaatgacgaaaagcgttgtcgctttagctaccacttcaacatcacttaatgactagtcaccatattagtaaaaacccgtgacgtaatcacccgattatcctcgcttttaggaagctgcttggaagggttccgccagtggtagtggtccaacggtttcacgcgaattcgacgggtttccggatatcgacgatgtaacgaggccaactgatgcgcccacacccgttttcctgtatgtaagttaatcaacgcataaccctcaccgcttacaccggacttcaaaaagtcgtagttgtcatcttcctttgccttcacaatcatcacctgaccatgccacccagcggcttgaacatggtaaagcagcgtgttggcatcagtcgttgtctgtaactttttaggaattcgctcaatcaaaaaagggccaatacccgacttaacaatttcaaaattcccaggcaacttaatcaaaaagcccttagcatcagcgccaggatcgcgtttgtttttaggaccttggtgacgaagactgacaaaagttacaagcacaagcgccaatacactgacgatcaggacaagtgatactaggtgttttcttttcaaaatgaccacccaacttttctataagctgcattgtttgcggaaaattccactatttttagcataattcttgcatgcacattcaggcagtctggaccaaaaagttaaggtaatttcatgtttttagtggaatttctgactgatcataagtatcgacgtttgtttcacgtgaaacggtctaaagtcgttcaattttctctcagtttaaatcagcttcttctataaaagtcgtatactgaagccaagcgtcacgctaacattggactaatgatcaaactcagcgaggtgtttgaacgatgaaaattgtcttactcgatggctacgccttaaaccaagatttagactggggcgccttatgcaatctgggcgaatgccatttttatgatcgcacgccgaatgacgatgcaaaaattttggcaaggattggcgatgcagatatcattttgacccacaagacgcctttgacagccgaaacgattcgcactgctccgcgccttcgatacattggcgtgatgggcgatggctatgatgtcattgatactgaggcggctagtgaacggcatattccggtgacaaatgtaccgatttacgcaacggatgctgttgcccaattcacctttgccttgctcctagaaataaccagtcatgtcggcctccacaaccgccttgttcatgaaggcaagtggccgaccagtcccaatttcactttttgggcaaagaagctggtggaacttaaaggaaagacactgggactcatcggttatggccgaattgcccagaaagtcgcgaccattgcgcatgccttttcgatgaaggttatgttttataatcatcggcccaagccgcatgacccgaacattagccaacaggttagcctagatgagttgctgaagcaggccgatatcattagcctgcatgttcgccaggcgccagaaaccttgaatatgattcgccacgagacgatcgaaaagatgcgtccgggaacgattattattaacacggctcgtggcaaactcatcaatgagcaggatttggccgaggcgttaaataacggaaaaatagctgcagccggtcttgatgtcgcgcagcaggaaccgatcagtccggacagcccattgttaaccgctaaaaattgctatatcacaccgcacattgcctgggcgccgtttgaaaccagagaacggctgcttgatatcaccgttgcgaatctaaaggcatttcttgagcaccatccccagaatgttgtcaatgcaaagtagcatatgagaatcatgtaataaaccaaaatttccttataaatcttctgagtcaatcttttctacaactaaaaaatggatcgatcacagccatcatcgccgtgtgcgataatccctttatggttgtcagatgaaatatcataattcatctgatgatcatggagggattttctatgcccagatctaagtacaca
